United States Patent 7,365,185 (GENOMIC PLANT SEQUENCES AND USES THEREOF) - sequence listing, part 51

SEQ ID NO: 67069 - DNA, 11508 bp, Oryza sativa
agtgtcagtagtttgggcctcgtacgcggagcctcctgaatattagtagcaatttaattagcagagagctcagaaaaaaacacgaacatcaacctaatatcaaataattagaaagggtaagacttcgaactcaggtcgtccagcccaccacctcgtggagttagtcgaaagacccctgcgtgtttctttaattagcagagagctcccttgatctaatcatcaaactgtcatcaaagcaagcttatctagcgaaaatgctcttgcagtttcagttgcaatgtaacaatcacaccgcacatgcatgcagtggactagattttgtttatccccgtatagcaaagccaattccatgtcccagtattttagcctaatctgttcgtcaacagaaaaaaaggcagatgcaacagagcctgcatgttaatgacaactatattaatgacagagttgaccatgccggatagctactctatgttaatgacaagttgacaattagtactagaatacgctggtgcacgcttgtcttatactcccttcgtgatcaacgtgcaacagagtatataatttaatgatgttcacatcgcccattgactactcttgggtggatttggattaattaatttggcccctgtccacctaatgtttgatgcttacatatcattaattaagcatccacatggttcatcgttcaagtataggttaagtagctagtttctcataggccgaagacgcctgcatggagggagggtttatctgaccctgatatcattggagtaacatatataatctgcattaccgccataatgacatatatggagtatcagtcttgagtttatgacacattgttactatatattcagaccaatattactaagaatatgaaccctcgaataggcaagaagttcggatcctggtcaactccttcacatgccaacttgtcactactgaaacatatttgatgcctgaagttaggatcaacatgtattatcatctatcataacctgggtcattgttcatccacacaattgatgacgtaagtctattgatagactttcagctgatgataagacacacctaaattgaaaattgaaaaattaattttcatccttaatttttgaatcaccttttttagactctctaactttatttcataatagaaacatatccgtgccagagtggaagtatgaaagtcttgcccaaaatcatttttcattgggtcggttactttttcggtctctaagttgtgtttcaactaatgagattacaatttggtgtctatcagtagatcgccgcagtaatatgtgtctccatcctaaaacttcaaatttacgaaacaaaatgtttaaatctagattagaatttcaaaaaacttacaaaaattcgaattatttttgattttttttgggtatttcttccccggaattcctttttggattccgaagtactgaacctctctctcacacccacaaagaagaaaaatctcattcatgatcacctcatagttgcaacaataatacttgcagaaagccagaaacacatcctacaatactacacacctattagtaccatttatcacgcaatttagtcgcataacaatgctagctaggagtagatttgaaacagatcaatctcatcgaaattcatgaactcatcggcgtcgacgaacgagctgtctccaaagtcatcatcccagttcaagcagcccagcagatcgggctccattgccggagacgaacaagaaacgacgtcggccggcgaactcaccgctgacggccccggacacgagtccactggctcttccttgctcatcttcaccccggattcctccccgtctccctccggcgagcacctggactgcctcgacgacggtggggtggccgccgtctccctccagacatcgccgtcgtcgccgtcgtcgtagagcagaggcggcgaaccgctgcggctcgcggtggccggcccgaagttgatgacgaaatgctgcgagttttcatcgtcgtcgtcgtcgtccatggcggcggcggcggccgtctggcagctgcaggtgtggtcgccgaagtaggtgatgacgtagagggaagggtcttcctccgactgctggacctgcttcgtcgccgtgcagccatggtcgtccttgtagctgcaccggtagtagagcctcgggtgcttgctgttcttgatctccttctgcccgtacttcctccacaggaatccgtcctccgacgtccgcgccttctccaccctcgccggctccgccgccgccgccgctccgccgccgctcgccgtcgctctgcaaaagatctcttgctgagtcgctgctcgatcgcgcgcgccatcgcaagaacgggaggagacatacatatatatataccttctcctccggcgcgtcgacggctgggcggttgccggcttgcgcttcgtgtcggctgacgacgattcggcatcgccgccggcgcgcaacgcggcgagcgcgcggtcgcagcagcgaaggatctcggcggcgagggcgtgggcaccgccgtgcgccggcgggagcgacgcgccatggagcagggcttccaggacggcggcggactcccgcccctgcgccatcagctcggacgccatggaagaagcagccgggctagccaccggcgccgcagtagcagtagcggtagcaccagtggcaatcagcgccatttgcgcaacctcggaaaggtggtggatttttatagcggcgggtctggatcggatatagcttagctgattagctcgagaggaagcagagacgaagttaaaggaaaaaaaagtggattaaaatgattaattcgatcgggaagcgtgtctagttgctcgcgtcagtcactaacttagttactacgcgccatgcatatggatggcaatatggcatcgtgtgttaatgttgttcatgtcatcaggtcacatgtactatgttgttcaaatctaggttaaatttggtgctacttgtacttgtttatgagttgttgaaagcgtgtgggtgcaccgatgggttatactaacaaggactgatacatggcctttgctctaccggtgcaaacctcgtgtaaaaagctaatttactaaaatcctatatgcgataattttgttcttttttgagtgtagagtctaagttgtgtggtagatcctaatgtaaatcccccgttgattcctttgctcggtgtcgaaaatcaaacccctctcctaaatccctatcaaccaatttccttgattgattccagttcaataattcttttaaagatttgagtcggcgctcaaaccatttctgatttctcgttgcgaattcccattatttcaaatcaccaatttgacaagttcaaatctctaatccaacttctcaaaatctccactcgaaaataatctcgaagttcgaacccttctattcagatttctcttctaaaaaccgtaaatgcaattttcgtcaaatcctcgaattcaaactcactccaatgtttcacctctaaacttctcccttggtctcttgaaatcaattatcgattgtttcatctctctgtctgtctctatcccccttcgaatcccttcctaaataatcgatctaactctaagaaacaaatcaaaataccacttttctacctctttaccctctctctttttagagaaaaggcatttcgcccagctttactgaaagcataagagtatcttacaagcgtttcgctagggattgcagcttccaacaaggaccagataaacaaaagcaaagaagggcgcgcacacacacacaggcggaacaaagataaagaggtctagcaagcactaaaagcaagagaatggtagtcccccttgaggggaagccccttaaagacgcttgatgcagcggttggcttccatgtccttgagcgtcttcactgcggcagcatttgcaactatcacattccatggatattggcaagtagtgagtcccctaaagtctccatctctcctatcagcgtcgacggcaccaaacgctttcactgttgcataaaagaaacaactctataaggaagatgaaggatattaatttgttagaagtttgttgttaaacaccccaatcattcctaattagccaaatcgcccaaaaaccttcaacaaaaagataccacataactatatttttggacctctctgcttcccacatcaatatagtcatctcgctgtcgattgagggatcctgttccaattaagaacatctctaaaacaacaccaaagaaatctagccgggcacatttgaacatcaagtgatcagtgtcttccaattctccacaaagtttacagtcaggatcaccttgccatttcatctttttttaattggctggcagcgtgaatcctccctttcattgttaaccaaacaaagatcctaaccttcagcggcacaggtgtcctccaaatctcctgcattcttgagtacttgacctcaccaaacattatcgccctatacaaagatttagtagaatactttcctggcccctctcttttgaatccctctcaaataatcttttgagtccccaaatatacacccatccccaaaatatcaagttctcgagttgatgccctctccttgatcctttgtatttcgctaagttaaaatgtaaatttcgaatcccgatcccaactcaaaccctatttctctctatcgatcccctccccgcaataattcctggaattcaaaatttgaagtttcaaatcccaattcttgcccccttaaattcccctcaatctttctgaaggttcaaaaacaaacttattccgaaaatctcactcatgatcacctaacagttgcaacaataatacctacagaaacacaacctacaatattacacctaccatttatcatgcaatttagtcgctaagcatgctagattttctttctagatccattttaactttttcattatttaattaattcatttgtgtccttaattaattccataatgtcaataataatatatcacaataatctaccatctgaaacaaacagagcctttggttactgtaaccttactttaattaccccttccccttttgataatttaattagcacctttttctaaaacaaaacgcatattaaagactacgaatggtctcgactaaaatatactccctccgtcccataatataagggattttggagggacatgacacatcctagttaggaccatgtccagatacatggtcctaagatgtgtcgcatccctccaaaatccgttatattatgggacggagggagtaattatatcagggtaaaaattatagctaagcatagaagaaacgaatgggaattggagagaacttgcagtacagtatagaattacaagcagaccgtaattcgaattcatcttaactagtttcccttttgcggctgacacaatctaacaatatgttattgttcgagatggtaccatgaaaaatagagttggattatccaagtactattatccatgatagatctgaactgtcacatggtaatgttgttctccaagatgacaaatatatatttgtacacacatgaccctggggaaagctgtccaatctcattatctgtgtagaaaaacgtgttttacgtacatgaatagctgaaaattagttctctaagctgtactcctgaatattgaatctcttgatctagaagcttccagctgctgtgaactctcctggcgtagctagctcgctgcacatgatcatgttggtgagattccaaaagagaataaaaacattgaacagtgtgctcatagtaaaattaattttcttacaaaactctttgcagacaatttttttagccatttgatttaatgaattaggagttacagagaatcaagattattcaatgacaatgttccatattagagtttgtaaatgttttggcaaaaaaaattcgtacacatgcatagcttcctaaaaacattcagtattggacttaaagttcaacgaaatttactggggttgtgcatgagattggtgtggagattagtgggaattcattctcttcaacggccgtggttacgctaaattagaaaacaaggtgggcctggaagggaaacataagaggtaagaagatagttccatcgggctaaatggatggctggggcaataatggtgatgtgccgtctcagccctaagagatatatatatggtggtctggtggatgatagaggagcatggaaatgatgagggttgagtatttttaggcatttaggaatgcaaagttatagggacaccatggtggaggatagatagaggggatatattaagtgggcttaagaactatattaacccacatgtatagggctgtttgaatgacacccctcccatactttgtcataaaagttctgcaaactgtggcaagccacatattgtatggccaacattttgttggtctcatttgtggcgagaaaacgagactatgataagtgaggtttgattttttaaaaaggtgtggcatactatagttgtggatgccataaatttcacagtgtgtggcttgccacaaatgtcacagtgtgtggctctcaaccaaatagcgccatgcttctctatctcaagatataactgcttcttcaccaatctcgtttccgtctcaaccaataacaaccacattttatttaattctacctctccttaatatatgtgaaaaacttgagagtggagaagtgcttctattttaatttgggatggagaaaactctctggtgccctcgcgccgccctcacgcggcggctcaggggcgaaaccctagccgtcgccgcccctctcccctcctccctgcttcgccgccggcaattccgggcgacgcgctgggatggcggcggcggggccatctctcttggctccatctcgccccggcgtaggcatggcgacaatggcggctgggcggcgaggtcgcggcggcgggatggtgaggtcgcgttgacggcgtggtggtggggctctctgcggcgtcggcagcgctgcggaagggctccgcgcggctccggcgatggcgtcgccagctccgatcgccccgccagatctggccggggtgacgacggcggcgcggcggtggggctctgtgcggccggcgacaggctcggtcgatgccggcgccttcgggcgttggcaggtggcctgcagctcccgcgcggtttcgtcggcgatgacggcatcgggtcggcggcggctcgtccggttggccggcggagcgcgccccggcgccgactgccgcgtggtcctggccgggggcagcaggcctgctgcggcttttgccggctgcggggacggcgcatccatcctcttgttcctctagatccggttctccccttcttcagtggttgttcttccggtgctctctagcggtgtggcacccgctccattcttctcaggtgctcctcccttcttaggctaggctgcttccagtcgatgccggggagcttcttggtaggggtggcgtgcggattttcggcgtcctgttcgctggtcatcggccgcgctgttagtttgctccagctgggttcctgggtgtgaggtggtctctggtcgagctgcaggtgattggttgttgaggcggagttggagctgcttgtcttgcaagcttggcaacgatgaccctcagtgaacgtcccggcaatgcggcgagggtttggaagtggagccttttgagagagcctcgggtgaaaaccttgcctagtgctatcctaggttgatgatatcgacgcttgcgggcgccgttttctccttggaggtattgtcatgctggctctctcttccttcaggtgaaaaccgggttcctttcggaacgggcgttgacagcatccttgatgttgctcccttgttgaaggcttcgctcagaaggtttatgctccactagaggatgtttggtggttctggagacctcgtttgcattatgttgttcaagctgcttgccttttggtaagcttggtaacgacgacttttgtgaggtctctttagttgtttcttttccttttttgtataggtttttgtcggttgtccgtttaattaaccgtgcttgtttggttttcgggcccggtttcccttattaactgggccaattctcttcttctataaattccggcaggagaaactcctgtcgtcggttcctctaaaaaaaattgggatggagggaatagcaaacttagatactagctagctggtttgcacaaagtgaaacatgaggagccacggtgaatcagggatgaaactcgagagaaaaaaaattggctgtgtattctcccttgaatgtaaattgtataggtaagataaagtgataaaccatagaacacatttaggtgccatgccgggagcttatatatagtaatcacttgcaaattaaaatccaagtttttgggtacaatacaacaagagctagctaataattcactaatactacgcgacaactttaaaaagatgattattgtgatttggcaattgcaagggaagctgcttgcatgtgtaccaaactaggtagatctagatcaccatgagttcatcactggcaaattacgttcgtacgtactacctgaagagcagtggggaaaaactgatcagttgatctctatcacttccagccggcaccattccatggctgcggagacgactcatcatagtcgccataggatccatagttacgcataattgtggacatgattcttgtgctctcatcaatggagggaacttcttcttcttcctcttccttcaagatcggcgcgccgacatgagaatccattaatgatgaggaaatggatgcttttgtgaagtcgagcacttgggaattagtactgcttgaactgggctgatcttggaacactgtattgcatgtatgctcgttggtgagggtgaccctgaactctgggggatgtttgttgttttcttgctgcacatatttctttgcttgacactttcgctcatcactgtaaccacatctgtagtataacctgcaaattgtgtagtgcatgaattgatataaacatataattatgcatgtcagactatatcatcagttttatatatagttgatacacatttatttccaagaaagcacaaacggaatgaatgcccattcaataagtaaaaaccaattaattgtgagacttcatgtacatgtgcacgaaaaatgcagtgaacgaattgaactagcacaccattctttcggcacattctcgtcgtagtctaaactctgaacatttacagttgtgagaactagttgattgatttttgtgtgactaattggacttcagccaaactttcatacgtctatgcatgcaccgcacttaacggtacatgtctccatgcatgtgatttttcagtataatccttttatttaaatgaaataccttcaaaacatactaatgaacaatattaattttagttaaaaaaagatgtctacaatctttgctcactaaaatttccttgtcctattcagttactaagaactgcacttattttccctaaaaaaaaagaactgcactttttttaagataataaaagttcttaatgaacttagtcaattacaactgcacacaaatcatatgatcatagcactacaggaatttaaggaaagagttggtatctcactctacttttcataattatcactctacttcaaataatataattgttctataagtgtatttgcaaaggtcacttacccagattttctatatttttggcccatttacacctcgaaaaacaagtagaaccatttcccaataattagaagcatatataccattattccgacaaaagtattaatgtaataaaaacatgagtatcatactacatatattttgctatttgcaattatatataaaccgaccatttcaaaggaaaggtaggttcatttctgctcacccaatatgagatatatgcacacaatccttaaattagagctagctatgacacacgcacacacatctaaaatacatcctgatatttctccgaggacacaccttagtgttcttgttgtgacacgtctgctggcactctatatgtatgctactaattacctaggtaatactcctttattataaggtgctacagagagctagctagaattaattcctgcagtattaattcttttttttgaataaaagggaattatcaacccatgtttgaattttgattaaggtaatgctaaatcttcagaaattgaatcaaagaaaagtccatcagaacttcatgaattgatggttactttcgaaattcactgttgaggatattcttctcgccatatttcctccagtgaaacccatcattttctggtgtcgtagtaatgaataccgtctcgctgaaacaaaaaaggaagacaaaataaatcatgcacttaacttgttaacaagtttcctaaccatgaaatatagatccagccagtgctactcgagaaaagcaagcatacgaggctcccaaataatccgaatggggcagaacaatatccagcttgctaaaaaccttttagtgtcctctaagtataatagatctaggcttctttcggcatagactattaacagctccatttcttttccccctcaaagcaagctaataattagagacaacaaggaaattaagctgattaatcagtcactcaagctcaaatggaacacacacacacacacagatctgccggccggttgccggttgatggggttcttaaatcttaattatctagtccattaattagtcccatatatatgtattgccagtggtagcatgcagaagagaagaaatcgaacacacataagtagttttcggcactcacatgagctcctcgccatgcttgcctcgccggcgcttcgtctttctttcgccgccggcgccggagacggaggtgacagcagctggcccagcgccgccggatgaggaggaggagccgcagtagtagtgctccctcctctcggaccggagggcgtagagcgaggagctgagggacatggagaggctcctcacgttggccagcgcgtcgtcgcggcggccgtcgagctcccgctccgggatgagctccagctgcgccatgagctgcgtcgccagctcgctgcccttgctgagctcctggatggcagcgtccctttggtcgccgggcggcggcggcggcggcgacggcgacctctcggactttggcaggcgcctcgccattggggatcgatagattgggcagcgcagctagctggctgaggtgtaccccttcagtaggtggagacgatgtgaactttggtttggactaggggtgtccttttctggatacttgtgtactggcttagtagaagcagctatctatagaggctctgatcttgggttcaattcaagttgttcaaccattgaccaggtaaatattcgatgagatgtgtgtaaggagtttaacctttttaagctaatactccctccgttccacaatataagggattttgagttttttcttgcaacgtttgaccactcgtcttattcaattttttttgcaaatataaaaaacgaaaagttgtgcttaaagtactatagataataaagtaagtcacaa

SEQ ID NO: 67070 - DNA, 3550 bp, Oryza sativa
ctcggggagccaccggtcgtcctcggcgtcggcgagcacgaagccggcccgcccgcctgcgccgtcctcgagctcgcgcacgagcccctgcagcgacgagcacaggcggcaccggggcgagtagaactccagcacggtcgcgtccctcccgctcgccagcgctgccgcgagcgcccgctgctccgcctccccgcggtccgcctccgccgccagcccagggcccagccgcctcctcctcctccacctcgtcctcgccccaccgccgcctcctcccccgtccgacgagggggaggggaggtcgccggcgatgaggaggccctgcgccacggtgcggatggacttgagcagccagggcatctcgaggtcgccgcaggggctcgggctagggctagggctcgttgccttggggtcggggccccatggccacttgaagcagacgaagggtgggggcttcgcggcggcgcccatcctctccggcgagggaagcgccggcgaggcggcggcggctgcggattgggcgatgacgtgggttgatgaatggaccgcgcatcacatatcgattcaacggctgagatctaccccactggagtgtactggacgcggcctctacttctgcaaattggaccctcgtttggttgctacagacctacagttagcgagtaaactatactactccctccttccctagatgttgacgccgttgcctcttttaaatatgtttgaccgttcgtcttatttaaaaacttttgtgaatgtgtaaaactatatgtatacataaaagtatatttaacaataaatcaaatgataggaaaaaaattaataattacttaaattttttgaataagaagaacggtcaaatattttttaaaaagtcaacggcgtcaaacattttgggatggagggagtatattcctttccgggcgaccattctacccctgtcatttcttcactctcattgcaccatttcgtccatcttaagatattaataatactccctccgtttcaaaatgtttgacgccgttgactttttaaaacatatttgaccgttcttctttttcaaaaagtttaagtaataattaattcttttcatatcatttgattcattgttaaatatacttccatgtacacatatagttttacatatttcacaaattttttgaataagacgaacggtcaaacatgtactaaaaagtcaagggtgtcaaacattttgaaacggagggagtagtaaccaacgcacatcatatctttttagacggcgtcatacacggtgatcaatcatgccgtggaaaggacaatgttaaattggataatgcttcccctagattgctaaatgggccgcttggcccggcaatgaccgagcctatgtcgagatcagtcgggccggcacgccccgaccaacatgccaggccagggcaggcccgcccacttgctgcaccttcggcctaggcgctcaataaaactcaggccaacccaaaagcacgtaagtctattgtgctcctccttgaaaaagtctattttcctccctaatctctttaggctggctcttatatagctgcattgcatcctcattctttggccgtaccttatatggctagaataagtctacgttggctccctcatcttatcgtgccgacgaagaggcccattcacagctcaaagatcgggctatgctgtgcttggaccgggccaaaactctgtgccatgggccgggccatcgggccttgagccttttggccaactaaaccctataaagtggccgacgcactgcacacgatcgcactctcgcaaagtcgcaacgtcattactcatcatccgttaatctccttccggacgattaggccaatcctaactataaaacccaatggctgacataggagaggacggaaaacgcagccttgtgtctatccacatttcagacaaatttgctccaatcatatgcctttttttcacactttattagcagtcacttttattgctcaaacaaatagtaacaattacaaacaacatcaacatgatcataattacaagtttaattaaacccaatctttccttaatgaatcaacagcaatcattaatcaatcatcttctggagtaatgaaaagtatgaaacaaacacttacaaagttgcatttgcaattcatggatgctctcgatcctacgacgcattgaagcatgggaagcaaccgcacagcttggacagagccgacggcgtcgccggtgccggcgccgtggccggcgggtcagccgccggagcggaagacgaagcagaagccgaagccggctgcagcatcgggacgtgggacccgtccatgccgccgtcgcggcaccggtggcactcctcccggaaccggtcgaacgcgtcgcggcagtactgggcggcgccggcgacggtcatcccgcggacgaacacctcggggtcgtacccttccccgtcgtggtcgccgttcagcgcggcgccgagctgcaccagctcggcctggaactccgacacctcccggtgctcctccgcctccgccgcccgcagccgcggcggctccggcagcgtggcggggcagtcctccctcggcgccgcccgcgtcagcaccgtgtcgaacgtgcccgcccacgcgtcgcgcctcgtcaggaactccttcaacccaaatatcctcttcaccgtcgccgggatcgacgagtgctcgaactgcgacgtcggctccggcgcgccgccgcacgacgccgggtcgtgcaccacggtgcccggctcgatccacggcgagacgagcagcgtcgggacgcggacgccgaggcggtcgaaggcgaacgacacgggggcggcgctgacgatgccgtcgggggaagggacgccggcgaccggggtggggacgtggtcgaagaagccgccgtgctcgtcgtaggtgatgacgaagaggatctcgtgccactgggggctcgagcggagcgcctcgtagacgtccttgacgaggcgctggccatgggcgacgtcgtgggaagggtggtcgtcgttgcccgggaggagcttgaggtcgaagtagcgctgctcgatgacgacgtagtttgggagcttgccggccttgcagtcgcgcttgaaggcggtgtcgtaggggtggaagttgcccacgtacttgagttgcctcatgttcctacatgcatgccaatatatccggtattaattcatacttcctccgtactcgtaaaggaagtcgttttggacagcgacacggtcttcaaaacacaactttaacttcttgtttctataaaaatatttattaaaaagtgatatatgtatacttttatgaaagtattttttcaaggcaaatctatttgtatatattttacattttcaaactcaacaacttgagagttattcatgatttatattcttaaggtttgacttaagcattatcctaaactacttcttttatgagtacggaggctgtagctgattaaccaagtactcccaccatgtaagtcattctagcatttcccatattcatattgatgttgatgaatctagatatatatctatctagattcaatctagatttat

SEQ ID NO: 67071 - DNA, 1317 bp, Oryza sativa
  unsure (1)..(1317): unsure at all n locations
ggccccattgattgcttgacgatcgatcgnnaagggcgaanncgagctcggtacccaatgtgtttggtatcaccttaaatttgttggtgtgatgctttttgtaatgttctatttttttaactagggcctgaattaattgtgggttagtcatggacttatggttcttatatgctctatagataatactggaccagccttgtcacgcacatgcgtatgctcatttctcatgggaatctcagtttgaatattttgttgctcataatgatgtgctggaagtctgcaaactcctggacagtattcctgacagtgtacttctagaagggattcttagagtgaatgtggacaattcacaagctacttacaacactctgtctgacgtagcaacccacggttataaaatgtacttatttgactcagaagagatagaacctgtttgtatggaaataccacatgtcaaagtgttcagatctttgtgtaatcatgaatcaacttcttggatgagaatgatcatgctacaggaattggcaaagaagcatatctttatgaaagagtactggcaaagcactactgaaattatacctatacttgcccgcgcgggcatgcttgttaatacttcagagctttgttcagatgttctacatggtgcataccaccaggattgtgacggagcattacacaaattagtcctacgcttctgtgtgcagtataacacaccaaacctactggacctctatctggactactgtaacttggctcttgaaaaggattctattcctttgctcaaggaagctactgtaagtttttgttcaattttagtttatgatactatttgatgttcaatagtattctctggaacctttgataatcacctacctaatttctcaattatatgaccaatacaattgtagactttatgaccagatgatatttgtcaataaactagattatttagtttaggatatatacttggtgacttagcctttacatgttttttttttttttaaattctgggcttacaatattctttagaaaaataccaaaaaggtcaaacttgccaaatctttcagttttactgtgagatttggcctaccctcctaagcatactccgtacaaagtgactttagttctcacttactttgcaagctcattctcttgaatagtaaaccaattattatcagaaactgctagcaccgttcgaatgagaacattgttgcattcacgaagcctgccttaatataatgcccaggattttattagcctgcagctacagcggattattccatctatctgactaaagatttgccttacttgccgata

SEQ ID NO: 67072 - DNA, 571 bp, Oryza sativa
  unsure (1)..(571): unsure at all n locations
tttgatgacgaactcgatgacccnagcgcgaattcgagctcggtacccttgaggcacgaggagtaagatggtggtgcagaataatcagcggaagccaggatagttttgtgaatgcttggttcagttcagaacaggttgttcttggtgattcatctggcagcttaattaacagggataattttggctaatttggtgaattggttgtgtgtttttgtaggcttcttggcccaaggttgtgctgaagaaatggctcaacctcaagagcaaggattcggagttcaacgccgacgaggaagacgacgacgacgggagcgacgttgatgagcaaggtacatactgtttctgaaaaacaaaaaacctcttctcagatcaaattatccatctgaatttaagtgttcttgaggagaatttagttaccagtcaggagtcacattttttcctccttctgattggttcggtttcaagcagagaactgcggctgcgacgacggcgaggagcggcggcgggccgacggcgatctcgccggtgagtcttatgtctatgtgacggtttgatgacattcccatgtttg

SEQ ID NO: 67073 - DNA, 5433 bp, Oryza sativa
tatacgtgtggctggtagctgggcacatcggggctgttaacagcggccgggtcaacaacgacggggcggggcgggggcggccgccggggaggacgaggcgcttggacagcttgaggtcgtcctccaccgcccttgcgaagtcctcatccatcgccgccgccatccttcgtctggctggaggaggagaggagttggaggaggggaggacgaggtgtctccgtcaagcctcctcctcctcaagacccgcgccatcgacgcccgccgacctcgcgccggccgctggccctacgcccgttggcttcgcggccgccggttcacctcgtcgaaggctagagagggagaagaagaaaaggggagggctaacgggtggggtccacgttgctttccacgcggacatgccacgatggcaagccacgtgaacaaaagtggcaaatagtcaagaaatcacctctctgcagtggtaaaatattaagcgtgaatctaaaagaggcatttggataattaccaaacttaaaattggcaaataccgggaaaaagtggttgggggcaatacgaggagaaacttgaatgtgagttagattaggtagctaatactttagattacctacactgcgaaaataaattaaaatggttgcgtcccttatataatatggggacgaggtagtaaatccgtaatatatgagcttggctactactttcaacggcaagtaaccatagcggcacaccatcaatagcatattaggtaagatgataaccaaccaacaaccatatgttacgatttaatccctccatccataaaagttttgtcaccaaaactaaagaaaaattaaatcattttggatattataaaatcaaaagtgaatttaaatatgcagccaataagtatttagattactccttgagttctaattaaatatttaatttatctaattaaaatcaaaaagtgaatgcaaatatgcaattaataagtatttagatgactcctctcattggagctcattgtgactccctttgttttatattataaaattattttaacatttttttaatcgaactttttaaagtttgatcatgtacgtagaacaacatttccaagacagaatacatatattatcaaaatatatttaatattatatttaattaaactaatagtattttgttgctgatgttgctaattatttttatagatttagtttatctaggaaaaaaatgatcaaaacgactagtttaaaaagagcaatatctattccacattccaaaatatatttaatattatatttaattaaactaatagtattttgttgctgatgttgctgattatttttatagatttagtttatctaggaaaaaaataatcaaaacgactagtttaaaaagagcaatatctattccacattccaatggccccaaactcttaaaatatcggccatcctctttattaaaagagactactcgattgttggaattgaataagcctcccattcccatcgtatgggatggacgaaaattgaactgataaataaatctttcaataccgacaaataacaaagttgtcacgagcccgatccatttcataactgtcaaccgcaaaatgctgggaatactgcattccacctttctacagcctggacagagaattccgaatgttgatagcaagccccactttgaatgatcactgatcagggatgacatgctgatcaaggaaggtataccacgtcaagtgtgatcgaaagcaagcaggcaaagaatgcaaagaaggggcatttggaattgcagcaatttgcaatctgggaattgagatgccaccacatcatcagctactccagctagctaacctcgtcaacacattgttggctacgcactcgacattgattcctgtaccacgcaacaattactaccaagtaatctaggggaaaaaaccaaagatgaatccgatcgatcacttggcggcgtaattgggtatctcgtagatttggtggatcctccaaatgtcgtcgtcgaaggccatctcggcgtcgccgcgggcgccgaggcagcggaagtcctcctccacgaaggggaaccaccccagcagcttctcctcctccaccccgaacgtccaccacgacaacccgttgctgagcccgccgtcgaggtcccactcgacggtggtcgccgccccggcctcgtatcccgcgccgccgccgccgccgccacacacgtcgggcacggtgggcgccatgtccgctccggaggagcaggaggaggacgccgcggatgtcactgccgcccccgcccccacagacgacgacgacgactcgcgcgccgccgccgccgccgccgccttcttggctgccgccgacgccgccttgggctgcctcggctgcttcgccctccgctgcggcttcgggttggcgttcccggccgcgccgccgccgtcctgcccctcctggagcttcggctgctgcgctctcgtccgcttcatgcctcctcttcagcgcgcggcgcggcgcggcgaggcgaggtgaggagaagaggggagtgacggggtgtgagcagtgagagtgggagtgttttggcagcgaggcggccgcctcttcgcgcttttgtagtgtactccagcatcgagtggctcggctggtttggcgcgccgccgtcgccgcgcgcgcgcgcagccggtatgtgcggaccaggtcgcgtcgcctcctctgtcctggcgtgcggtgtatcgggccaggtccgagtcgtgacgggagcccgtgcggcgaggcaacttgcaaccggtaaacgcaccaatcacacaacgttgtaggtaaccgctttttttttcccttcagatagtgaaaattaacgagttaattaattgatgaagcgcacgaggttgtactgtagacagggaaacgagcagcagtagtaatcctcctgatattttgttgggtgcagtcgtgctgtgcagcgtaccgggccagggtgtgtggctttggcagttttttttttccacgatatgtgcgcgtagcaacggccagtgatggagggacggctcacgtggaaacccccggaaacttggggaggttgggcgtcgacgagggcgtgcgcctgtctgtctgcgtacgcaaaatcgcatgccgacatcgtgaaccactcctttgtacaactattagcttccaaagctctccaatctctacttttcatggtattactagtgttttttagtctcgtgtttttttactactactacagacggagtatgcgtatacttgacgtgcatcgatcgtgtggttgacagatattttacgtgtatactagtggtgatagcggcattgtatatttgtatcgtggcacaagggacgggaggagaaagtgtgtgttagccgtatctcagtcgagaaagcgatggattaagggtcatttaagggccgacaggggcgtggccatatgtcggcaaagaggcgtgagtaatggctcgcagatccacgggacccaacaccttgccaacttgacgccgctcgagtcgtaataatacgagtatttttatgcaggaacatgcataatactcctacaatgcgttgcacggacgggacggcacgccactctgccagaacaaccagatttgacgagaggaggctcgtgccttgcctcgtggtcggccgggtcctgcgccgagaggaggaggcgctgcacgtctgcacctgcccgtgttcgctcgtctcaccgcccacgtttggccgtctgacgtgacgggatatactcctacagtcctactccacaacgtgatggaacaagatactagtactcgggctaatactggagtactagtagtgtatagtacagtactatttgatactgtacgtacgtacgagtatctcaaagtaccctcacaagtctcaaatctcacttatggagccacctaggagtagttagcagcctggcaggcaatactagtatctgactgggccgtgtctggtttgggacgagacgaccacgcagatgctgatctgcagcaattttgacaaacgggccggatttatatggccggcacataggccttaatctgaatgggccggcccaccattactcattgggttttgtttgaccttaccgggctgtgccctcaactgcaattctgcaaagaagacgacaatccaaagacgcatgaaggcggcatcagaacgccgatacaggtggcttccaaaaaaaaaaaagaaaaaaaaaagaacgccgatacaagtgacgcatgtctatggtcagctcgtgcagtaagacgttaagtctcacagcgagtgtaaccttcgtggtactggttgctataagtttagaatcataaacatgcaaattgctgaacaacgagatctcaaaatcttggatagatttgagttggtggccgaagagtttaggtttggacagtctcggctataactttcttattagtctagcggcaaccggtcacgctcagtagagatcgattcggtgttaatcttctccttgattatacgtaggcgttatcggtgcatagtgttaatcttcttttctagctattgtcttacatgacaatagttttataattttttctactctatttaatgaatcatcgctatgtttgattatgaccgttaaaaaaggagatgccaatgacactactgtgacagcatcccagctacagcactccggtggatcttaagatatactccctccttccaaaaacctaagaactatttcattctttggtttctccaaaaatctaagtcctatttatagtcactatgtgctaaattaaatgttgatcgaaaaccaagaagccactctagtgcttattggttgtatgttcattggttttgccacatggtgagtgagttaattacttcttggtattgatgcagaaagaaataggtcttggatttttggaaggtgggagtagtagtatactccctccgtacctataaaggaagtcgttttggacagcgacacggtctccaaaacacaactttgacttcttgtttttataaaaatatttattgaaaagtgatgtatgtatacttttatgaaaatattttttaagacaaatctattcatataatttttacattttcaaacttaacaacttgagagttattcatgatttatattccccatgtttgacttaagcattgtcctaaatgatttcctttacgagtatatagggagtatatgttagtggtcacgcttagcttttcttcctgtcgccaaaagctaacacggtcaaatcgattcacacactgtagcagatagtatagtaaaaatgcatgctacatgattcatgtaaaacacacagaaacgcaaaagggaaaaaaggaagttcggatcagcactgctactgcatgctgggggatggccaccacgggctgcacgtttcgaccggccggcgtcttgcgtccctttcgcttcatgtgatttggtgcccgaaaacattcgacttgt

SEQ ID NO: 67074 - DNA, 13918 bp, Oryza sativa
ataaggcatgcgttcatatgcaattgactatgattttttctgcattcatgtagtatgcaattgactagaacttcatctccattaaattattattttttaaaatcttctactcttaaaatatatttattggtgatccaaattaggatatgttaataattatttcttggtttttgattaagggtggttatatgttaaattttggaatgcagagagcggttctctaaacgttactacctagcaattctccaagcgtcgttccgcatgcatgcaaatagccgagggacagacaacatcaacaaaatttcacatcctcagccctctaattagggggtgtttagttctatgggtataaagttttagcgtgtcattgggtattatatatgatgtcgcatagggtgttcaggcactaataaaaaaactaattacagaatcagtcagtaaaccgcgagacgaatttattaagcctaattaatccgtcattatcaaatactctctctatctacttttgatagtcatatttcatcttggcacatagaccaaggataagtaattctacttatcatctatttaaacatgctactagtcattcatcgcaaacaagtgattcattaatatttatatttctcgatgtccatatagccaatcttgtgtggaagaatggagagtcacgcattaaatctgagaaagtcattaagatgataggttgttcgattaaaatatgcctatcaaaaataattttttcagatttgaaaatataactatcaaaagtagataaagagagtatttattgtagcaacatgttgtcaaatcatggaacaattaggtttaaatgatttctctcgtaaattaattgcaatctgtgcaattagttatttttagtctatatttaatacttcatgcagatgttaaatcttcgatgtgatagggtgtaaagttttaggatgaaatctaaacagggccttagggaaggaaggagtactacactagcttcaccattaaaatacttcctccgtcttaaattttgtctcgttctagtttgatcatcaattccctaaaatagatagttttatcatcagtcaaacattgatatattttgattactaaattttaaaaattcatatagcttaacatcatcttaaaaatattttcatgatatatataaactcccttcatttctttttataaaacatgctactatataaagtaaaagagtcaaagttagtgaattttcaccaatgattactccaggatttgcacatttagtattaaaaacgatatcaatagaattatactcttacgttacgtagtttcgtgaaagattacttttgtatgcgtattaacaataccatttatgaggaatcaatggctaaagttcgctggctttgacattttcattgtatagtggcatgcctgcatgcctcgtaaacagaaacagaggtagggtttacgtgcgtacgtttataagagtgagtgcatgtacgttgtgagtgtctgtgttgtactgtgtaattaaaaaaaaagaaacagagagttattcacacgttgttaaactatgattttttttaaaaaaatattaataaaatatataaatacttgacttagaaaaaatctataaaaaaataaaaaaattggaaagggggagtagaagtaatgaacgaaaagatccaacaaagatagtgctataaaaagagactcaaaaggaaataacactgtaaaatgacacgataccatgcacttcttccggtccttctcgtcacagctcacagaagtgtgctggaactgacatttgacgaggcaggaggacgtcgaaaaggtaaagatcgtgtcatagttcttctacagaatcctactacaacctgatattttctaacatcacaaggattgtcatttgtcatagcctcataggtactcctacaatccaacatcacaaggactgtcggatgagcaatctgagattttctacagttctgaagaacgtactatgaatttctacagaacgatctgagattaacatcagcagggtatgcaaaaaatggtatgtactcatattaaccagtttgaacaagtccgctgtaacacatgttaagcgtcaatattgttcctccaatgcaaggtaatcaatttagcacgtagagataaattacacagccgtacgagagcaaacagcttcgtttgggtggaaactagaacgcctaaaaaggtagaaaccagaaaggcatcccaagttcccaacaacttatacagtaaagttggggctaaaagatcaaatcagttcttgattaaattaaatgtgattttacataagacatactgaacaagtcattgtcactactgctttaaagtccacgcctattcagaagggataatcctgataacatagtaaagacgatcaatgagtagaaagcttgtagagtcgacttactagtcatttctgactagttaggagttggtcatttagtctatttcatatataaaaagagcatatacggtcgcatctaaaagccaaaccaaataacttaagcttaaaaaaataaatcattagagtactaacagccgcgctgccttaatgtctccataattatcaataggcaaaccttttgctgtgaatctatctaggtgcttgctaattactactccctccatctacttttgataggcatatttccaaatatgaaaaatttatttttgataggcatatttcaatccaacaacctattctcttaatgactttctcggatttaatgcgtaactctctattcttccacacaagattggctatatgtgcatcgagaaatgtaaatattaatgaatcgcatatttacgaggaataactagtatactctccattacaaattgatctacatatttcataagtataccaagacaaaaaaaaataataactctctcatactatatttactctagcaacaaactcaatgcatgcatcatccccactatttcctagccaatagcaaatcaagatattgcatgtgggttataaatgcttgtgtgcatggatgcatgcatcaatgtccatttactccaacgcacaaataacgaatagacctaatgaatgaacataaatatgtagatcatttagaaataacctcaaaaaaactatatgtagatcaatttggaatggagggagtagcatgtttaaagataaatagaattacttatccttggtctgtgtgccaagatgaaatatgactatcaaaagtagatggagggagtagtatataagcatagcatgtagaatggccaaaagacgttgcttagagcacccgcaatggtaaagtaatgtgctttctataaaacatgtacatttcagcaatagactagattaatagtaaaccacctcaatagtatgtctacataggtatctatagctctctcatgccttgcctcgtttttctctatagactatctctaagttagtagatagctttgctctctctcttcatttaatatcttccaagtagaaaaatatgctgacatggatctcttgtagagagcctatagataaccattgtgggtgcccttaaattcaacaaatttaactggctatcttttatggaggcagcaaaacaatctatgggatacccaccaacttgtccatcttgcaagaattccaaattagacccaactaaacgttatgctttgcatatcaattgatgtacaatttttcatcagcaaaggtctttgactgaaaattgcaattaaccatgaattgacaccaaatcttagtattgtaagcaactatgcacctccagcaattacaaggaaatatctttcactcagagaaaggtagaatttacctcattcatccggtggtgtccgcacaacagatgagtagtaatgtgcctccaactcctttaggcttcctgctgcctcctgcccaatcctctccagcattctctctgttccttcagcttgttgactaaggatctcaatccgcctatccacattttcagttaacgaagcaagcccagaaaagatagctgttctcttaagctctgacactagtttcaacagagaatcagctgaatgtatctgaaaagcatgatagcatatcgcagctgaaattacacattcaacgggtttgccaaatgatactgattactagaactagcttccaattatattacaaaagcatactttgtagaatggatggttgcaatatgttaacataaaggtagatcagaaaatacataggcaacaaaatgtgattcaaactcattattcattaccattaccatactgtctatgataagtaaggccattgcgtgtctgaggtaggttcttctcaatccacagatatacacaaactatgatatcatgttctgaatcttactctgcgtgactagagtcagtttcttgcttgaattttaactaaccaatccctgattccctgtttcatatgcactgcattttcaccctacccagataacatccctaccgttattcaaatatcaaattccatctctatagcgatgtccttgtttgcactagatatctcctttccagatagtgtttttgggtgtcggattaaacacggtgatatctcctctgcgttggatagcttcgtctatttgaactttgactcagtagaggcgcgtttggaatcctcactaagtttacttagccaggataagataggataggccgtctgatcgctagctcatagaagttagtatgcttgtttggttcaagcgagttgcttgtctgtacgtccctccaagtggttccagcatgtctttgactgcttgcatccatgacattgggcttcattgcttgccgtccagggagagccaaattggctctccatggtgggcaaggatttgttgacggttattgcctactttgcttagcaaagcaagattaatttgcctctaccaaacagctgaggtttccaagcaaagctagtttcactcttgcctaggattgccttctagttataagttccaactagatcagggtgcacctgaaatcaagaaatcaatactataactcctaaatcctaacaaacagctatcaaggatatggcaccaaggattcactgccatggcttaatttgacccctaatacaatggtaataccaaattgagcaagtaattcctcggtatttcttcttacacaccaattgtctccactactgaggtaggaggaacatctccagttctccatccagccggcacatcaaatgtgatattaaagcttaaaattaggggcatcgtagctctaaatttgctcatttagacaaatactatagggcatgatttaaacaccgccgcgaagaaacaagtcatggagcaagtgtgtaccaagcgggagccgcgcatgtccatctggaaggcctcctgcgtgttgcgcacgggcgggtcgttgacctgagacgagcggagcggaagtaggagttagggtttggtacgacaccaaggaagaggaggagggagaagtggggagggggggacgtacgcgcgcgatgttgatgaaggcggcgaagttgtcgacgaggctggagacgtcggcgtcggccttctggaggagcgtcttctgcttctgcaccgcggctgccgcggccgccgccgtcggccccgccgccgcgccggcgctcttgctcatcgttgctgctgctgctgcgatggcggcggcgcaggtgggtgcctctcgtctctgggcttcgtcgggagaggaagcaatgcgaggcccacttcatagcaccacgtcgtgggctatccgaaggcccatgacgagacttgacttgcgggtgtttcttgggccacggaatgcgcaaattctgagttatttggatgaggaataagttcacttaggtccctcagcttgttgccaagtctggaattcgtccctgaaccgcagtaatatgacgtgttcctcaattttcaaaaccagtgcaaataaggttgcaagacggttttggatggtggttttggttgacatggagcctatgtgacattgacgtggtacttaaagtcttttcaaaaccataggacccacccgtcagtgagtgtccaattaaaataaaataattacagtggatctcaccttttttttctctcttttctccgctctctccatcttttctctccctctcattcgtggtgaccgactagggcgggccaatcttcttccagaacaggttgagcaacatcaagaatgtagaagaggacggcaacctgtggccgaccgccaggtaccgggaatgagaagaagcaagaaaggagaaaagtgagagagaaaaaaagaaggaacgaaaaataagggggaccactgtaattttttattttaattggaactcactaacaggtgggtcccatagttttaaaaatactttaagtgccacgtaggcgtcacgtcagccaaaaccaccatctaaaccgtccagagaccttatttgaattggttttgaaggttgaggggcatgttatatcttgttactttagttcagggatgaattcagactcgtcgacaaattgagggacctaaagtaaactttccctttggatgaataagtcttgagggaggcgattctacatagagcaagacaggaaggagaaaaatatacatattccttatttagaccagtgattgtgtgattgggcctcccaaggcccaacagatcgaagttttgtctgaaatctgaagcagagtaataacccttcagttcctgaatctgaccaaattcgacgaacagaattatgcaaaaacagcagattcgttcacccaagacatgggcctacactggttgatctgatatgtcaagcaaagaagagtatacacgagaataatgtttttttgggaagaaagagaaaaaaaggatcgggaacaggagttgacaccagctttgcccgattcctttctcagtctcccttttctcaccacctttcgatccatcgatctcgcttccttttgctttcttgttcctttccctttccccatctctctctgtcgtctgatgaactccgaatttgctgtttgctgctgctgtagctaagctaatctgctgttccgtgttgggtgctgcatcatgtccctgatcaacgtcaggtttaccatcacacgtcactgttgttaatctgccttgcaagtaactcaagttgtttttttaaaaggaaaaatttgatgatggtggctacctagctagctccgaccgacaatcaccattaattagatgcctgcctacaactgatgactaacaaacctacctaattaagtacctatgcaacaagtggtaatcaagcatacaccacactatagctaatctagcacagttactgactccatcagtagctgagcattagctctgagtacattagaaagcagctcaataatgagatacctttgttgcttaatgatccaagctatagtgtttggacccatctacttaaacgtggaacctacagcacttagcatgcatgtgctacacttaaacatttcagctctagcaatgtgcatggtttttataactaactcagtgcctagctaatctagagttaattataatggcatcagcaactagctagggtctttggatcagattgcattgcagaattaatccagagttaatttaatttgccagggtggagggcactgtcaaagtgcttggccaactgaaagctactaagtaggccaaaattcacacttgcagacacacatcatgcataaacattatcttaattactaggagtgaaacctgaaatgcatatgctggagctgaacaaaaaggtagtgtttttatctgaagacttatcaagtactctcccagccaatcaaaactcaccagttgagcacaaagcctttgtggaaaagatgagcaagcatagattagcttagctataccagaaaaaacaggctaagtctcaagtgaaaggcaaagtacagataccaataaagtgggcaagctttcatcagaccaaatgatcagcagtccaccatagttgtgcactttaatccctgcctcctccttgatctcccctacataatgctatgctatgcatgtcaaggtgtcagctgctagcttaagcatggcatcttccttctaatcatagcactcactcctagggctactaaaacattggctctacttgttgatttgtgactggttggcgccacagggggaggaccccaccctccacgaaaacgcagggacttcttgcacttgagcatgatgatgccctaatgtcttccatgattcgatctgaaggagacattgactccattgcttcagttctagactagctacctcctgcaggaccccctaaggccccctttgaatcacaggaatgaaaaaacggaggaatagaaaaaacataggattctgataggaatacaagtgtaaaacagaggattgcaaaacacaggaaaaacataggaatgaccgtttgattgagccgcaggaaaaacacaggaatttgaggagagagaaagactcaaaggattcttaatatgaggtagaacctcatgttaaatttccttcaaaatttgcatgggaagagccattccataggaattttataggattccataggattcattcctttgattcaaagggctatataggaaaaattcctataggaattaaatcctttaaaattcctatgaatttcctttgaatcaaagggggcctaaaagagggggattgatgaactccggaacaagaagcaaagctgttctcttctctattggaaatccatgctagtgcacactgcagtcatgcatgtttctttcttcttggcaagcaacattattggtttagctagctagttaaaatttatttatttcatatatatgagcagtagccttttaggccttattaatgttcttcaaactgcctcgcctaaaattgatgttcttcaaaaacaatttagtgtcattttggagtactcttttcttagataacaggaaattttcattacccaaaacaaacaagcagtcatctgattacaggaaaaaaaacatattttggagtactataagatgcagcaacttaagtttatagtcatatggatgagttttatagaagttttcagttcttgctagtctgatgaatgccggtaggttgttgttgtgtgtgaattgtgttggttttcatccatctatctatctatctatctatctatctatctatctatctattatctatctattatatactaaaagtccattaaacttccttaaaacgctctcaagctgccatgtggtgttctaaaaacgctctcagattgccacatggcaaaaacatctacccttttatttttcacttaaatacgtgggtccaatattataaaccattaaatttatatataaaatagtgtatgtacggcgccgctgcccccacagatccgatcctctcccatcacggctcgcgcgtacgtatgcacgcccttctccatcctcttttttctccacggtagttaagataagcattatattgttaactaattttaaataaaatttccatggtatatagccggatctcccggcctcaaagtatatcttcatgcgagcctaccggcatggacatgtactgatgtatgtgatcgtcgatgaataaccttttaactatatatatatgttgaattgttcttttattagtctatctttttatatcctaatatatcaatcaattatttaaggtgcacattgactatgattttattgtcaaataaaaaatagtgtgagacatataccttcacgatttacaatttgttagttactttggtttttaatagattgatacctttaacttatatatatactctttcatcccaatcagaaattatatatgtctggcatgcttgtatacatgaaagcatcagctaacctttgaaatttcaattaatgtacactccatggacaatgatactggattccatgaatgatttcagagtaaataacacaaaaaacttcagatactatgatcaaattattgcaaaactatagatttgaattggtgtatcacaaaactacacatttaacaccaaatttatcacaaaactacacatttaaaatgaagtgtcacaaaactacacatttagtaactaaattatcacaaaactacagatttagaaccaatttagtcaaaaaaaatgtttacagctccagcataataatggtgctagggattaaactctaaaaactatagttttgtgttaacttcaatattaaatatgcagttttgtgatacttaaccttaaatattatttttttgataaatatgatgctaaatctgtagttttataatacaacgccttaaatatgtaattttgtgatagtttgatcaaaatacatgtagttttgtgaaatttaaataaaatcaaatgtgtgattagatcaaatattttgttcctaaaaattcttttaacacctctaataagttgaagaaaattcaaaaaatttgataaagaaaaaggcaaattaaacctggaatcgataaatgattatatgatttataaataccccatagtaacataaaaaggtattttaaatcaaagcaaatatttgtgattgtattaaacaccttgccactaaaaaattctcttaacgcctctaataagttaatggaaattataaaagttatggtaaagaaacaaacaaattaaacgtatgatccttatttctgcttaaattaatcaaacctacatgtccatcccctccactgtttgatctcatcgtagatatctcacatttctcttctaatataagggtgtgcaagagtgtttgcaaaaaaaaaaaaataccacattggtcgaatgcattagtcgattgagatatcaaggttttgaatggctattacctttgaatcataaattttattgtttttatccatttaaatcattttttttaattattaaaggttgaacactaaaacaactgtatgtctcatcatatttccatttatacaatagtcataattttctatgaggaactatccctagctggctagctatgataattcgattacgtctactatcaaataataaattaattattggttttctacataaattggtagagcaattaattatatattgttacatatccaatgtcttttatagcaacttaagttttctctcttttccaatagaacttcaacagacagatgtcctaggtaccataaaatccaatctccaatagacaattttataaataacgtaattaaattcgtcatgcaatgctaacggagaaaacatagacaaatcatagttttgaaatatggcatgtattattccgttagtacattatcttataagtttctcaaatgcaacctacgatacatgcccgcacgaatgcgcgggctaccttcctagttaaattaaaggacatataagtaacccattaaaaaccacagagggtcttaaaaaactagagaagcgtatatacatgaaaatgaatttacatcttccttacagtaaagtaagaaacgagtttacgtcactgaatattacagcaacctatcaatttgacagtaaaataatatagagaatattgaagagttatgttctattcaataatgataataaaagagatatgttctattctgaagacttttctcctcgatggtccttttcatcaagcaatgcttcaagccaaattggtcaagaatagcataataacactaataaccattgtgactatatagcggagacaaatagatggttcaatcaacaagtgcatccttgtctgtcaaagcctaatttgatgtgcttctaccttatgtcctggttccactagaggatgcatgctgcatgccaactaagatgcttgcccaaaattgggaacaccgcaattacttatagcatatttgaactcttcaaaaatcacacaatttaagatgcaatcttttcgcccattaataattaagttgaaagaaggcctataaaacaaacaatataataagaggcagggtagggcccacaatctaatcacgttccatttgagataaggttttcttgacataaaactacatcaatgcaaggactcaagtgagatcataacaaaagtgttttcaaatctccccttttgagatcttgtttgtagttgggacatcttggtgatggtgactcacatgggcctcaggccaaaggttttagctagcattaattctttagcctttactcctaggggtcaaaaaatattttttttctaggtgccttgtggtaataagggtatcaattcaacatagctagcagtttgttgggaaatatgatggttcatcaacttattgcttctagtggttgggtgtccaacttacaagtatggtttaagaaagctttgggaaaatgttgtttggtggtcattcagtttgttatgtccccttctttcaaaagcaggtacttttttttttcagaacataacaatgtgcaatggtgatcaattattgacctttggaagtatgccttccacttgtacagaaattttaaactatatgtcaaactagcagtgagaagaatttgttctgtgtaacatatatattacgcctcaacctttgcagttacatatattttagaactactaggagcatgtaacatgtaagtttacatgaaacagttcatcccctgcatttctgttccaaacaaaagctgatgaaactggacaatgcacagtccaaaaggaatcgtactcattgtgtgccaaattggtcacagaggaatgtttagtagcagcaaattggatttaaaatatgttaaccctgacaaagcgatccctgaaactgaatataagtagtacgagggttcatctctgcatataagaaagtgatcagagaccatttttttttatcacgtgcattgcaagctctctcgacagaaagaggtggcaatggcaaatgggcaaacatgtttccaggggcggaaacaataaattagaacacccatcttgcagatcacaggaagaccacacaattaactacaaataattacaaaataaaaacttctaaactagcaaccgccgaactctagtattttggaaaagtccaacggctacatacagatgagtgctagctagctgcttaattctggcaaaaaaataatttcttaaagagcaattatgggcctagtgaaagcaagctttttgcagtacaattgtgactaaattagtcttcaaataaagcgtacgctggtggactaaatggtacagattaaatacttaattattcggtgctttgaagattacaattgcatcagaaaatcgagacaggaagaagaaggacaagtctgagttgatatcaggatagaaacctaccggcgcaatatgtttatcaacatgcctagctttacatcacctttcatatcacatcacttggaacaagaatttggcaacttgaaccctaagaagttgccaatccggccccacacatgcatacatcgcaattctagaagatgattaattgcatatcacttcaaacaaattaattaattaaatgttaatttggccatccctttcatctagcagctatcttcttagctataaatttccttcctgatcttgtgcaaatattcaaaccacaacctagagctcatctccggttttagtcaccaaacaattgaatacaaattaattagtagtaaattaaaaatggccggctagctctttcaaagagtaattaacttgcttgttggtctaaacttccaaggagagatatagaatgaattctctctgcactagacaggactcgccatgcgtcacctacagcttgtctttttattaaaagacctatacctacgtgtacttgggccaccaattaactaaacccacaagcaacacaagatcccaagatgatgcaagcctagattaccagtagttccatctcatgcaattcgtagccaattagccagtaaatcttcgagaaaagatgatgccatctctcaattagcttgtttaattatgattggtttat

SEQ ID NO: 67075 - DNA, 803 bp, Oryza sativa
attcctgcagcccctcacagtacacgcacactcacctctacaaacacgcacatgcacattctatccctttgaacacctccgaaaaactgaagcagcatatcttgagatcatgggcatctcgacaggtacatcgcctaccactaaaagaataattagctgtaaatgtgagcacctttgtcaagtctactcgtggaggagttgtgcacatcattcaagctctgaaaatttgtatcacaaccgccgttgttctggtcaagaaagtaataacatatgttatgttactgtacactaaattccgttactgtcaattgtcatgggtgtctggagtagtaacagaaatgatgcgggatttacatcatccttgaagtatgaagtactcctacgttttaaaaagaaacctcacattctcatctgagttggcctttttgggacagagggagtaaagatttgtacgtcactggcgaaactaacatcaggatgaagccgcagtatcgaatccagcactgaattagatgagaacccccaacccaaaaaaaaggaggaaagggagaatgcaactctgcgctggtagatttctctcgcggcgatccctcccgactcatgccgtcgggaagcagggcaggaggatttcgctcttccaacggcggctcggttgacacccatgtatagatcaaaataaaccacgaaacccatatgttttaatctataattgaatttattggttaaccacttacactcttaaccatcagtacctaagtaaggaacccaagtgaaacaagtccagcagatcgctactattggtg

SEQ ID NO: 67076 - DNA, 10134 bp, Oryza sativa
attttgtcttttgtgaggtaaaagtaaatattatgaaatagtccaatatttgttttcaaagtgaatatcatatatttaaataagcaaacagttggtactaacatatctgataaaaaatatatattatgtatggcatattataatatgctttcttttacccaaagcaaagtatagacattttgctagtatcttaaagtatgtgtagagtgttgtttcatgagagctaaccatttatttttcttattctcttatttttacataggtttatagttaggttatagcttactataaattgacaggttgctgttgcaaggaacacatgcaaatcttctattatatactaaaattccattaaacttcctataaacactcttaaaccgtcatgtggcaccctacaaacgctcctaagctgccacgtggcagaaaaacatctaaccatcgattttcatttaaattggtggacccattctttgaaccattagattagtaaaaaaaacaaccaatctacctctaaactgggccccaccctatttgtatggacgttcgtgtaggtacgtactccataccatcttatgttcttctcttttcactctattatctttcttattttccttctattagatggaaagcaaaatttatataaaaacatttaagtaactatagtattctttttagaaacacaaaacaaacgcaggcattcacaacacgcgcacactcatcccttaggacgcacacacgtataccctaccccctatgaacaccatcgaaaacatttaaatcatatatgtattcttatatgcttatgttgttagattatttatatagtatctaaatcatacatgtatttgatccgcttatgttgtaagataatttatcattaataaatttacagttaaaaacccatatttactatagaaatatgtcattattatggataagaaaaacttgaaatcgttacagcgtataattatcttaaagaaaaaaattacctcctaaaattgggcccaccaggcatgtatgtacatacgtatgttactttttctaagaaaaaatatgacatcttttctccctgttacttctcctattttcatgttttattagttagaaaagcaaaaaatattttttataaaatctaaatcatataactaatttttatccgcttatatcttatgactaaatttacagttgaagaacaaatttaactataattcaactttgaaaagaaatgtcattttgggttttattttcggacttttgtgtgtcactcaggcaattataaaaaatatgaaataataataataataataatcatcatcatcattattattattattatatcatcgtacataacttcataattaaattagatctgcaaaaaaaagtaaaatgaatataactatgagcaatgctgacaaacttatactaaaaaataaataactataacatctaaatcacgtgatccgtttattctatattcactgtaatttaactttttatatgccacttcggggttatatttttttttaactttagcatgacattcaaacaattatgaaattatgaaaaaaaaatgatatagattttatcgttctatataactgcacaataattaaattagatctataatgatagaagtaaaatgccaaaaagactaaattgaattatttggagaaagtctaataagttcagaaaaaaattagttcttactttttactacaattgatgtttcaatttcataacaatttttaaatacttagatattaatggccttacatctatactataccataccatagcattatgagtttttccacatattattacatatataagaagccacactaaggttgcagtgtatgctaagtatgtaataacttgcgtcaataagaaccaaccaaaaggatgactaacttgattctacaaataaaacatatttattaataataatagttttttatttgttcaaaaaattctactaaacattcaattaaataagacaaaacaccttacttttaaattataaatgtttcctaaacaaactaaatatagctctgtactgaagaaatcatagataattatttattgcgatgttttaaatatcatatattttaaaagctaacaaatagtttggaaaaattatctaagcaatgcgatgtagaaaatttattgagaaatagtgctttttaaacatggcatgtatcatctggttgatattccgtctatataagtttttcaaacgcaatctactatacatgcccgcacatcgcgcgggctacctttctagttagtaaaattgttgctaccattatagagagaagcatcatgcatggctgctagctagctatatagattgagatctaaccgatcaagtgaccgagatttaaaaattaacaaatctcagtttgcattaattatatatggatcactacttacaaaattaatcagaagataacaaaagaaaattatccagctaaccagaaacgcccaaacctctaacctcaaagatgccgtctgcattatgtagattataaattttagtttatatatatatatacattcatgactgctatacctaagttgagcatctcttacttactcaatactatactatctaaaatttcaatctgattttatatgcgcagttgaaggcatcaaacacttagtgtttactcgcatattcgatcgtctggtaagaaattatctatggcagttgttggaaaatattatatacaatataactaagtcaggtcaactgcacatggttaagatagttaatatattttcatcttaatcttataattgtatcaagacaacatccatccaagaagaggtgatctgtacgctacatgtttaagagaatatccgttcgatatgtcctatttcaaagtcaacactagatcactacgtctctaccaacgcgtgaagcaatcataggctgttaattaggagcccctctatatatgcgataattaagcaaataataaggcaattaatggaagttatatatactatatcctaagtgtcacatttctctctgttttttttttagtaacttcaagcacaacttggacgaacatatatatagtcttaacatctgcataatattattatgcgcaactagttgacatatctgttctgttagcttcaaattcaaacaaacatcagtatatgctttgttcaaacttagccatcctatgtgttccctcgtcaccattggataattcatgtgtcaactataatgatgacttcgacaatgactataatgtactctatctcgtgcaatttgcaaggttaattgattggatgatcatttcgtcgaatataatgacaaatatgaactgagctatcgagaaccaaacacttccaacatttgcatagaacatatcgatcgagagtcgaatgcatggacacattgcttacttagctacacacgtactccctacatttttaatagatggcgttattaacttttggtataacatttgatcattcattatattaaaaaattagtgtaaatataaaaacatataaatcacacttaaagtttctttataataataaactaagtcaaaacaaaataaatgacacttatattaattttcaaatataataaaagatcagatgttatgtcaaaagtaaacggcttctccatctaataaaaatagagttaattagtctatgatattaaactaatccaccactataataaatggagcctaattcaaatagcattgtttgcaattccggttcgaaatatcggaactcccccttccctaatacgaaaccattttgaccattaatatcattttttcagttgtttgtgaattaagcaaaattcattcaaatcagtcaaaaaattattcaaatttcaaaaaagaaaaaaaatcaatctacgcgtgcgatcatgttaagcagcccgtctaggaagacttgtcttcatgtgcggtttggccgcccgcacgcgaagatggtgatcttcgcagaccctttaggcatactggccgcacacgaaaacgtgtttcgaccgtctgtaaaaaccgtttcttcaattctatagtgctagctgccatgctactgacctgtagaagagcacggagggagggaactggtagtagacgccgaaggagtggccggcgtcgtggagggcgtcgaagatggtgcgctgcggcaggccggcgcggagctgcttgccgtcgttgctgacgaggccgtgcgacgtcgccgagtggacgaacatccggttcggctgcgtcgacgtcggcaccgacgcgaaccaccggtcgcacacggcgaactcccgcaccagctcccggtacaccggcaccttctccggccggaacccgttcatcaccgtgctcgacatgccggcgcgctccttctccgcctcctgcgcgaacccgctcatcggcggcgagggcacccccggcttcgtcgccggcgaggtggtcccccacgtgtaggcgtcgccgtacacctgctcgtagatggcctggaacgagtggcccgggtcggggtccacgtacccggagccgtcgccgaagtggatcgccggggaggaggggtcgccggcggtggcgcggttgaactcggcgcccgtcacgccgtcgatctccgggttcaacgacttcatccaccccagcatgtggtcgaaggagcggttctcctggaccagcaccaccaccgtcttgatcttgcccgccatggctggcgtcgaggctgggattggaagagggaagaggaagataaacgatcgaggatggcttattagctagagctcagtggcgagctgatagtagctgcttctatgtgtatttattggcggctctcgtgtggtggagacgtgtgagatgctgctaaatacagtatgtacaagtagtctcattttgttaattaagcaaatccttgcaattgctgaggtgacatgattaattattagtacgtcgtagtaggttgttatgttcattaaaaaaaattactgtattaggttattatgtacagcgtactcttctcatgtttatgtttgaaagtagaggaaagaagaatactccctccgtcccataatataaagaattttgaatttttgtttgtattgtttgaacactcgtcttatttaaaatatttttaaaattattatttatttttttacttactttattatctaaagtattttaagcacaacttttcgttttttacatttacataaattttttgaataagacgagtggtcaaacagtgcaagcaaaaattcaaaatctcttatattatgagacggaggaagtactggaagacacgtaaaataaggtgtgccattaatatatactccctccatatttatttttatgatgctagttagttcaacatcctttatttagagaaggaggtagtaattaattaagtaggtgtattaattatttcaaacttaataaataaataattttttaaaggaatattcctatagaaattgatgaggatctaagaataccttcaccttcaacttcagcaacaactcttatttctttctcttttgtttcaacgtacactctatactatgcctagtttaacaacacaataattcaaatatgcttccacgtattatttagccactcattttaaattatttgttaagttaagtttttaaaacttcaattcatccatatagttctagataatccgtggcaataggccggagtactaatgtacttgtacagggcctaaatagactttttccctaaaaatattataggcccttggtggcccaaagttttgcaggcctcggtaagcccagtactaaactgttcggccttcgctgagtctatgggccgtgtgcttttccgattctaattcagttttcggacgcgcgcggcgtgcgaaacaagaagagaagccgttgcggcggccaaaattccccaattcccaaattctagggttcgcctcttgcaccgccacgcatcaggagcacacgcccacatgaagatgagggcggcggtggccgacggcgacggcgacgacgacggcgccggcgcgcccgtccaagtcagcgtggaccccgccgcctaccgggactggtccgcgctcccggccgacctgctgctcacggtgatggagtcgctcgccatccccgacctcttccgcgccgggaccgcctgcgcctcctggtacgccgcctactccatcgcccgccgcgcccgtatccccatacgggattcggctccgtgcttgctctactccggcgaaggcgacgacgaccccagcaaggccaccctgtacagcccctcgagcggggactgcttccgcgtgcggctcccggacccgccgctccggagccgcaacctcgtcggctcagcgcacggctggctcgtcaccgccgacgagcaatccaacctccacctcgtgaacccgctcaacggcgcgcaggtcgcgctcccgcccgtcacggccctccaccatgtggagagcttcgtggacgaggaagggaacatagtgtatagtgttgatgagtctctggggcccgacgatccagaagccaatctccccgaattcgaggagctcgccgaccgggaagtccccgtggaataccctgcggagaagctgcgcctgttcatgtaccacagggtgattctatcctgcagcccatccgtggggagggaatgtgttgccctgctggtgcacagaccggatgggatgatctccttcgcccgaccgggcgacgagagatggacccatatcaaccggacaacgagcaatggatcgctcaaatgggataccggctataccgatgcgctttacaacaagaatgatggcttgttctacctgttgagctttgacggttctatatgcgcgttggatctaagtgggtcaagtccagttgcgaggaacattgtgaagaaaaatacacagtgggataatcctagcaaatacattgtgctggcaccatggggcgatctcttggaggtgtggaggttgagagactttgatgaacctgatgaaactcctgaatgttcttctgctgagtttgaggatcgatctgataagtggttaacagaagaaattatgctatataaagttgatatcgataagcagaaacttgttaagataagcagcatcggggattatgctctgttccttggtttcaattctgtggtgtgccttccaacagagaattttcctatgttaaaacctgattgtgcttatctttctgatgaattttatgaagaaatatgtgtcaagaggcataactggcgagaaataggcatttgggatttgaaaaattgcaaactgcagagccttggtgatgtggagtctcttcatgcttggcgtaattggccatcgcctatttggataacaccatctcttagttagaaagatgtgggagattttcatgtattaggagctccaatatggatatcattaatcgaaaagagagatttatgatgaactgatgatagcccaatactcaatttggttctgaaatgattcttgctcctgtacaataaaagctgtagtagttattattcttatcttaaagctcagcagtttgctgcacccttgttcattccattgctattcttgtgcacatgccttcaacacctcagcacatgcccccggtaaacctctccttcctcgttttcatgtactttcaccgtcgttggatgttactgctgctttgcttctttttatttcctatcaattactcttttttcttcgttgttggtgttgttccctccctttgcttgtgggccgtcctgtcagttactcaaatcatcacttaagagaatatcccctcatttttgcatgtcacttaaagcttaaacaaaaaaatttaaaaaaactagtacgatagaacaatatatgataggtcacttcataaacatgcaaatttaaattcaacttatacaagtagaaacaaaaataacaaatttcactatgaagtgaatgcgtaattcacggtcacatttgttatttttgtttcaaattgtataagtcaaattttaactcgcatgttttcaaaaagatatatcatatattgatctatcttgatattttttcaaaaaaatttgataactttttgaacgacacgcacaaaatgaggggatgtcccctcgaggaacaaaaatccacttccgagtttgattgacatcattcgttgttttttagactctactaccttccatttttcattgtcccacttgtctgtaaactgttgcctttgtcttccttcttctgcttctgtttatttccttgttgcaattgtttgttgtgtgccgtcgcaagccccctggtagttttccttctctttactcctttcctttctttgcaagctctgtcacttcttctgtcatgcttgctcggttgctccgcatcttcatgatgcattcttaagatctccctcctctcttgctctcatcactctcactggcagtgcttctccatgtttaagttgctatatgtgacacggcactcacagagagtgccctagaagggaagggggaggactcggcatggtggtggcccgtgctgttctaccggacgagagggcagcttgtggccatggcttttgatttgagcccagtgggatagatgaggaggtctccccagtggtggaacatagatcaactgtcatcctgtcatgcccacatcccttctcttaatctctccatagattgctggttcttatagttctttttttgatggtttgatttggattgcttgctctaatgtttgctgatttgctctatagggtgtctttggtggtgttccttaagtaactcgcaatggggatataggatgcctgcacacagagcaagatcctgaggatgaaaaagggacagatagaaaaaactattgtgaaatctaattttggtgtattgtaactgattgtaagtgctatgtaattgagtgtaaatccaatgtaaccgagtgtaactacaagttggatataccagaacacgaatcttgatgcaatatcctaagggtgaaaaagtgaaagatagaaaaccaaaaatccattgcaagtgaactaaaaaatctgttttattcttatgttttttcccgtcggtcctttgggggtcttgcatgcgccttgggccgtggccttggcacgtgggttgacatggcatggcccgacccactacaggtgccgtgcggttggcgggccaaccgttcgggcacctgtagaagcaaagaaaaaaaaccggtcacacgacacctcccccatgcatgaacccatccgaatctttgcctccctccctctctccctgtctcccctcttcctctctcttgtcaggacttggccaaatttgagtccaaaacataaaatttcagagaaaattaggctagtagctacttagtaggaccaaaagtaagggaatttcattaaaatgggaagcaaacataacagaattgagatgggtgctacaaggagttcgctgatctcaaaaaactcgatggcttataaggagttcgctgcggctacgcgacaaaagagatggcgataacgctatgacaatggatcctctgtagaaagacttggagcatcccaggccattcgatcctcataacacactcttgcgaaccattttccttaaatctcagtcgttcattcgcaaccataactttccttgtattctccaccttgcttcaggatccagactttagttctaggcttcagttttagaacctgacaatgcccccctttaagaccacatgtcctcgtgggtgaaaaacatgaaaaactttggagatgaaggttgcatcttcctacgtagctgctaattcaggtaagttggtccaatggatcttccattgaacgaccgactcattgttgtgaggaatgagtctacgctccaggacagctaaggatgccgacaatatattcccatcaggatccaccagaggcaagctagattctggaaaagcttttgagcccaaatgcttcttcaattgacttacatggaagacatgatgaatatggcaattagtgggtaacaaaagacgataagccactgatccaatcttttccagaacacgaaaagtaccatagtatttggaatgcagtttgaaagaattgtggatgcccaatggcattgtggctgtaaggttgtattttcaggtaaaccatgtcaccaatgtccagag

SEQ ID NO: 67077 - DNA, 1228 bp, Oryza sativa
ttttcgttaaattctctctcccggttgtattgccttgctatcgacctctcatgtactttatttaaatatttaggttcgtagctaattttttttttgacacccgtagctaaaaattgatggtgaaggggagtaaactttttcttcacctcgctctttcagtgcgttggtcatcgcaaggtacatgtctagattcactcaccgtcatgcacgcgccactatcaaaatggagatcattgatagctgcatcagctgcctatcaattaatctctcatttttaaatctgaccaaattaaagctcacgggcaaaagtatatattacacacatactgacatgtggggacaccacaccagtggcaataatcagcttgtaagaatacgtacttcgttatattactaattaattactctcttatcctccactaataaagttgtcatcttgacttccttgcacacagcatgcatcaccgtcacatctcagttaaaaaaaagtccagcaaattgagtgccaggtcgccatcagacgatgcaaaagttcccggacagagcatgaatttttcttcatggaaaagatcttctccccactccatggccgccggccgggcaagtgctcatcgatcgatcaagtggggccatatgagcccatgacgcaattacgaggcagcggcggcgacagtacgctgaagcagggtttacgaaaccttttcattttttaaaccacggtcggtatcgtggaatagcggtaacccgattctaaacgatttagtaaacactacattagagtgcgggacgaaggcccagaggacgaacaggttgcagacccgtggatccgaggaaagtttttcgaggtcttagactcttaggttatcaggtcaagtatagctgtccattctaaaataaactaatttctaccttcctatctatcatgagtctataaatcgataaattttgttcttccaatatctctcatatagcctttcactaatataattttgctattagactgaactattttggtcatttcttttcctacttaactctaattgaaaagttaggatttaaggatttatgttccttagagggagtatatagctgaaattaactgattgatagataatttgatttctaatagctatttgacgatataagtaaataaaataactactctgaagtgaaaatgttgttttagaaaagtattttaagattttatttttttttacaaaacacgttg

SEQ ID NO: 67078 - DNA, 5702 bp, Oryza sativa
ttagtgtgatgtgatatgtctgtgatgttgagatcaaagggacagttactgttaaattcttggggacggacctgtccgccgtggacgtggttggtcaatcagaaggaagcgcgtctcgaacatgaattatgctatttttttcagaaaaaaataatttacatacgccgaatcttcttattaaaaagtgaatatgtacaagggcaaatatgaacaacaaaccaatcgaatcgaggatgacattgcatctgtctgatatcgagtgtgaccattgttcaatttcgaatatacgaagaatttgggaaaaggatggcatgcaatatatatttaaaaatttcaatacctttttataaatatgttctctattttaggtgttaacctggcaataccaataatgttttgttgcctacacgatagatatttgtaaaaaaaaaagaaatttggagggctttgtttttaaaactttgttaaaagttttataaggaaaaaacagtgtagtattttggagggatttattttactgaaaaggtttaaagacaaaattatatgtatgatacatgaatttgcatagtgtctataaataagtacaataaaatactgtgcttatttcagtggaagaacttgcttagtccaaatgaaccagggaaaatatttcagacggacaaactagttcatgctactaaatgccacgctgatttcgaagtgagcataatgcatgcagacatcactttgtgcacattctagtaaaaagaaaatcgacttatgcatatgagttttaagtatattaggacgatatacatgtattatcgtgctacagttgtaagagtgaaccaaacactcaactaagaaaccatgtcatggctaccatatagcattggaaagggaggtatccaaccaaacaacacattaagaaggtggtatttgaaaccaatgaagataaagattaagttgacgcacataaaacgaaaaaactattagcatatgattaattaaatttaaattattacaaacttcacaaatggatatatttgatattttaaagcaactataaaaagtttccgtacgaaacatttcgtaccgtctagtagtttgaaaaacgtgctaacgaaaatcaagataaaatatgtagagaaaagaacgtgacgtaagcctgcatttgacatcgtcgtttggcattaaacctgcagccaaaatgaaaaaaactattaacacatgattaattgagttttaattattaaaagtttgaaaataaatttatttaatatttcaaagaaacttctactccctccatttcaatataaatatataagtactttttagatttcgacacagtcttcgagatattactttgactaacaatatctatgtcttatataaaaaagagttgtatattacgatagtatgtttaatggtaaatatatacaaaatcattttatacaaaatatactattttagtatttggacaaacatgcttcttataattctagtacatttctactcggccatattactctgtccattataggaaaaaacaatctaagatgagacattattttaacattatggtctcgttcttttctccaaccagagttgaatgaaaattaattttcatggcacgcttttcaaactgctaaaaggtgtatttcgtgtgaaaactttctatatgaaagtttctctaaaatattatattaatctattttttaagtttgtaataattaaaagtcaatcaattatacgttaatacgtaaaaaaaattaatctttatctttagaagaaaagaagaaccccaattattctggtttgtcccattatttccagttgattttttctgcacagaggtagtcctgtcggagtcgaacgcagccggcttccctttcacaccgccgcgccgatataaaagcgcgcgtcccgacggctggggactcccacttccacggcgccaaccgccaacccactccctcactcctccgcactaattcctcgcctctacaatctccttctcctcttccgctcgcgctcgcgctcgcggcggctactatgacgcagctcaggcgatccacctcgcggagcgcggagtggatataggataggatcgaggcggatcggaggaaggaggaggaatcctgggttggcttgattccccgccccagttcgagtgagcttccggagtttaatttggggtagtgttcttcttcgcaacaaggtatattctccccgcttgaatcatgggggcgcgtttgcctgtgtgtgagttttttttttttgtgaatttttcggtggttcggttggattattctcagccacattttaccacaggaatttgctggggttttggcgttccttcctcttttatataggagtagtagtcgacaggtcccatctcgagttttcatcctgatttgatgggattttcggcatttctcgcgatttttttgcacttgttgagttggtactagtacaaaagtaggagtactactactagctagtagctgccgctgcatgcatctgcggagtttagttgggacgtcgtggttgcgaattaggatggtgttactgtcaggtttcgttggcctgatgttgctgagtggcagatgtgttatttgtctctagtttgattgattttgatcgcacagagccattgcttgagcacaaaagcgactagctaggcaggttgttagaggcagaagaagtaggtacaagtaaacgatacaaatggggtgatcttcttttctgaagaactttcatgtcacttgcatactgttaccgtcaaatttggccatctgtttcagttttcattgatccaactttcattaagcaacggagtatagagaaccggagtgatttgttttcttgatattggggaattttctgaaccccatgtaccaaactgggcatgcatatgcaaacacccaaaacctcgtgcttcaaaaagaggaataaatgatatctaacatcataaacaatggtggtattcataaactcttcttttttcctagttaggatcctgaaattttggaattttgctgtcgtggatatgactagttgctgctgattatcttgaagacatgatcaatttcggaggagtactctgtgcagttacccttgtggtgttgctccccttcttagaggctgcagatggaaaatctactgatccttcagaaggtaatctttgcaagcgtattcttcactatgagccaaatcattctttgcaagcatattcttcatgctgagccaaacctgggctgggtcatattaagctggttttgaactaacacgttctcctgatcacaaattcctcattatatgttgacacatggggtaggcttaggtttggactaggccttggggcaagacatgcttgattagttgattggaccattttaaactggcttttgaaccaatattctcttatgatatctctgtaattacatcaacttttagtttcttatttgcacaatactccgttcatttctagatgggtgcttcagtgttctcccactattgattctgtaagacagtgggagtaatttgtttatgcccttgaaaaacaacaaaccagaaattgtacttcatggattacaaacataccggaactctggtctaatgaaaacatgcaagaattctattttatgcctgctgtgatgccagagtccatttctagtaactgaagtaggtattttttgacgacaatgagccgaacatagtatttgtggctatacagttttcctactaggtaggtatttgtaaatcataccctaccagttagtatgtttgtctaacagagaatgatattatacacagctcttatttgaaaaatgaaataaagagttgcaaaaatgtatgctaacgttgtaaatgaaataattctctcataggatttgtaaaaaatagtttgttatctcttgtgctcgataaccactttctatcaacagactatgagatgtttaatgccaacagtattttacattgagtttctttagttaaaagttctaaaatatttgctgcaaaatatatgttgtttttctccctatatgcagtcagtgcacttatggctatcaagggaagcttagttgatcctatgaacaacctcaagaattggaataggggagatccatgcacaaaaaattggacaggggtcttctgccatgatttgggtgatacatatcttcatgtaacagaactgtatgaccaatacttctacataatttatttgccatatcctcactttcagtttggttgtcataataggaactatgaatgctagtggtcatagaaaacggttctatagttaaatgctgatgactatgttttccatagctgattaggaattacaaatttctgatgcatgattaattgtataatctattaaagaaataaatagttgatgtcttacaagtgtcttattgccatactaaacatttgaagcatactgaattgaagtgttatatttagtctttattattgaatggtggcaatgtggcatgatgctacatttactggtaactatgcatctcgtttgatagtaataatatgtcccaccatgttaccgcagggaacctcagtcctgtctgtacgaggccccttttttaaaaaaaaaattctaagcattgttggagcagccttttgaagcttttctttgcttgaaatattcgataagggcatacagttccagtaaatttcaatctgttgctgattatattattttgctccatgtaggcaactgtttaggaggaacctctctggaaatttggtaccagaggtcagtcttttatctcagctgaaaatattgtaagtatactctaatgactgaagattttattttttgtaagttctgcattcattaaatattaatccttagtactatcttcatatcactatattttccataaaataaattaatggtgtcttcctggataaaagattagccttcatcttttacttgctgaaaaattactaaagaaaatactaattgatcagcatatagttgatttttttgcatcaatctcttataccatatattaacttattgctgtttctcttgaagggattttatgtggaacaatttaacaggcaacatcccaaaagagataggcaatatcactacgctcaaacttatgtatgtattctctttcaattaattctacacccctcttcaatatgcacagaaaacaacggaactccttaattaaattatttgctatttttcttatatctaccaatactttactctttttttcatgctttatgtagattattaaatggaaatcagctctctggtcttttaccagatgagattggcaaccttcaaagcttaacaaggttacaggttgaccaaaaccatctatccggcgcaatacctaaatcatttgccaacttaagaagtgtgaagcatctgtaaggattgttcatttccattttgttcctgctttgttcttcaatctgaattcagtgctagactcaatttcccctttcatttcagtcacatgaataataattcattaagtgggcaaatcccgtccgaattgtccagactgaatacacttttgcacctgtaagtggaagcctattggttgcatttttttctaatgcatgttgtatcaggtaacatggaattaatcttattatatactctaactaaaactttgcagccttgttgataacaacaatttgtctgggcctcttcctccagaactagctgcggcaaa

SEQ ID NO: 67079 - DNA, 9192 bp, Oryza sativa
  unsure (1)..(9192): unsure at all n locations
agcgcggcctctggtgacttccctgaggtgccctgaactgagcggccttcctcttcctgtccatcttgttgcgttgatcctcctggcggattgccttgtcaaccaacctctcaaagtcggcgtagtccccagatatcagttggttggtcagctcgtcatccagacccgccatgaacttctcctgcttctcggcgtcggtgcggacatcctctggtgcatatcgcgcgaggcgattgaactcgtggaggtactctgtcacagtccggttgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacgcgggaccctgaagctggtgtgtggcaaaagcgaccttctcctgatcattgcactgcaggagattcagcttcttctctattgcatggagccagtcatttgcctccatggggttggtggtgctggagaaggtgggtggcctgacgcgtagaaactctggcaacttggactgagggggagggggaccaaactgttgatgctgctgttcggcgtgctgcatcatcctttggtgcatctgctggtgctgctgctgcatctgctgcatcatggctgccatcatctgagtctgatgtgccataacttgggcgagggtcggattctcgggaagtggtggcggaccattgccagaatcactgttggggtgcacaccatcagcgcgttcttcgccgttgctgccctcgcctgtcgtgcggttgccagtcctggtgtagaccatctggagggaaaagcagacgggggaaaagaagaaaaacagatgctcaagaactaagctttattacaaaggaattaaaactgcaattgttctgatctgaattaaaacacttaaaaagcaagcaaaaatccttattaagacagccatatcataggcacatgatatcgaccgtcaactgaccccaaacaagcaacctaaacacgcaaactaacaaccagaagctagacaatcgataaactaatgggaaaacgagcctaatgctcggaacggctcctgcggtcggtggagtcgaaggcgtcctcctgctcgtcacccggtccctctgagcgactcctggagcctgacagatcagtctcgccgctgccactgggagtagcggacaaccaacctccggtaccactggctggacctctggcggctgatgctggagcgaaggagagagtgaacgcgggagctggaactggagctgcaggaactgcaggcggaactggaggtgctgcgggagctgctggtggaggtgggttcctgggcgcaagctggatgcgcacaggtgcagtcgtcgtcttgcggggcgtggtgcggatccggactcctcctggcgctggaagaccctttagctgagcgttctccttcttcaggcgcgctatctcgtccttcagagcgacgatcctcatgagcttcccatcgttcaaagccttggtcaccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggccgcctcctgacaggcgtgatctgctgtgcctccagatgcctcgaccgccatgttagcgaggcaagtccccacgtagccatggacctccaagcggacacggtgaggaagctcgccgctgagcggcggaatcgtcgtgtactccggcgcgttggggtagcccaccaccagtgtcatacgtgccagctctgccacaaagtcgatcatgccttctccgcggtggttgggtgggtgaccggccatctagagaagacaaaggagtaggatcaatgcatgctcaaatccaaatttaaataaagcaataaagactcaaataagggaaacgaaccagagcgaaatttttatgcataggtcattttgcatgagagcgaataaataagacagactcacataacgacaaaataatgagaaattagatacatattaataataacaaacgaagcataaacaccttgcaacccatgttataaagctaggacctaatgcatttcacccatcaaaccccaactgactgacgaataaatcccaataattttactaaaaccctagactgactcgttttgaaaaaaccccgcttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcccaaatagaattccaagcagaatgtgcattataatccccatccaggaccagccggggtacacaaacgacaatgttgacattcagatccacgtcttacaaacatcataaaagtcttacaaaaatgcagcggaaacaaaagataactggagctaagccttgactaaactgcagcgggaacaccactccacaggcatcctcgacggcacggacgaagcctactcctcggggaaaccttcatctgacacaaacccgtcctctggggttgggaaaagtagagcaagactgagtactacccactgtactcagcaagtcataccggaataggagtatgatgcagggaattaacaaagaagagctagagtggttcatttgcataaatactggcatttaaaaacaggaattgaatgcgaaaacggttgtaataattaattagtattaaacatccactgtccaacgctaacccacgttgcgacaggcccaaccgtccacctaaactatccaaattcaaaagattaccctagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataaccccctctaaccaagcacatcacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgtgaaccggtccttaactgccatgggtgcgaccagcaaaaccatgcacccacagcccaccatgtgattcattttatttaaccaacaccagagcggtggtactaatccaacattaccattagaaccaacagtctaaacattaatatgattttccccattgtgaactagttgaactaagcatggctaagcaattactagtccaaactctaatcatgttataaccccaagctaacaaaggagcatggtatcaaaatagcatggctgtaacaataggtaaccatcccatagtaatattgcaaaacaaatgcggtatttgaaagaaaacattaggacatttgcaatataggatcaatatgatcaagtgacaagcatgacttgccttgctctgctgctggaggaacctcggcgactatctcgaagtacaccggagcgtcggagaaatcggaatctaacgacatacaaagcaaacattgcaaacaggctataagactactgaaacagggaacaaaaccatttttaatggattctacacatttttcttgatttactaagacttgaatgggattaaacggagctcggatgaattagttatgaattttagaagattcactgtgtttattactataacaaaaatccttaaataatttattgcgcaatattaaccagggctgacgtcagcacaggcggctcggcgccgacatgcggggcccaccggtcagcggcacggggaggagagaggaggcgtcggcccgcgggcccaccggtcagcggcacggggagggcggtctaccgtggaccgggaccacgcgggtgatccaccgccgatccacgggaccgacggcccggatcgccctcggccgatcggacggacggcggcggcggcagcccccgggctcggatcggcatcaaagccgatcggccgacccggggctagcggcggcggtgcgtgcgcgtcgcgtcgccggcgacggcatccggcggcggaggcgacgcaaaagcggcggcagcggacggcggcaacgacccaaagcgacggcgagcgcgggtggcggcgacgcacggggaaacggggaaggagaggagaggagatgcctcaccgagggtggccggcgcggaggaagacgatggcgaacggcgacggcaggccacgggagggcgacggcgaccggcggacgagcttcggcgtgccctaaggaaggagaagagagggattagagagagggagatagaccccggcgaccggcattcgaggccgaaagcggcggtaggggttaaacccaccggagcgcgaggaaacgggtgttccggcggcgaacctcgacggggaaggggcggccaaggtagatctcgaccccgcgaacccgacggcgacgacggcgcggtgcggcggcgatcctagcggcggctagcagcggccgaagtagcaaaacggcggcggcgggtggttgcacggcgcgggagcgatggggagctcgggagaggtcggcgcaatggggaaaaagtgagagggagtgccggcgatgcttaaatagggggagagggaaccggacgtggccggaagaggcgggaatcgccggccgacgtggggagtggggagggagagagaggcgggattctaaattnnaatnccggccatctcgggcgcgggcgccagcgggaaaaagaggggaatggacncggaaagcgcggggcacgcccggacgttgccgacgttgcccggaaaaagcggaggcgtgggcgtgacggccgttacgggcgcggcggcgcgagcgggagaggcgggaggtgggagacgggtccgacaggtgggccccacctgtcggcgaccccgggagggagggaggcgggcggctggctgggcctcggcctgcggccggcccagtaaggggagggggaggaaaggaaaagagaaatgggccgacggcccatttgacaaaaaggaggaaaaagagaggaaaaagaaaaagaaaaaggaaaaaagattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcctgatttcacctgcattttcttggggtcatttgtaaattacaattttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtaaccttgtttctggttctcctttcgctggtatcaagtatacgaaccggcttctccacgtatgttaggtcctcctggatatcaatgtgctccgaatcagcctgttcttcaggtacccttaagcacttctttagttgggacacgtggaacacgtcatggatgccgatcatgttggatggaagttctagctgataggcaacttctccccttcgttccaaaattttgtatggtcccacgaagcgtggtgccaacttgcctttcgtctgaaaacgatgtactccccggagcggagtgacacgaagatacacgtaatctcctgcctcaaaagtgagctcccttcgacggttatccgcatagctcttctgtcgagactgagcaatcctcaacctttccctgatgattctgactttctcttctgcttccgctaatacttctgttccgaacagttgacgttcgcctgtctgatcccagaagagaggtgtgcggcactttcggccgtataaagcttcaaacggtgccatctgtagactggcctggtagctgttgttgtacgagaattccgcatatggcaagcttttgtcccaagctccaccaaaatcaagagcgcaagctctcaacatatcctccaagatttgattgactcgctcggtctgaccatcagtttgcgggtgataggccgtgctgaagtttaaacgggtccccaattcttcctgcagtttctgccaaaactttgaggtgaactgactacctcggtcggatactatcttcctgggtaccccatgcaaacacatgatccttgcgaggtacaattctgccaatctctttcccgtataggtggtatgtactggtataaagtgagcaaccttggtgagtcgatccacgactacccagattgaatcgtgacccgatgatgtccggggcagtcctgttataaagtccattccaatctcctcccatttccattccgggatttgaagaggttggagtaaacctgctggtctttggtgctctgctttcactcgttggcaaacatcgcagagtgcgacgaattcagctatttctctcctcatgctgacccaccaaaatttttccttgaggtcttggtacattttggtgctgcctgggtgaatggagtactgggtctgatgagcctcggtgagtatcagatccttcagttctttgtcgtcaggtacacacaatctttctcctatccagatggtgccatgctcatcttcgtggaaatcccgagcctttccgactctcatgttctttttcagttctgctatttcagaatcatttacttgagctgctctgacttgatccacgagagtgggccgtgcctccagagcggctacgaacccgtgttcaacaattcccatgttgagatgttcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatatgcaaccactctaccctcttgcattaggacacatccaagtccgtgacgggatgcatcgcaatagacttggaagtctttcatctggtcgggcaggatcaaaaccggtgcggatactaatttcttcttgagctcctcaaagctcttatcgcactcagctgtccatttaaacttctcatctttcttaagcaactgagtcatgggtcgggcgattctggagaaattttcgatgaatcggcggtaataacctgccagtcctagaaaacttcgaatctgcgacacggtcttaggtggggtccatttggtaactgactccacgttcgatggatcaactgccacaccctgagctgtaatgacatggcccagaaatttgacttccgtcaaccagaagtcacacttgctgaacttggcgtatagctggtgctccttcaacttctcgagtactagacggagatgttgttcatgttcttcttcggactttgagtagataagtatgtcgtcgatgaacaccacaacaaacttgtccagaaactccatgaacactttgttcatcagattcatgaagaatgcgggtgcgttggtaagtccgaaggacataaccgtgcactcatatagcccgtaccgagtggtgaaggccgtcttcggaatatcctcttctcgaattctcaactggtgatagcctgatcgcaggtctatcttagaaaacactttagctcctttcagttgatcaaataaatcgtcgattcgcggtaaaggatatttattcttgattgtgacctcgttgagtgcgcgataatcaacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtacggtctcttatagattggagcagttcccggtgccaagtcaatccggaattcaatctctctcttgggtggcatggtagtgaggtcttcggggaacacttctggatactcgcagactatgggtatatcttccaatttcctcaagttcttctctacggtgtccactggaacttccatctcgacctggttcaaggagaccccttgctttggcggggctagtgttttgtacactactgtttctcccttctcgttggtcaaggtgactgtgcgattcgcacaatcgatgactcccttgaacttagtcagccaatccatcccaagaatgacatctaggtctttggattcaagaagaatgaggttggctagaaatggtgatctttggatttctattagcactgaggggctaaaactgactgaggttgaactatttcccggggtatgaaccctcattggtgtgctaagctcttctttccttaacccatacctccccacaaatttctttgaaatgaaagaatgcgttgcaccagaatcaaaaagtactgttgccgggattgagttaacagggaacgtacccagtacgacctccggtgctgtttgtgcctcctctgcagacgcgtggttgacacgagcctggataaaccttggcccggcacgcctgggcttcgggcatttgtcagcgaagtggccaagctcgccacagttgaag

SEQ ID NO: 67080 - DNA, 16665 bp, Oryza sativa
tatctataattagggacaaataaagaaaattaaaaatgtgattccatgcaagaaatacgattaacaaaattcagaatttaggattaacaattacaaaaaaataatatttttgttaggagtccatgtagaaatacaatttaaaaacatccaaaagttcagattgaatataataaaactaacataaagagtccacatagaaaaattggattgaagataaatattatagcgaaaagagttttgggaggattgcagtttagaaatattttaaaatcggattaaaaataaataatattgaggggaagaatccaggtagctagaaataaaatttacaaatatcttaaattcggtttgaaaataaatattagtgagaaaacattttatgtagaagttgatttagaactattttaaatgtgaattaaaataaataatattgatagaagagtccacttttacaattgaaggctagtcttctattagctttatattaatactatcagctaaaaatcagctaaagaatctcatgtaaattagctagaaaactagcttatgagattggatcttaaccctataccaatgtgacaggagttagtccaaactgtcagcaacattaacaaaataaaatataaaaatacccagtaacatagtaatattgataacaatagaacgtttttaatttaaggttatgaactattatgaatatacaatacaatatgccatcttcagtaggtggaagaatgtcattcgaggtagtggaaagatgcaactatagatacagatgtaggggaataagacaaataaatatgccataggatttatgtatctttgatttattgtatttttatgagaatactaaaaattccatcgtgtttgttttatggacatgggaattactatattaatcatttgtcattttaaatactttttcacaatagtttggtcaagttaggtcaaagctcaaaatcatttgtcattttaaatatttttttcacaatagaatgtgaagtatatgtattatagaatgtgaatattttatagagatgctagtttatttcatagaatctgcgcggaccactttgctagtttatttcaaagtaaacgttgagacatgctagaatgccacttggtattggtacatagtatataccttctttgtcaaaactcttgcgagtatgtaccatgtctcgtacaactcccttaattccaaagtaagttccgaaagatgtgcatggtgacacgcggtgaaaagcttttctaactattgcattgtatgtacaagcaaggacgaaatcgtcgtcaaccccaaatgaatcagggcttccataggtgcggcgcacaagttgctagctacttccttcgaccttcatcttaaaattaaaattatttatattttctaaaaaataaattaaagttatgacatagatgcttgtgaatgtttgatgtgggaaaatagatgaagaaattaaatgggcaaaattataattggttcagattgaggtcgacaaagaggtactcccttcgtcccaaaatataagtagttttagggttgaacacaagtattaagaaagtcggtagaattaaataggtgaaagttgttattggttgagaagcggagctaagtgagaaaattgaatggtgaagggctgtgattaattgagaagaaaatattggtgaagaaattattatattttgggacaaatcttaagggctagaagttgttatattttagaacggatggagtagctagtttcatttaaaaaatatcttaaaagtagttatattttaatacagagaggacttgctcgtccactgcttgagaaatttatggaggacgcacgcgttggtcgtagctatcactcatcagcagctgcagttgctgagcttgccgttgacgctaatactatatattggagcgagcgatggatcgatggagtatacaacagcagcattcaatggcgtggcagaaatatctccacgccatgagccacggcagcctcaaacgaagaaaaatagacccaaattacaacccgatcgacgtgcacgttttactgaatcgttgacgcgaagcttctatcccgtgttggatatacatcgatgctcatcgtcgtcgtcgtcgtcgtcgcagtcgctagccgtgtgtgtcggctgatgccgatgccaccgttgccgcgaccatttcgccacgcacgaattcatcttcaaagacaaaaaaaaataaacaaaaacaaaaacaaacaaacaaaaacaaaactgcaacggcgacgtgctttgtcccacggtcatgcacgctgccacggacgatgtcgcgtttactgaaacagaagacgcgcgcagcacacatcttttgcagtggaaattctacagaagaacgcagcagtgtgcgttacagtagaaaaaccttataaaagttgtggacattatctctccgctgtgtatgtgttcaatgtgcaccatggcgcgaccgttgctgtaggtgaatttttcagggatctttgcagttttgctagtgacaataagaagtgttttgtttggttcagtacaaggttgactcgaaaattcagctgaatttgtatggctcgtggtgcagacaacaagatattgcagatatcaccaccattcagttagagttgctgttacacagctgagctcgactcaactggacaaaactatggtccctgggcggtgagaaccaggcattactgatgaacaggaaggtgtcaggccgctggcactaaaatctggggtaccagaacatgcccttgatgccttgagggtcagcttcgaatcccaagttcttgtagaaatctacaactgcagttaataagaacgaattatcagaaagacgacctttttagtgcattgaagcaacattgataagctgcacattctggatatcatgaacagaacgaccatttccatttccctgctgcaagtcgcagcaataactcgccacagcaagaaaattatgttactccctccgtcccaaaatataacaacttttatctctcaagatttgtcccaaaatataacaacttctccaccaacattctcttcccaaccaatcacaatcctccaccattcacttttcccacctacctccactactcaaccaatcacaactctccatcattcacttctacctattttcttaataaccgtgtccacctctaaatatgcttatattctggacggaggtagtaatgaatattcaacattttggtttagaaaggtgctatcgagataaatggcacagttgagttaatgacttcaaggaaagtaagccaccagttcacccaccagtaaaatttgaggcagccaggcaggtgcacttaccaaaggcatatatccattcaatcactcagatttggataatgatgtaatggccttataggaataggttgaaacgaagacaacagccttttcaatagcataaaatttctacaaattcatcttttatggttttcaattacgttttcatccacaagagtaaatcatgtggtacctttggtagccagtctagttgttgcagtactcaaaggatcaaaatatttgcttgttttctactcactacaaagatgacttaacagcaaaccaaaggtaaattcgagctagcagtgctacttagacatggcttttgtgaaaaaagggaggtgtgtgtggtactgtggtggtggttgtggttttctacctttgttatctgcaaacagcgtaatattgctgatgtctctctggagcaaagttcggattactttctccattaacgctttaccaagaccttgaccctgaaaatgttaaaacaggtataaaccattataagtaaccttacatgccaaaacagtgaattcaagttcatcaattcacctgatatgaagggtcaacgagaacatcccaaatggtagcattaaaggcatggtctgaagttgctcgcgccataccaattagttgcttcctctcttctccctctgtcaaataacttctacaagtacactaagatgttcatcatctagaaaaatgaatttctgcaaataatcttcagattagaagatgtggtttgactaacgcttaggatcataaacgagccgctaataatgaaacaacgaggtaagcacctgcttttgaaggcatagtaactgaatgtagtgtagcaaccaggtaactgtttcttaaggatgctgctattttggttaggggtctgcgtggccatcccacctatgagatgaacatcataaacacaaacatctgttaaagaagaaactaccgaggaacaacatgaacttggagaaaattgtgatatatattcctttatgaaaacaggatgtgttactacaaggtgacaaatattttaataatatttcatttagctctatttggtattttcgagtgtactcagctataatagccagtttacactgcataagtggtcccagttaggccatacaatagttactaggtgtgttagtgaacgaataatggttacttatttagaaccttgactgcaagaactatcaaatgattttggagaaagatcaccttgtcgcataaagcttggagatcatacacattaacatctccagctgaagaaaatatgatctgctctgtgctgccatcagcaagtgtcctttctaggagtactagttcctcgggcaaaggttcttcctcttcaattggtgctgatggtggctctactgtctctgtactgttattactcttcaaaaatctgcaaagcaaaagcattagattctctttaccatacatgacagatctaaggagcatgatataagcatgttgcttcaaatgtacacagcacatagttagtctacatactcccttgttaattgaagaaaaagatatagaaattttatcaatctagtttctctacaagacctgaactgtaaggctgagttcttttcggctgttggctgtggaggcaagccattagcgcatgaataattgagtattaattattacagacttgaaaatgggttgatttgattttttttaggaacttctatataaaaagcttttgcaaaaaaaagcaccgtttagcagtttgggtcgggaagcgtgctaccggaaaatggggaagttgcaacttccaaacaaaaaaacgtaagggcctagtctgtaaacacccaggatgttccggtcctactacatctttatattttttagtttttcagttccccctttgtcgcaggtaatgtgagaaattagtagctttcacttctcatagaggtaggaatttctaacgagaccattttcatattaacacatactacatgctatagtatgtagatttatgtgaaaatataaacatagggtttaagcaagggacacaatgtattttacccggatctaagggagtcccacagaccagccttcaaggaccaagttgccgcagcccgttttttacctgcagcgtaaacacgataagagtgtacgtactagttcagcaaataacagctaaacttcatgaacatgtcatgaacaaaaaaaaaatcaaccaaagagaagttaggcagatgacaaaacaacaaagagaaggtccacaagtttattttgccgtggagcttggacaactgtgcagtctatgattatctagctggtagctagtagccggtaaaccatcaaacatggcgtatttctatatgcaaacctaagaaataatctgaaccaccattctcaccaagacccatacggataaatgccagagtaatttagcgagttgcagtagcacgaaatgcaggatctgcagaatggtgctgcttaccaaatgtttggaaagatgggacaaaggagccagagcaaagctttacttgtttactgacgctgtaattcctcgattaagcagtacatcagttcgttgcaagttatttgcagactctggaacactaattcctaatcccatccaacaagacactagattggcatctacctaccctggccggccattgttagcctaaacatttggatgtctgtaattcctattcgcaccaaacgactactatactgtgattatccgctgcaacgcggaagggagcaccgcaccgcaccgcaccgtaccttgcgcgtggtcgtggagaagccggcgcggcgcgggggctttaccccgggcccccaaaccgcacgacgccgtggggacgcatctgaaagaggacggtgtgacgacggcggaggcggaggcggaggcggcgggcgccatccttgccggatagtgcggcccggtgattcgtcgccgcgcgccgccggagtgggcgcagccgaggcggtcgccgccgggaggaggaggaggtggtggtggtggtggtggtggagctcgctgccgtcgtctcgtcgcagataaggtcggggaaggtgggtggtggactgatggagtggtcagtggtagccgattcctcctcgccgagaccgagaagaagccgaggcccaggcggtcggcccatcaccacaggagtttggcatgattgggccgctcggttatgggcctctaatttaatctaaactcttatttccctgtaaaaattgagaagataaacaaaacaagatgagctataaatgtattattaagttatgagtattaattatctcgaatttaaaggaaataattaatatgattttttaaaacaacttttttatagaactttttttaaaataacgtatcgcttaatagtttaggaagtgtgcatgcgcagcaggagtaagttttcctatctatccgttgctaccgaacgcggcctagttcaattgttgggactagctatatcgagctacattttttcgttaagaaaacagatactcatttttcaatacacttttacattgcaaatttcatactttatagtactataaacttcatatatttacagtgtaatttttaaatattacactgtagtttttttccttactactcactatatacaaaggaaaaggatagttagcaatcacatggtggaaaaaggttattgaaatcaactaatcaagccaaaaatgtggtgccaagttttttagcaaaaccatagttttttaggaagaagaagagagagggtgagagggagattagagcaaagctttatgcctttatctacaggctacatacactgacatatctacttagcaatccctgtagctatggtgccatgccagaatccagattgcaaataggatccggatcaacagagagatacagaaaggaaaagcatccaacctctcaacagcaaaatctggggattatattgctgtctgctgatggctctttgcatccacttatgcaccacaggattcacaaagagcttcagacgactgcatcttgtgcagacaagaggcagaagaaaaaagatcagagacagtcaagtgcactataaacaaaggacaaacagctagcctggatctgtaactgcacagcacagaaagaactaagatctaagctgcccaatgaactgcagccttgcagcgcaaacaacagaacagtgcttgcgccggaatcatctcatggcaaccaggagcgccgcagccatgccacccagggacatggcccaaacgatcaaccgcagcagctactgtcctcctgagcgggtaaagtacagtttcatcatcagcttgcacttgcaggacctagttaagaaaccaagcagcaacaatcaatcggccaagtgaactaggacaatagtaggaaggcaactcaaatttattctgtaatgtttctgaagaattggagaccgggaatgaatccgagatacctgaacaccggcaaggacattttcagagactagctcagacggcgcaaccgctgcccagccgtcgacgtaaaccacctctatcagtaccagccatacaccaatatcctcaacatctggatggtgtagctccatgtgataagtgcagcagtctgaagagaatgacgacgtgcataggacgcagaaattatcatggagtagagcctgggtactgtaatctcctgttgcaagtgcctcgaccatgtccctcccttggtcctcttcttggacttggttaagctggaaatttcggatcaccattgttaatgaattcagtttggcatgagcagttaacaacgaagcacagaggtttccactattaatttgtgcacgagcaaatacccaaatactaatatacaagataaattaacagcattagtaagtagcaacaaatttacatagcatatgtagcaggatatattctattttcagttatctgaaacgaaaatggagcctcttttattgctagatgaccaaaatacaaacttctttttttatcctggttttgcacatgcttttgtccaagaaacctgtgcacgatcaaggcaacaagaacacatccacaaatcaagatggccaagaaaccctacaccagaggaaattgtaggcacgcgtggttccaagcacaactcgaagtatggacaagaacttaccttgcacattgtacagcagtagagcgcgtttgttggcttcttgattcgttggtggcagtccacgcagctcgagaaatccttcttccgcccgtacattggtggcacccatggtctcaacaggatccagttcgtctgttcgtcgcctctcaatctttgtataccttcccaatcgtactcggtgcccactgggtacctggcgagcacagcggggttttcagcgagcaactcaacctgcgagcgagaataagatgagacacaagaggctcgatcgaagaagaagaagaagaagaagaagaagacgaagaagaagaagaagaagaagaagaagaagaagaagaagaagaagtcttctttcgaaccgaccgtagcgacacggggaaggccctcttccgggtggtgatgatcccaatgttctttgcagcagtggtcgcagaaggagagccagcagtagaagcagaacctgtttcgcctgcatgtcattctccaatcctcctggaccaacctctggaggtagaggggctgctccattggaggctgccttggagcctgcagcttatcccctcccgcttgctagctcctctgcttcttggcgtccgctacccctgttcttgcgttcttgcggctgctcgctgctccgctaccgatcgattcttccccctttctcttcttctcctgcttgcgatcgattcttcttcgccctgctctctgatcgcgaaggcttcttgcgatcgcttatctacacctgttgattgattctctcggatgttcttgatgccgtcgcaatgttgctctgctctctgatgtctctttctttcttgggtcttcttgttcgtggagttcttgatggagaagagccataggcatagcgagcgggaaggcgagtgtttaaataggagcggaggcgagcggatgctgattcgattaatgggcctcttcttggagcttttacccggcccattaatatatttctcttttttgtctatttcttcttccacttcttcccgtttcgattttgtttgaggctgcgcgcgcgcgagaggggagagaggctgacgagagggagaggaggtggagagcgagtcgatctgggcggggggaagaggaatcgctcgggggatgcctccgctggaggtggaatcgcttcaaggcctcgcagttttgtcgtttggttctgtacttctgtttcctccctgtgtttgtggctcttttgcgcgattgaatgtttgaattttggtgtgattgggatagttaatcgaggaaaaatagagattcgtcttgtgaattgtgatgtgcggagcccgcccaccggaggtagatggtgatgaacccccaatttcatttctattgtcagtttcttatatgtttttggttaagtttcagctatcaggtgtgggcttttgctgtcgtgggttaatttttctgttttgctctgaatggcagattcatgtgggagcggtttcagcaattgtcccctttctgcttatcccgataatatatgccagttttgatgtaatgaaatggtagtctccttgcttgattaaggtgtaaatcctgctcatttcctctccagagagtaggttaggcaaaattcagacacttttttatagggtcttttttttttgagaactggagtaagcacagaatacagagccgtagtgtagggacaaacatctttcaggcttcagccacagaaacacagaatagcagaaccaaaccactcgtctgaccgtttcgtatagctacttgttgcattctaatcgggactgatgattaacacatgattatgttgatgttgtctagatatagatgttctcattgcgagctttgcttggaaagaaacacacgatttttttcgtagcggggaatcaacagtccatcaaactaatcaatcgaataaccgttcaaatgagttgttggagcatgggaggcaggaaagaatattgtgagattattctcttagttgttcaggattgttgacgaacaacagtgttgccagcactctgtacagttttcagttattccttttctttcagccttgatctgcctgtgttaaaatcatctcctaccaatgtaatgccagccagcttggttggccttccgaaaaagaagtgttcaagtcttttgttaaggacccctccccccctctctcatttttgttattattctattttattgaaatcttgtgaattttggaatgttgtgtattgtttgcaactcagtgcctttttttttcctgaattcagtggcttttaattcagtgtagtttggttttgcggatgatcatgttttacctcatctgttaagacttctgccaggttttacttgagctttgtttcaggctctaccagtgctgttctatcggagatgatgcaaaaggaatcattgtcaacttatactggagcagcattgtgtctttgttgatgctgtgaatgatgctacttctgcgtatcccaggcctttgtgttggattttctggcagagattgattgaagagaaccattggggatatctatgaatgaggaaagggcctcacgggctgtagttttctctttttcttgtaaaagtttttaacttcttatttctgtcaattatgctatggtttgtaatgcagaggcatcatgtatgtgtcagtcaagtatagctaatagtgtggatctcttggtgcaattgtaatcaatgtttagtgatgaactcgtatggtttggtattaacctgagcccagtatgatgtttagcgttttacacaaacaaagagatactccaaaagggagtatttgctttcactgaaatgaaattttggccttactagttgcatgcacggcctatgcgcttaactgacaaaagggaatagtactccaaatataacagtgaaaagcatccaacatctcaacagcaaaatctagggatctctgatggttctttgcatctatttatgcaccacagaattcacaggagcttcagatgaatgactgcatcttgtgcagacaagaggcagcagggaaaaagatcagacacactgagacagtcaagtgcactatcccacatttgctacagtaacaaagggccaacagctaagcctgatctgtaactgccaagcacggagagaactaagatctaagctgcccaatgaactgcagccttgcaacgcaaacaacagaactgtgcttgcaccagaatcatctcatggcaaccgggtgcgccgcagttatgctgccaagggacgtcgcccacatgctgaactgcaggaggagcttctaacctcatgacagggtaaaccagagctccaccaccagcatgcacgacctaagttcagaaaccaagcagcaaccactcaagttaggacacatgaggcagctcaattctgtaatggattaaatcaagctcaattctgtagtgtctctgaagaaatggagactgagatatatatacctgaacaccatgaaggacatcctcggggactagcacagacggcgcaaccgctgcccaagcatctacgtgaacaacctcaatgatctggtcgccatgagcgttagccttttctggatggtgtcgctcaatgtgctcagcgcagcaagctgaacagaaggacgacatgcatatggtgcagaaacgatcagggcgatgaatctggaagtaatttcctgctgcaagtgcctgaatcatgtccctccctttgccctggtggacatggttatgctgtccaatggaaattttggattacaattagtgaggtcactttcatatgagcagttaacaacgaagcaaagaggtttcctctatctgtccatcgatcgaagaagatatgaaatgaacagcattttcttgcacagataaaatgaacatcattaattttcttttttgaaggtcaacatgatctttttgagagcacattagtaccacactaccacattgactaagcatctcaagatatattttattttcagtcatctgaaaacgataatggattctcttcttttactagatggctaaactaggaacctattccattggagtaaccaagatttctatattggttttgcacaagcttccgtccaagaagtagaacttgcgcacgatcaagaaagacaagaacgcatgatgcgcatccacaaatcaagatggccaagactctaaacaagaattagttgtagccacgcacggtcccaagcacaaattttgaagtatgaacaaggacttaccttgcacattaaacagcagtacctcgccgaagactccccgattttctgattgcagttaacgcaggttcgaccacgcccttgtaatggtgtcatcctggggttcaacaggatccaatcccgattccagtctttcactctctgtatatagttccaattgtacccccagcgacccacggggtacttggcgaacgccgcggggtctccacttccgagcaacccaatctgcaacaagaagaaaaggaggcatggggggcaacacgcacgagaggctcagctcagctctcaactcgatcggagcgcaagaagtcaagaacaaagaagaaggaagaaatctttcgaaccgaccgtagcgactcggccgcgacctcctgccggatggtgacgatcccaatgctcggggcagcaatggtggcagaagggggaccggcagtggaagcagaatctgcctcgacggcacatcctcgtccagttcgcctggaccaacctgtggaggtagaggggttgctccatcgtcggagccccgcagcttgctatctcctctgcttcttggcgtccgctacccctgttcttgcgttcttgatttgcttgctgctccgataccgatcgattcccccccccccctctctctctcttcttctccctgctctcttggttgctgaggtttcttgcgatcgcttctctacacccgctgattgattctctcggatgttcttgattccctcgcgatgttgctctcctctctgatgtctctttctttcttgggtctttgttgttcgtggagttcttggatgggggagagccatcgcgagcgggaaggcgagggtttaaataggagaagaggcgagcggatgctgattcgattaatgggccttttcttggagcttttacccggcccattaatatgttcttttttttgttttggtctatttcttgatttcttcttccacttcttcccgtttcgatttccaatcaaagtttgaggcggcgagagagagagagagagagagagagagattgacgagagggagatgaggcggagagcgagtcgatctgggcagggggaagatgaatcgctcgggagatgcctccgctggaggcggaatcgcttcaaggtctcgcagttttgtcgtttgattctgtttccccctgtgtttgtggctcttttgcgcgattgaatgtttgatttttggtgtatgattggggatggttggtagaggctattcggcgactcggcctgtgatgtgcggaggccgctggaggtggatggtgatgagcaccgatttcatttctagggttttgggggggcggatgggaggagctggatttcatttctagggtttgggtcacggcttcacatcgtcagtttctttaatattttttggttggagtagctttcagctatcaacagtgggatttatctgttatcacttcaattttgctctggacagcagattcgtgggggaaagcggtttcagcagctggtccctttctgatggaacgaaatgcaagtttctcttctgatttgggtgtaaacaactcctctccaagatatcagaggaagcgaaattcagacacattcatcaacaccaaactgaaactatggtctaccaactatctacaaggtaccaacttaacttagggcacagcctcccgaaacaaacaacactgaattgctctttgttcagaactttggtaagcatagaatgcagagccgtagtggcactcgcatcttccaagcttcagccttcggccacagaatagcagaattaaatcgttcatctggctgtttcgtgtagttacttgttgcactctgagtaactacactctgatctgaggattcgattattagcatgattgtttgttgttgttattgttgttgtcgtcgtccagttatagaagttctcatagtatcatgtatcaattccaacttggtcaaaaatgaaattgctcaagactcttgttaaggagtccctctcatttttttactagtctatttgttgaaatcttctgaattttggaatgtagtatcatgtttgcagatcagagcctttttttttccttggtcagtggcttttaattcggtgtagtttgcttttgcaattgatcatgtttgacatctacctggtccattacagattttatttgagcttgtttctgtctctaccagcactattttatcggaggtgattattagcactatttgattttggttttgcaaaaggaatcaattatcaacttatactggagcagcattgtgcctttgttgatgctgtgatcctttgtgttggattttctggcagagattgattgaagagaagccagagggggataactatgaacgaggaaagggcctcatggtgagctttgcttgaatccatccacccctgttgcgttgcgtcgcctaggagcccttttttctggtgggctgtagttttctccttttcttgtaaaagtttcttaacttcttatttctgtcaattatgctaagatttgcaatgcagaggcatcaaaactgtatgtgtctgtcaaatataactaacagtgtcgatctcttggtgcaattgcaatcaatgttttgtgatgaactcaaagggttctcaacttctcatggtgttttacacaaagagatatatatagtgttttacacaacgagacatttgctttcactgaaatgaacttttggccttactagttgcatacacggcctgtgcactttaactgacagaagggaatagtactccaaaatacaacaaaaatatacatattgtgaaccacgtctttgttttattcctggatatcaagaacccgaaaaaattgcttattgtgacactttctggctgaagagcttcttcctgatctgcaggagagaagaaaatgaaacactcgtatcaaatccactgaattaccatgcattgatggatgaggtaagacatatatacctcaggaagcttttgcttgaaagagatttccaccctcgcatccagcgtgttgtcgcagacgatcttgccgtcctgcgatgcaatcaccacacctccagagctgcaaaattagggacacaaatcagcttccgatgaagtaagcgttagcacgagcatattactggtgtatcaggtactaggaagcaacaagattgtgtgtaccagaaggggccatgggcgtcacgggcggtcttgggcggcgggaggtagaccttgccgtcgatgaggatcttggggaggttcaccttagccttctcggcgtactccttcttcgccgcctccagcaccgactcgacgtgcccgcgatccgcctcccggcaccgcagcaccaccgacggctccctcagccggagcaggctctgaatttgatcaatgatctctgaatcttttctctgaaccaaaatgtgcatggatagctagatactccctccgtttcacaatgtaggactttctagcattgtccacattcatatatatgctaataaatctagacattattatatatatagattcattagcatctatataaatgtggataatgctagaaagtcctatgtagagggtgtgaggggatttggtggtgatcacctgcacgatgaggcccttgaggaccttcctgtaggcggtggcgtccttggtgacgcggaggaggctcttgccggcatcctccttcatctcgcccaccacgccgtcctgcgcccgcagcaccttgatccgcgccgcgttcagctgcgtcgagtactcgctgcaaccatgcgaaagatcaaatccaaacacagagttaataatcaggaacgacactgattcgatcaccacagttgaacattttttcgcaaatatgcagttgctatcgatcgagatcttttctgtgtgatgctcacatcttccttccaacgtccacctgcttcgccttgcgctcgtagtcctgcctgatcctccgcttctccgactccaccagctgcagcttctctatgttgaactcctgcatcacccccatcaagatcgttttcagttgacaccctttctgaagaacagaagacgaaggagatcaaattatttattttacc

SEQ ID NO: 67081 - DNA, 8571 bp, Oryza sativa
ctagagctctgaaaattccactaaaaatcctgttaatgaatttcgacatgtagaactcaagaaaaattccacatgtcaaatccgattattatttgcattactttcttagggttttctcctgatttcacctgcattttcttggggtcatttgtaaattacaattttggcttgggaggaaaacttcggggtgtgacactgggtaacttgagtctggatctgtttctaccctcttttaaacctcaaacctataaccgtttcaatcttcagtttcagaatctgaaatctctcccccaacatcgacactagcggcataattccaaaatcccagaaagaaatttagtgaatcgtgccctaccaccgccacatcgcgcttcccatttcaagcaagcgcgtaggtgagtctcccaaaccttccatgatgcgcatcctccgcgaacccaggtgccccatggcgaggacatcttcccgacgagtttgaggttgagttcagataatgatgcagatacgacaggcgaggagggttaagatttgggaatcgacggatagtgtggtcacaccctctggacatcttccaccgcggtggtaaaggaagatcatcctccatgcgttctttgctttttgttccggtagaaagtgggtttaaaaattttaacccaatatatcgccttatgtacttcaaggctggtttcatggatctccactacaataagtgtcgtgcgaattttatgtgtaagaataaggacacgaggtattagtgccacaagtgcaaatgttggtttgaaggcaaaaacttcgcactaatcaatcagatgtttcagttatcaaatacggtttttatgtaaggagattggtttgtatgtaaggagattggatgatggtatatcgataagatatttcattttgacttcgatgggatattccattttgacatattttagttggtggtcatcaaattttaggtgcagctttttcatttgatattaaatctagtagttggaagttcctatatcagttgatcagaattaatatttactacaaacctaatgtatatgtgttttttctaagtttcctaaatattaatattatgtttatgactatcaaacactaaatattattgttaaggtagcacaaatttctatgagaagtttatttaatagatgtttctttaatcttatatttttttagatataaaaaaattgtaatgataattgctgaagttgatgatcatgttgctagtagtgcataagggtttagtcgtgaatatgtgtagggctacaaaagaaaatacgataggctaatagtagaatatgctgttcaaaatgcaattgaccaacttaaatactgctcctttcatattataagtttttaatttttttaaagaagtttgacaaagtttatagaaaaatataccaatatttataggatcaaattagtttcattacatctaacattgaacatatttgattagtttctttattttgtgttaaaaatattgctataatttttataagatgttgataaacaaacgcatctgccgaagggcaagcttcactcaatatgtgcgatataaagtgataaaatgtattgatttttataaaaatttgatcacctattacatgctcctgacgtctatttataggtttacagccctgggtttgtaaccctagggttttggtgtacaagtgagtttacacaaacgcccttatgacatgaacatttataggggtaataacaaacctttggctcagctacccggtctatgggcttgtcccttcatgggttgtttgcgggccttcttgattaacagggcgttggctgtcgtattggcttcgctgcttggtcagagcgatcctttggcaatttctccgctactcagtgatcagctttgccgcttactgggacttcgcctcttggttgtcttgcacctcgtttcgcggcttggcatttatgtgtttcggctggctcggtcgaaggccctcatgacatgcctctaacataaacttaatcaaatgtaaaaaagtttgacttagaaaaagttaaagcgatttataatatgaaacgtaggtagtaatcagaatttgacctgaaaatccctatctctactattataaaaattgaagatgtttctgccgaaattttggtatgtcatccatttttgagttagttgtacatcacccgtatccaattcgacatgagtcaacgtgagtccataataactattatatatccccttccggctagggctgtcaacaagccaagctcgagcgagctcgtctgccgaagctcgagctcgacacaagctcgagccgagatcgagccgagcctattgcacctttgagcttttaggcaagctcggttcgagctcgttcgagctcgagctcggcaataagtagtataatatatattttaatgacaatctcttgataagtataattattttctagttaatcacactaataaaagagtagaaaatgattaaaataaatatattgtgctaacacatgctaatttattgtgtgaatagatactaatatatatatatatatatatatatatatatatatatatatatatatatatatatatatatatatatatatatatctattagtttattatattaataaggtgaacatgcatataaactatacacagtcaagctcggtagaagcttgagctcggctcggtaaagctcgcgagcttttgcttaggctcgggttcggctggtttggagctcgagcctaggacgagccaagctcaagctgctcgcgagcctcgaacttttttgacagccctactgccagcccaactcctccctctcctagcccaacccagctggcccacaccatcccacaccccatcccgcaaccctcccctgatctgattatctctctctctctctctctgatttttctccttttcttttctccaataattctaatcctccccctctccctctccttacaatcttctcttttctcctactattctctttttcatttttttttctcttccagatttctctctacataaatatttttattttaaaattatcattatttaaggtgtgtatgtgacaagttgttactttgttcatctatataaaaaaaaacattcactaattgaataatcaaaattttagtttcaatctttggtcaataaggtataagcaaaatatcaatgcgtcaaattatggaatagccacccggttgatttgtgaggctacggagaaatatacataaaagatttttcgtgtgatgatgcatgaaacgagcgcaatcaggttcaatgctatatatgatttttgactttgttttgcattgttttgtttgtcttatttcactgtcatttaaattggctgagtttttattaatcgtaaaaattatctttcccctattgcaacacacatgtatttttgctagtctctaccttaataaaaattgaagatgtttttgccgatattttggtatgtcatacgtgtttgagttagtttttaagtttgtttgcttttggaaatacaaatctgtatttgagttggattattttaagcttgtttgtttttggaaatataaaaggagtcgtataagaaatctctttaaagaaaactcatgctaacttgagatgaaatatggacttctaattgtagctcatgattttctaaaaaaatatttaagcgaatttccacggtgaattttatcctctaaaccatataacaataataatattaaaatagcatttacccgttataatgcacggatattttttctagttaaacataaattcaaaagaccgaattggcctagtgatgcgctgcaaccatcgttccacaagtgaaagaagaaaccacttgatgcttcctaagattatccgccgccaccgtcgtcgtcggggagcccttccatctgacctctcttcatctcccatctgccaatgtcttgccggcaatattctttctcatctagacggcagtcgtcgacgaggtaggcgcatctgggcttcaacgctgccaggaattgctcggcccggaagcacgccgagaattcgtggccgaggaagaccaactcgccgccgacgcctccacgagcttcttctcgtcgccgagcaccgtcgaccctgaagatcggcagatgtttggtgcagaaaggcgggtccccgttatcgccgtcgccggcgaacctccagacgatgttgttgtgttgccctttggaaatccacttaaaaaaataaacaggagagatacaaacaattttacatactcttttattatcctagtagcaaaatgtttatgtgttgcaacaggagaaaaagagtgaacatgttatagtaaaaatcatgaaacatcgtgtcttatatttacttttgtcaacataacgggcctgttcactttactgccaaaaaaaaccttatcaaagtttggcaactatgccaaaattttggcaactagtggtagcttgccaaattttggcaggaattcttatatagttactaaaatttggcaacaaactaaatgtagcaacttttttgtcaactttatcaaaatttggtaaggttgaaaatggcaccaaagtgaacaggcccaacatgtccagcaaatcgtacttgatttattttactttcatcggttaatcctccttgagtagctattctcatgagcaccagaaacagaacgtaatcagaattgagaaacgcccaggagtcttccggctagctcacaaggtggtgggctagacaacctgggttcgaatcctcaccccttctaattatttgatattaggtcattcccttatatttgcttctttttttaaacataacgtaattaaatataaaattgtacttatattgaaacggagaaacgtagtattattgcgcaataagctggcactgttatggcctccaacagtacgtagcatcgtggcatcttacagcacggtatcatctggagacattgaatttgaacgtcgatcagggcaagagagacgtgccgagtccgactcggaaaatgtgcgccgtgttcaggcccgtccgaacctaatccagcacgtacgggtctaacacagcacaaaacatctttttaatcattccagtgtctctcaggaaaattatcgcgttcatagaagcgttttaatttgctctgtcgaccgacgatcgccggcggcggcgccgtcagatcagccatggagccgaccggcgccggcgccggcgtgatccagtgctgggagacgcttcccgaggatctcctcgtcaccgtcttttgccagctggagatacccgacctcctccgctccggcgccgtgtgcgcgtcctggcacgccgcgtaccgcaccttccgccgcctccgcctcccgtcgccgaagcagccgccgtgcctactctactcctgcgacgcctacggccccgacgccgccggactctactgcccatccaccggcgccacataccgcatccccgtgtcgtgcggcggcggcggcggtggcttccgtaacctgacgctgatcggctcggcggacgggtgggtcgtcgccgccgacgagatcggcaacctacgcctcctgaacccgctcaccggcgcccacgccgagctcccgccgctgtccacgatgcaccacgtcgaggccgccgccgacgaggaggacgaaggcggcggcctcgcgtacgacatcgttgatcgcctgtacaaccggcccagcctggtgcgcgtcccggcgcgcgaggtgcgggattgcatgtacttcagggcggtgctctcctgcggccctcacgccgccgccggcggcggcgacgcggcggcgtgcgtcgtgctgctcctgcacatgcccaggtgcgagctctcctacgctaggcccggcgacgagcggtggacgtggatctcgcctggcgccggcaccggcctccggtggcgtaacctgtactgcgacgccgcctactgcaaggacgatggcctcttctacgtcgtgcgggatgacgactccgtccacgccctggacctcaccgggccatcgccggtggcgaggaaggtgttcgacgagcggacatggagcacgagcttaccatccaggtacctcgaagatgtccacctgccatgcgcccaaccttgcagatacctcgtcaacacgccgtcgggcgagctcttgcacgtctggaggttcaggcaatgggtcagttcctacgattcgtcatctgatgatcaagacgactcctccaacgattcgtcatccgaggatcaagacgacgactcctacgattcgtcatctgaggatcaagacgactcgtcctcgagagacctgtatgaagatctcatcaccagggacatacagctctacaggactgacttccatggaaagaagctcgatgcgatggacagtctagacaatcatgctctgttcctcggttacaatacctccttgtgccttccaacggaggatttccctggattgaagcccaatcatgcttacatcacggatgattcgctcgagtttgtcaactattttaaacgaaataaaaaagaaattggcatgtggaacatcgaaagccagatcttggagggatttggtggggcgtcatctcttgaagaaccttggttaaattggcctgcgcctatttggataataccctcccttttgtagacgaaattatattgtaacaacactgaggcgatagtgttgcgttgccctttggaaatccacttaaaaaaataaacaggagagatacaaacaattttacatactcttttatattatactagtagcaatatgtttgtgtgttgcaacaggagaaaaaagagtgaacatgttatagtaaaaatcataaaacatcgtgccttatatttacttttgtcaacataacatgtccagcaaatcgtaattaatttgttttactttaatcggttaatcctctttgagtagctattctcatgagcagcagaaacagaaagtaatcagaaacagaacgtaattaaatataaaattgcacttaagctggcacggttatgacctccaacatatttatctatcttgtcttgtcagctgcaggattaaactgactagcacacccacattttattaagatttggacctgcattggagctaagcatatctcctaagccattatgttcatcgacttagttcgcaccaacaaagttctggcaccatcagtcgagcgcggatttttcatcaacacaaatttggcacgaacagtggggcacggattttatacctatatgtttgaagaagtcgacgccaatatcctggtcgcaatggagaatttgacggaggaacagaggcaacagattgatcaatcagtgactaattttcaaaagtgttatgttcaatgtttcttcatgacgtaacaaggactgattcagaagacacaatttcccaagtcgatgattgaaacacttcaaaatacagttgatgaagcagttcgtcgtgctttgcttgatcaatctggagttttggtggatacattgtgaaatttgatcaaaggaacagttgatgagttagttgctcaaagacgccagctcggggggcagattgaagaacaacaacaatatcggcttgggggacaagcacatcagtatcagtaagatgaatcatatcaacaatatcagctagaagaaactcaaaaacatcattatggagaagattgggcatttgggccgatagaattgcaaagatgatagatgagcagtttggaatcaaactcaaggaccaaacttctgtgtatcggctgccatatcctgagtggtttgatagggttccattgccacaccgatacaaggttccagacttctccaagtttccagggcaagatgatatatctataatggaacacttcagccgattgttagtgcaatgtggggaaacatctgctaatgaagctctgagagttagatttttttcactgtctttgactggatcgtctttcacatggttttcatcactaccgtcgaattctatcagaggatgtgctgatcttgtgaagcaatttcatgtctacttctttgttggaatcgatgagttgaaacttttacaatcatagatcttgctgagctttacggagcttcaatacaattttcatatggagtttgtcatgatctgtggtgctctcatttttttaggtagacctctttgaaagatctggtcgccaaaagtcaaattttacaggtttttcctcatgaaaaattcctgtaaaaaaatcaccccatttcaaagggtagttttcctaataaatcgtctgcgagaatagacaaattttcataggcagatttgcccaaccgtaaaaataggttttcaaatacggtctttaacccttcacagcctcccaaccatttatacaagctctgtttcttttgggccgcctgtgaaaataaatgcacagcgtccaaaaatgattttgttttttttcttttttacaagtagtgcatttcttcacctcatgatacttatcaaagcatcatccatgtatacttatcaaagcatacttatcaatgtatgatagatgtatctcaaatggacacgtgctttgtactcgtttttttcatccttccaaaaatgggagagatattgcacaaca

SEQ ID NO: 67082 - DNA, 5858 bp, Oryza sativa
  unsure (1)..(5858): unsure at all n locations
tattagaacttagaagtttatattacatcacgttacatctagtagtactatctccgttccaaaacggaggtagtataaagagttttaggcttaaatacgggtgtgaagaaaataggtagaattaaatggaagaaaattatgattgattgagaaaaaaaagttagtggagaatttgaatggtgaaagattgtgattggttgaaaagagaagatatgtgaagaagttgtaatattctgagataaattttaaatgttaaaagttactatattttgatacggaaggtgtaataatcatcatcgcagcaaaatcatccactgagcagtgaccacccacctgattactctaacccaaccaaacatctctgtaccttcttttccagagataaaagaaaacatttgttcttttcttttcagttttcactgcacaagaccataaaccgactgacacgtgggccccaccacaccctggtcccactactcccacacctcgcccgcgccgacttctcgcctctctgacttaccgcatactttactccaccaccaccacccctccccctttgccaccgcgcccacccttcaaagccacccccaaccctcaccgacaggtggggcccaactcctcgtgggtcccgcccgccattgtcaccgtagcgggtcccacgcgcggggggcgatcacgattcgcgaaagcctttacggcgagaaacaaaaacaaaagctttcacaaggcagcgtgaggaggaggaggaggggagctcagctcacgcagaggcgacgacgacgcgcacgcgcaccgccctcctccctccccgcgatctcgccgtaggggatctcgtcggcggcgaggaagcaaaggccgagggggcagcggctggggaggggaggggaggggagagcggcattggttggagcttggaggaagttgggtgtgtgtgtctgggggtgagggtgagggatcggatcgaagcttctggaaggttccgggcgcggatccggctcggtgggttgctcgctcgtggctggaggtagcggcgcgctggtggtatcggcttttggtctaatgctttgcttcggtttggagtttggaggtgggggttttattgatgcttttggttgggtggatttgttgctgcagtttgagcggggggagcaactctgaggtttggttttcctgagatggaggacctgctgggcgcggaggtcggcaagaacgactatgactggtgatcatcgatttcgttttcttcagtttctttcttttttttttgtttgtttcaccttcgctgattttgattaatctccttttgttgtcggtgtggtgatcttcgtagtgtatttggtacagcacaagtttatgtgaagttgtagctgtatttttttttaaatctgctgggttgacttgaattgacgtgttttgggctggatttgtactgaacgcttgttttgggtggtttgagtaggcttgatcttggagtgacatgtttttgtttgtttcgtaaaagaggatatgctgcattgcccccagaaacgtcactcttccggttgtagttgtgatggttgtgatcgtttctcgttaaggatggccttggtgattgcagttggttggaattgaatcgctgtgctgagcaaacgtgaaatatatgaaatatgcaattggatggataggcagttaggcaacctgtggggacgggctcctcttcccttggaaggccaatttgatgttaaactaggggagatatgctgatactaatttggggatattagcaggagcatgccacgaaaagaaagatttatttttgggccaaatgtgccattaatatgttgttcccacaatatataattgtaatcgcttatgactttttgctgtgaaaacataatcaatctgttttggttgttttctatagtattttaaaagcttgtagtaactatatggtttcttgcttgattggttgtctgttcctctagtccatacatgtttagcatttgtttctactataatgaaacataaattgtgatgctcttctcaggcttcttactccccctgggacaccccgttgtcctgtactggaggttgctgagaaaacaccatccccaaatatattacctaagcgcactgccactagatcatcgtcaaccaccagagcgtcgagggtatgtactatgtattatttgtattagaatggacgtgctaaattttggagatttgcttttgcaatctagtttaaggctctttttctgcagatatacttctaatttcgtagtttcagtgacaacctgtacccaattttctaaagaaataaggaacaattttatccatgttgcattgtaacaacactcagtttagggatcaatacctccagatatatatctctgatgaatagttgctgtctgggctatgcatcctttttctttggctgcatgatctttggtagtatgaaacattttgagctcctacaacctgttttcctgttaagttttcattaatgacacatagtcttaagtcttaaccagtgtagaaaaatgggatgcagctgatattcaaataagtgttttgatctgaaaagctttcaatgttattgtcattttatttcttcgagggaaaaatttactcattgttagcaattgaaggtttcacattagatttcaataatgaacaatgcattgaagtatttcccaatatatgccacaactagatacaaaaacaactttatttaatgaattgcatattggaattgaagaccacccaaaccagggagtctggtgataacacgtttcttgcttctctacctactcgaactacctaggcagtagttgcataattactctcggggcttttttttctcctccttgattaatcttggttataattagcatttttatgtcaaactacgttgttttgcagctttcagtatctcaaacagagaatggtcattctacagctcccactagaccagctagaagtaactctgtcactcgcccttctattcagtccactctcatgtctagctccaacaggacagcagttctcaatacaagcatttcctccgtcagctcaagacctacaaccccaagtaggcgaagcagcactgttgttgcaccaaagcaatcaattgcagcttcacgccctgttccagcaaggtcctccactcctgttaaaactcgtccatctacaccaaccaaaactcgcccatctactcctgtgagaactcgtcaaacagccaattctacaagcgactcagctgctgccaggaccacatccgctcaaaattcaaggccatcaacgccaacctctagatcacgtgctatgcccaattcatcttctggtgcaattcctgcaatgagccgcccaggtgcatctacaatttctgcaacaagtcgctcaaatgcatctacaatatctgcaacaagccgtcctggctcatcctcaagtaatgtacctgggataagccgtgccacctcattgtcttcaagtacagttccttcaatgagccgctccagctcacgttcatccacacctacacgccagcctgcaatgcgctcatcggcccctgctgttggtcgctcgccttctgttgggcggagttctagcatcagtagcttgacatcatctatcaatcgacctgcagcaaatggtggccggaactcagcaccttcatcggctccgtcatctcgtccaagttcccctggtccacgacctcgagctccagttcgtccacttgatatccctgattttccaanatgaaacaccaccaaatcttaggacaaaactgcctgaacggccactatctgctggtagatcacggccaggcatggctttaggagtaagatcaacctcaaatactgaaccatcagctgcctcagctcctgtaaagaaggtgtctgtgcctgctatgagtcgaagtaaattttctgatgcaccatccaggacacctactctcacaaatggacgccaaaacagacagagtgagaggtctactgtggatagtcaacctagtaaagtctccaggcctgccacagggacagataatggatttgggatgacgatgtcaaagaagtcacttgacatggcaatcaggcacatggtacgtttcttcctgtgtttccatcagattagtaaaaccctgctttgaaccagttaggattctgtttgcatttagccagaatttgtcatgtacatttgattcgacattgcatgaaccatgactgtgttgcagtgccttttcttgccatacgcaaatcacaagttcaaagaagctaacattactccttgaacttgtgacaggacattcggcagaacttgggtggaatccgtggcgcatccctcttcccgcatagcatccgctcaaccgccggcaagggcaggccagctcgaatgtcagatcctgggcacaccatctcaaacggagaccaccggcactacgccgacaatggcagcaccaacgggcacttctccggggactccaatggggctctctcgcgcaacggtggcagctcgaccgactcacccgaccggggaagcatcggaggcaaggagacgctgagcgagctggacatgtacggcagctcgcgctacgaggcgatgctgctgagggaggacgtgaggaacacgagctggctgcacggcttcgacgacagcaagcccgaccagagcccactgttcgaccaccggttcgagccgctcccagagcccttcagcccgctatgacgaatgcacggttgccgctgcctgtaaatctgctgttccatggtctgctttgcaagatgtgtatgccattccatatgttttctgtttggttctgtttcaggttctacacgctcttcccttgggtacaatactctgctggtaatattttactttaccgatataagacggagagattgtggggtgtggctcatttaatttatccctggagtagggattggtttccacgtactgttgtactgagaatccacaagagtataggaattgataaaaacagtaaagatttgtaagttattgtaatgccattggtttctcatggatgttatatcttgtcaaaccaaccagggttgccaaatgcgatggagaccctgtctagggaagcctttagcaactacggtttcaggctcccaaaatagtctgtagtaatataatttgtggtccggtttattggtcttatatactcttatccactcggtaggccagctatgttttaaaaaaagtcaatttaatttgttaaaatttatctgaatttcatcgtttgtcgttgtcgtcagtgaacgagcggtcatcgtgtattaagcagtatccggtgaccagtcacattttggaaccctgtgtcaagctcgcagctgcttccatcacccatgctagtgacccgtgtgataaaacacgagacggtgcgtcgtgctgggacgggacagcatgagaagttgagaacgcattgaagtcgaggctggcccggccatctccccggccccggcccgtgcacggcacggcacgcgtcgcgctcagcgtaggtgggaactgaagagcccaccggcgagaggccgcgtcttgggctatcttcccttcccatgccgatccacggcttttttttttctttttggaacggccgattgttgccggcgttttatatataataaggtgtcttattttaaggagaaaataagaccaaactttacggtgcacagttaattaaagaaaactgggtaaaaaccacaactacaataaacactccaagaaacctaaactaccacggcgacaaaacattagccaagcacaacactcaacaacgctgctcaacacaagaacggtaaagccaagcagcaagcaagaaggaaacagaactccccaccctagtaaggcacgacgtgtta

SEQ ID NO: 67083 - DNA, 1750 bp, Oryza sativa
ttcgaaattccaacttttttatcacatcaaaactttcctacacacaaacttttaacttttccgtcacatcattccaatttcaaccaaacttccaattttagcgtgaactaaacacacccgaagacgaagatggtgatgaagattaattttttttatgtaaaacgagttggtattaacatattattgattgagttttaattattataaatttaaaaaatagcttaatatgatattttagagcaactttcatatagaaagttttcgcacaaaacgtattgtttagcaatttgaaaaatgtgctacgaaaatcttaatcttcatccactcttgttggataaaagaacgggaccttagtttgatttgataccatatcacaacactagctaaacgtacaacataccccccaaaaaagtatttttcttaaaaaaattacaagcatgttaaagattgaatatggaatcatatgattaaaactacatatcaagtgtatctataaaagtaccacactctttacaacaactaaattttgtgccacataattcatgacaacacgctgcaaaatgtttggtaaagcaataatgaatcgtggtatatatccaactaattaaacaggccctaatataccaacctctgtaaaccataaaaggcaatgctggaagcatggtttttgaggatttctatcacctccggtcgcccactcggacgatctgatgatgggcttttatcacatcctacggtcttcgccatctcttatggtcttcgtcatcttcaacgttttcttcgccgtatccaatgatcttcgtcattcttgatgatattatctgtttgtcgattgaagggacgtattcgtgagtgtcttcgacgaatgatcaaatacatgtctagaaatcaataacgtcgtataaaagtagagtgagtgtttgagtattacattattgggtacccacacaaaagacggagagtaagagcatgtttagatccattcggaatggtaaatggtaaatggcaaaagttttgtcattgcaaaagtactagttggtgtttagatgcatcctaaacttttaccattctagcactttttagtatagagagagagatcccaaaacactttttagcacaatttactattatgaactagcaaatagcaaatggcaaattgctaacttttactactagtgtttaggtccaaaatagtaaaacttttactgttttggagaatctaaacagggcgtaacaaagcccagcttaattgggcacttggaaggagaaaaaaaaaagagaatctggtgtgaggttgtccatgtgctgatcgaccagtgaccacgaggtctgggtgtagatcccgttgcttgcacagagctggatgcgattgcacgcgatctctctctccctcgtcgtactgggtgcctactaacctcataattagtgcatgtttcgtggaccttttctctgtggatcggagctggatacgtactacgcgcacagcagcataccaattcgcctgtcctaacgaggacgatgtatagtaattgagcaactaatgtagcagcgattagcaggagcagtgcccagtgcacacattgatgattgatctctcgaactcaagatgtggtttaataaagtctaagtcgacaggcactccatttaaacaatgtactcgtactaactgcttatctgtcgaaaagttcagagccacagccactgcaagagtgcagtctgcagagttcagaccaagggatgtttcactggg

SEQ ID NO: 67084 - DNA, 48435 bp, Oryza sativa
tccccggcggccgcccccgccccgccccgtcgttgttgacccggccgctgttaacagccccgatgtgcccagctaccagccacacgtatacggccgcctcgacccgccctagctcatcccactccacaggcgtgagtcacctcgttggaggccggagagggaaaagcagaggggaggggctgtcaggtgggatctacgttgcttcccatgcgggcataccacgaaggcacgccacataagtaaaagtggcaaatagttaagaaatcatctctctccaatgtcaaattattaagcgcaaacctaaaaggaacatttggataattgccaaacctaaaagtggtaaatagttaaattccccccccccccctttttccactcttcccttgcctctactgaatcatcctcggcgagatggatttggcaagagttcagtggctcgtctcggtgtacaaactaagtgaaaaggtggaggaaactgccatgcatatgtgcatccatgcctttcacaaatgcatttcggtaatctgttggtatatactccctccgtattttaatgtatgacaccgttgactttttaatcaacgtttgaccattcgtcttatttaaaaaaattatgttattatcatttattttaccgtgacttgatttatcatcaaatgttctttaagcatgatataaatatttttatatttataaaaaaaatttgaataagacgaatggtcaaacattgattaaaaagtcaacggcatcatacatttaaatacggaagggagtagtagataacaatgtcgcccatggaggagctggcgattttgcgccccccccccccccctcctctctctcctcttgccaggtgaggatgccgcgcatgcactaccaaatgttttagagtataatttgttgctggggtttatggaatcgtcgccacaatgttgttttgcacgtactgaataagatcctgtttagatgggactaaaacttttaagcctctatcatatcggatggttggacactaattataaatattaaacgtgactattaataaaacccatctataatcttgaactaattcgcaagacgaatatattgagcctaattaatccatgattagtctatgtgatgctacagtaaacattctctaattatggattaattagacttaaaaaatttgtctcgcaaattagctttcatttatataattagttttgtaagtagtctatatttaatattctaaattagtgtctaaatacatagactaaatttaaatcctagatccaaacaccacgtaagtcgctacctcgccttgtgactatattgaagacggcacactttgggcgagcatctccgacgatcggccaattattctcttggaaggagttactttcctcctctcttccataatttgtacccctccgtattttaatgtatgacgccgttgactttttgacgaatgtttgatctttcgtcttattcaaaaaaaattatgtaattataatttattttattatgacttgatttatcatcaaatgttttttaagcatgacataagtatttttatatttgcataaaatttttgaaaaagacgagtagtcaaacgttggttaaaaagtcaacgacgtcatacattaaaatatggagggagtaatatgtaatttgaacgatttgctgtgtggattttccctctaatttaataaaattcaggtatgacaaccccctccccctcctcccggggacgggtttgatattctaaaagaaaaaaaaatagcccatttagtaccggtatgtcacacgctaccaaacatgccggtgcacgctgcctgtgacggcatagtactcctttggcggtagcagaggtgtgtgcctgttggggcacgcgcacgtacaaaggcaaagctaccatccaccgtccaaactcggcgattttgccttggattcgccaaattgactgacgtgcttgctgctgtcgtacaaaccgtccgggcgatcgatcgaggtcgtcgatcggttccgtgacacgatggaacggccaggcatgttcatcccgtgaacgatctcgtagaccacactgtctagtacgcatgagtcatgacacggctactggccgtgctacactgcctttgtgcctgggagtagtcccggccgggccggagtgtcacgcagcaacacgttgcggcgcgccgacatatgggaaagggacgtgaccatgtgtgtgattactgattagcaatcggtgtgtctggactgcactccattgctcgcatgttgtgctgcatgcctgcgttgcgttggtcgcttgctcgacctggctggcattgttttatgggcaaccgcagttgcatgcgcaatccaatccaatcgatcgcagccgatcgtcgcttttgcctttatgtaggagtgagtactctgctccaccctcgctgaatccttttctttgactactgctgggccactattccggctaccaacacaaagaccagactggctgtcagttaaaagcggctccaatgttcatttgttcggtttccggcctgagcacgagctactccagctgttgccaatcattaggcgccactaaaaatgattccggcggagattgcgcccctttacaacgctcacgccgtgtcccttgatccttgtaacactgtataattacgtgcaccattgcgcacgcacggatcacgccgtaccgaatggcagtgtcggcagggatacgttcgtacagcgagacggagacggagatggtccagtccagccacggtgggcgacagggacgcctgtggcaaccgtcggcgtcgcacgtacatacagcacgtaccgacggaaagggatggcagtggtggtggtggtggtcacaggctgtggtggcggagggcggcaaggcaggcaggcgagcgaaaggaataccgagacggagaccccaatccgtgcgttgcggtccatggctggtacgtgctgcgactgcgatccggttgcggacggtccagccagcgccagccacggacggccaaagtttcggctggatcaccgggtcgcccgcttgggctggaccaccggcggcgacccgttgtcacgtgacggatggctggattgatgtaggactagtactactagtacgatggtagtacgaatatgatatccatccaacgtcctgcgtgatgtgtgcgcggtggatgcgatgcgatgcagtcggcagccagggcagaaggcagcagcaatcgttggttccatcgatcacctgggttttggcttggcgcttctctccggcttttggcgggcagctagcgcagcagcttctggcgtccgatggagacgcgacgaggccagcccaaccctgccgccgcgccagccatggaacagtacaacttgtggagcagtagtacgtgcaccatcgagatcggttttggattctgattgcacggaccgatcgacgcagagcgctgcactgccccgcaccggccgcggcttgaccggacacgggcctctgcactgcatgtgaccagcgatccggactgccagggaacgagaagacagatcagtcgccggaaaatgtcaggtcctcgtcctcgccatgttacccctaccacaactgctccctgtccagtgtccaccaccacggtaaaaaaaaaaaaaagcgacgaaaacgacaatgcgcaccctgtaaaaataacacagttttttttacagcggtgattctgacccctttgaaggctcatccccgacaggggcatgcgagagagagagagagagagatcggtcatcgacctcgatccacgagacggtggcagtctggcatggccgaacagagcattggacgtggtgtgcttgcgcggaagccttatcgcggacgctttctctgacgaccctttcactgcacggtggcccccgccgttgccggcgaagtactactaggcctcggctcccggactctagaccagctacggcttcctcgtattgggagggacccatccacacgcaggctttaaaatatcgcgggaaggaccaaaaaaaaaaaacaagaagaaaacgcctttcgccccaaaccggggcttggctcttctgtagctgcacgggtttcgcggcaaaagtagctgtccttgcgttggctcgtggcttgtcgatctcgcgcgcggcaactacggatcgtgcatggatggacgcggagagcctctcgtgtgctgaaccgcgcggcacaccgcaagcgagagttggttagtctttggccggggctcgaactctattgatcagagcaagtacaccgtcttggactctgccagtacagttttggtgatgtgcagtgcccggaaaaccgggctaacgtccaaacggatgccgagtattggcaaacatggtcgtcgtcgcatcacgtacgccactagccaagccaaatcgaggaaattattgttggtgagcacataaattccagaaaagcaagtaactccgtcgaccattctcggtgtgtcggcacgatcactttctacaaccgcctgcgccaacgatcgcaaaaacgaatccggaaatccaccaccactaagcgccgataaggaggcaaaataaaggtgatacgaaaggcttgaaccggacatccccaacaaacctcggcgcgatggtgaaaccgggcatccaagtggatccgggcttgcggcggctgcggaggcggtgcggtgggtttcgtcgcgcggcaatggggtcgtgtgtcgtcgtcagtcgcgggtcagcgcctcgagcggcacgaaaggtgcggtgcggagttttgcggaccgcgaccgcgcgctgcggctgcaatgcaactggcctgacctgacaacggcgcggcgcccgctctgtgttttggggtccggttggttggctggttcggcgtcgcgtggtgtgccgttcggcaacttgtgctctgcccgcgcgcggcgcggctgcagctgcatggcggccgactcctcatcgggcctcggcgcggcgtggcgtgatttggcgccgcgcggctcacgagtgggggggacgtgacctgacgtgacgggagccgcgcgtcgctttcgggtgtcgtccggcgcggagcacggacaaggagcagagcggccacagcaatttgcagtgagataaccttccagacttgagataaccttcgcctgccgactcgattagcacgaggacgaggagtacgtacttgacgtcgacatcgcaactcagaatcggttcgaggacacaatttgcaggtggttagaaaaagacggaaccgaatagactaagactaaaagattcggtcatcaattcggttagtcttctcggttaactgaatagacaaaaaagacttaattatagaaaaatatctaaatgtaacctataatccactatgtttaataggattaaactctaattttcacactcctacttcttctaagcatgtaacctaataagagtttttactcataagtgcttacgatttttttttgtgatttttgtgttgaaaatttccattatttctttgcatatatgaaaatgttgttaaatttcggtttggaccgagaccgagattgagactgaatttgtcggtcctgatatttttgcgctgaaattcggtcttcacttttcaaaaactaaaaagaccgaaaaccgagaccgaaattttcgattagaccgaatgcccatccctacttgataaccttcgcccgtcgactcgattagcacgaggatgaggagtacgtactttaccactttaccagctcttatacataatcagattaatattcaaattagtactccctatgtgccaaaatataataatttttagctataaatctagaaacacagttatttcaattcatagctaaaaatgcttatattttgggacgaaggtagtagtttttttacagaggaagtaatactattatctgatccatattaagtttatttccactcatactatcatttatctaaaataagtttccttttaaataatcattgcatagaaatttatgaaagtagagaataattgtattggaaatagataaagtggtgaatagttgcattgagatttgataaactataaacattcaagtctttttgttattttttattggaatgcatgtaaaattaatttattctaaatttaagtcgttgataaacgaaactgagatgtgtagagcggagaaatacgcgcatttttcatggcaaaatctaaaccgagaagcctctcagtttagcgttaaccagcgacgaaccaatttgtaagaaggactgctacacgtgctgacatgcatgcttgtttttcctcttagacatgcatgtgtttttcttccttcttataaaattttctctcaaattacttatccgatctaaaattcgattacaccagtgtgttcgttacaattaaatcttcacaaaaagatcttacatgattatattacgatgaaaaaatatttatatttttgaattacttttattataacataagttacttttatcatatatatataagttacttttagattcgactaagttacttcttagacatataaaagtaaattcaataaagtctaaaagtaatttatatatattataaaagtatcttaaaacaaaacggaaacatactatattgcatttttcaagttgaaaggaaacactagatggagtacaaaccagctaccactagttgtgtagtcacgtccaatgaaaaaaggcatgcattaaagttactttccttttgttataagttacttctataatatatgtaaattacttttaaaccttattgaatttacttttatatatcgaagaagtaatttagtgaaatctaaaagtaatttagatatattataaaagtaatttataatttttcatcaaaatataatcacgtgagatattgttataaagatataattgttacgatacaacggtgtaatcggatcgtaaattggatgagtagtttaagagaaaattttatttgaagtatagatggataggaactcttatagatagagtggtagctgatttagacaaactagttaccactagccgtgtaatttttcagggttgtacacaactactatgcctctcgtgacgtgacggtggtggtagccacgcactatcccacctttgtatttggtccacaaatgttgttcacgggtttgtcaaaagtttctgatgggcttatttccttatgggccacatgctgcggtatgacatgaccattccttatcaagggcttcaaataactatggcccgaataattttcctgatgaaccaagcctgcagcaaccatcggtttgtttcgtaccaaaccacagagaaaaattccgaacataaaaccgtgaagtaggtcacaaaacagctttccaaaaaatactaaaacgttcaaatcagagttcatatgcaaaattcactcttatcatttttgtgatggacagtctaagctgtccaagcataatccgaattaaattcaaactttgttaccttcgacttcctcctttggaaagagtaaagagacgggagatgtaatatatttctactagggactgcctatacattatgtgacagattttctagtattatctactctctctcaagttagtaccactctctcaagtattcgtgagggcattcgtaccgcaaatccgcaatctagccgatgttctttcgactgtctcccttgtgcgcacatgtaagagtcagaaagaaggatatatgtttagaatcatgttttatttccacaaggattcaaatgcagaagagaatcagagatggtggtgtgtcgttgaacacgttgacataaccttgctgatctagaacctaaaataatcagagagacagaatggagaaatgcagatgaaagcataagaaagcttcgatctatgcttcgatctgcatgttccaagtcatggtgaagctcttgcccagcggcaatgccagccctcccacctccaccatcacgctcttcttgtgtccctccacgtcgcggtgcccgtgcagctccgcctcggcacctgcaaagtacggcctcgacgttgcaatggcggtggcgttcgcgccatcgacatggacggcgaggtccctgcctgttccctccagtccgagcacggacagcttctcgatgaggagccccttctgcaagctgtagctgcctagctccacctccgacctcaccgtcaccgccttgccgcgcaccgtcgcgtagaagcggacgtacgtcgcctgcccctccgcgagcaccatctccggccgctcgtcgtcgtcgacgtacacggcgccctcggcctccgcctcggtggcgccgaacgggaacgcgaccaccagcgtgaacggcgtcgcgcgggcctccttggagatcgtcccgccgcgctgcatcgggaggatcgtgttctggaacacgtgcacgttgatctcgttgagcggcgcgtccagcttcacggcgccctcgcccctggacaccaccaccttggtcgtgtcgaacaggttgtaccagctccccggcgggaacatggcgctcaccgaggtggcgccctgctcgagcaccggcgacaccatgacgctcgcgccgagcaggtactgcgtgctcagcccgtagcacggcgtgaagtccgggaacgagaagaacaccggccgcgccaccggagcgccggtgagatgcgcctggtagttgagcgtgtacaggtaagggagcagcctgtaccgcatgccgagcgcgttccgagccgacttggccacggactcccacacatacagctcctgcctcggcgacgcgaagttggcatggtccctggagaacgggtagaacgcgccgagctcgatccaccggttgcagagctcctccgtcggctgcgggtagaacccgcagatgtcggcgccgaccatcggcatgccgaagatgccgaagttgagcatggtggagatggagtagcggagattctcccaggtgcccttgttgtcgccggtccagtgcgcggcgtaggcgcccgacccgacgaacgtagagcgcgtcaggatgaacggccgcttgccctggagcccctgcagcgcctggtgcgtcgcgatggcctgcgagaatccatacaggctgtgcgcattgtactccaggatgccattgtagtgcgtcgcgctggtggcgatggtgttgaagccgagccgcgccgtctggccggaggcgttgatcttgtacggcggctcgtcccacctggtgttcgtcaggttcttgcagtccaagcagcacacccatggcgtcgtcgtgttgggcagagggcacaggtgcgtcgtcgggatctcgcatttcccggtgcagaagttggatgcctcgttcatgtcgatccagaggccatccacgggcacaaggtcatgaaacctcctcacctcgtcgatccaccacgagacgccattggggttgaggaagtccgggaagtagacggggccgggccacacctgcgccaggtatggcttcccgtccagcttgatgaagacgtcgccctgcatgccgcgctggtacacgccataggtgttgttcacggcgatgccggggtcgatgaggacaatgtacttcatgccctgtgcatggatcttgtcaaggaattccagcagcttgggacgcgggtagttcacgggatcaagggtgaaatccttcgcggcgtccatgtgatcgtcgtcgttccagatcacgtcgagggggatttgcgcgttccggtagccctccacgacgccctcgaccactgacaagttcttgtatccccatctgcattggtggaaccctgagaacaagcatgtgagaagaacattagagagtcgcatcgttatctgaaacgaattatttggtatttgcatatttgttttgcagtacaatttagagcaccgactctgcatttttttttgttggttaattactgtcttgatctgatcctgtgcagcgggagccatattttatcgatgtgctgacagttaaagttagtacttatgatctgcatctggcaatatgtgcatctaaacagtgtttactgtcgtgataacaagggagtactactttgttgaaagcaaaatgacaacacatggtattgcaggaaatgcctaggcaagacaactgatgtgttgctgattgtttctctcgtctctgatcattttgagtgagctgggtagatcagtagggcactagtataacttatgaaaaacattgtcagtgtcatattctacagagtaacaatgcaactccagaaactattcctagcagctggcatgacttcattctggagtagcatctattggaactactaaaccctgcaggggaatattgcatctattggaaaccagttactaattgcaatcaactactacaggtgaaaaatgccatattgcatagtaagaattgactgaagacaaatgaacccacaatcaaactgcccccctgctgtccccaaattccaaaaagcctaaattagcgtgtgccatgtgaccaacatcccatacccctgctgtctccaaatattggagatttggagtatctcatcattgaatctggatggtactactataaaattagctaatcatagtactaataaatatactccagtattgatggatggatcaaactatacagacaaaacaaaactaataaaactaccagacaaaacgtaattaaaggacaccagaactcatccaaaaatgatgaaaaaacaaagaaaatgaagttgggcagtagttaccaaatgcccagtacggcattggggctggtcgtccgatcatggacgtgtactgatccaccacggccaacggcgtcggcccggagaagaggtagaaatcgaggaggccaccgatgaccttgtacgtcagcgacgtccccctgtagaacacgtccatgccgttgctgttcagcagcagcacggcgtgcgcgacgccatggccgccacggctcctgaggtccacgtacaccgggtgcgagccgtagaggtcggtgttgaggttgatcgccgagatgtccgtggtgtagatggtgtacgggtcgttggggcgcagccggatgccgcccggctgcgtgttctcgccgaggccgtacagcgccgcgtccctgggcagcgacgtcgacgcctcgatgtactggtccttgaacaccagcgcgccgcagctggtgttgaagagcgcctcgcggctggacttccggtgcaccgcgaaccagaacgggtcgcggccgtaggtgaacacgagctcctcacccgggtactcgccggcggcgaagggcacgccggtgatcctcccgccggtgacgggcggggctggctccctctggagaaggttgtaggggacctcccacctcggcttgtctgcgtccgtgatctggactcgtatcctgtccttggtctcgtgcctgcgcagcattgcaatttcgccattagagcgctagcgttgaatatgactcagtaatctttagaacatatggaaatcatgctgtgaagcagcaggagcacgatgagtacattgtaacataatatataaaaaaaattgagcaaagcatcgaacttttgtggtccaatcttacttcttcgagcagtagttcaatcgagcttgattatgatatgcaagatcagaaatgcaagtcgttctttattactattgaagaaaagatgcaactaaactatcaattgttacagccacgaacattctcctcaaatgtaagtactatcacttactctattagataacaattgggagggagccaaatcaatggaacatgtatagaacactgtgcacagaaagatcaaggcatgtggaatcgaacaacaagtgatcactagtcgcataaaaaagattttactctgttcttacttgacatagagcctgaggagagggatgtccgggccgtaggtggaggtgcgctgcttcacctgcaggtatccaacgagagctcctccctcggggtgctcgaccagggacacaagcttgtacccggacccaaccttgggtggtgctgcggcaaacacgccattgctgctcgccaaggtcaggaagaggagacacaacgggatgcaggagatggccgcacgggacgaagaagagagagacgccagcatttctcgcatttcttctccctccttcctctgttaatttcctctcaccctctccctttgtacagagagagcagtagactgtgtcacacacacagctcacagctcatctgtgagcctggagataggagaggagaggagtgtgtgttgtgctgtgcatacgagtaaatgtgcagggagagggacgctgagcagtgtcagtactcctcctctactgcactgcatgcattgagtggcatgcatgttcattggatggggcgctttttttctctgttttataggccccatatccaatcggagtgctctgtcgctatgactgacagggggtccagctgagtgatactgtgatactagcgcatcaccaatcggggtattagatttaaataaatcaacttttattataacaatcctcgcaatatatatatatatatatatacaaagtagtattaggcaaaaaagaaaagaaaagtagatatagataatattgtttactttatatgggtatcttttattatttctcttacataatattattagatggctgaataaaatattactcgctctatcggtcccaaaatataacaaattttagcccttacggtttatcccaaaatataacaatttattcaccaacattattttctcaatcaattacaaccctccactgttcaatcttcttacctacctccccttctctaccaagcataatattctctcatttaattctacgtactttcttataactcttgtccaaccctaaaaaaatccttacattttggggcggatggagtattacctatgtactatttttgcaccacattgttaatgacataagggaataaacaactcttcctgctaacgtgtgacctcgctcagccacgttggcgaagagttgacgtggaggagagagggaaaaaagcgaatggcttgcaaaggtttctcgtgtcttatagaaggcatgatagcctcgacacatacacgtagtgagtagagacatggcctgagcatcttgttgtgtagcttcgtcgctttgccacgtgttccacaattgcgccaacgaccgaacaaattggatctaactatagtttcgaagaagagaggagtatgtaacaattggaaggcataccaggatgaccgagaggaccttaccacagtcgccatcaccattgggattgctggcaagagctcatggcttgatgtttctccaccctactcatataaactggagctcctcaccttttcccgtcgcattcgtcatttttttttcacaaattgtatggtattctcacatgattcaaaaggggattatgaagtcaggtctagggctcaaactgccgatgccttgtgccatcattgagtgggaggatggattgcactagaatgtgaagaaattttaaaaataggttactgatggggcaattggtcctctggaatgtcgttaaatgttgaacggttgatgcatatacttaattataaatggaaaagattcttttatatatgttaggagtgaaaaattgtaagaataaaaaatcaacatcagttataatgctaaatcattaattatagtagtatgttatactactattaacatactactatatatgagttatttgcatgatgattacgtagacactagacatgcaagcgggccaacccgtgaacccgcttataggtaaaattagtgagtaacccgcgggttgacttgagggttacctactaattttgacctataaataagtttatgggttaattcatttgcatctctatgacgtggcaagtcgagctatgatatgaaaacccacgaattatttagcatacactccctccgtttcacaatataagtcattctaacattttccaaatcatattgatgttaatgaatctagacatatatctatctagattcattaacatcaatataaatatggaaaatactagaatgacttacattgtgaaacggatgaagtaagtagattcgctggtcggcccacttgcatccctactatacttgtgaaccactgatcatgcttttagcagtgccaatgttgcaacggtggagtacatctgctgatctgcatgcatccacctggctcaagttaagccaagcacaagattgattaaacaaatggatcgaaagctgtgtttctttagctgtaaagataaaaaagaatggtgtcaggcacgctactcaacgatagattggagaatcaccgaaaaacagaataggccccagatcgcaacaaatgtctatgtgggcatgttcgtcctcgaggtgctacaaccctagtacaaccttgggcacagcaacacgtcagctttcacaactcactactactagtactggtactgtacttgcacaacatttgcaagaatgattaacagaaaacataagcacgtaattgcaaaaccggaataagaaaataaatgaatggcggcaagacacgtagtaaccggcattggagacgagaatcgcgactggaacggatagcgagaggctgagagcactggactgcacgcgacatgggcacgcaccttatcatctctgccataatatcttgccggattggcggaccacggcggccagccgcgtgcccggccgtgtcctccatcccttttgttcactcaacatcagctcatcaaccatcatcatcagctgcagatcctgtaagtggtgtagcgagaggatcatgaatgataggaggagtattttgattgaatgccgcacgcatgcacgcacatgcgattgtgctcgcgtgaatcgatcgagcaaattaagcggaacgacgcacacagtgaagcaagcaatcggcgcgcatgggcaactgacagcccatgcgtgaatgatgcttcactcatcgacgattgacttgctctcgctggcaatggcattcagctaagctatagagagatgttaaatttgacggatcaaaaatggacaaggatcctccaagcgcgctgcgtgtccgagaaacgcggtacaaggtgacaaagctggaaccaccgctggctcgtcgcatgcgcccacatcacccggcacgcacggccaagttaatttggacccccccatcttcaccaaacacacatcacccctttaatcttcacatgaaccatggacaaaattccaagttataaaggggttgcaaggtttgaacaagcacacgtacgcaagaggttgctgctacggtagcgatctagcgttgagaatacgttgaaaagatcccgttccggaagaggcgcttattacgtttgtaagttggtgatcacgcggaaggatgtgtgggacaagtggtggcgtggcaagagcgatcgcttgcctgtgcgggtatggaccagataattaggcggatggcccctactggctactagttgtagtacagtttttctctttgtccattgcggcgtctgcctgccacgaccgggccggacacgacgcactgctgcctcccaaatcccaaaggccaaagctcacatgtggcgtgcgagaccaccgctcacgagacggcttggggttggacgcacgctgcacgtggccgtgctgctgcccactgtaccgctctctcctcactgtgccatctatgggggcatatatgcgagatttcagaggcgaccacctgtgtgtgtaccccggcaattggcccagccaattcggcctagcaacatgtaaaaggagagcagggggcagcccatctgtagcgggccgcgacgacgaaatctgggctggcgcctcgcaggcccagacggttggattctcccactatggatgaaaacggtccaaaaacgatatcatttctatggaaaactgtctcggcatggttgaggatttttcatatttatcaatttaaatatctagttgttccatacgatgcatatatagacttttttaaaaaattatacatagtgaattacaaacagttggaaacagtcacacttctacgaaaatggtctggaattgctttaccaaattcaagtgtccctctagccaaaagataacatatcaaatttgatatgtttcaaatcagaattttaattttaacgtcgatgtatataaatatctacatttgatgcatagggatcatattataagatttatcttgaaaatactacctttataaacttatagactatatcaggtgtcaaatattttgcattcgaagttaggctgtgtttagttcacgctgaaatttgaaaatttaattgaaattggtacgatgttatagaaaagttgtatgtgtataaaatgtttgatgtgatggaaaattggaagtttggaaaaaaacttcggaactaaacagagccatagtggtaaagttatggaaactatttgagagacgatataatgtacaaaggtcatttattattttttaaaacgaataggtcaattattttttgttagaggaagtaataatctacatccatgtggacctacaaaatctaccctttattctccataattgtaccttaaagctaaaaaacgcactcattcggttctagtacgaagctggtccaattaatcagaaaatgaatgagttattttttctgaagtcaaaatgtcactcgaggccaaggtggaaagaggacatgacaactaatggaagccatggttttccccctcttttcggtagttttcacttcagcctttagatgattttcttttgactagctaaatgctcattctttgcaacataattaaaaaataaatcacattattaccttttcaaatgttaatagaaaaattcatattttcgttggaattctatgtgaattgttgatgctgatccaaatggctcactgtttaatataaagtggtagatgacggattcacttatttgaatttcaagcacaaccgtgattacactgacaacatgtatccgcataagttagcaccattgagattttttaaaggagtatccgtaaaaaaaggtataatcttaactataaatctggacattctacttgtccagatatatagttaggattggattttttagatgaagcatttagtaaattacatcaccaccatcaaacacagaaccaatattttttttaatatgtaatacaaaacaaagggtagttaaatatttccatgactatctttatatataaaaaacacctgaaagcctaaaatagccaaaaatgtaagcgaccctttgcaaccgatttcaaaggcataacaatattgtatgcaatatatttttagaagcacagtacaaacgcggacactcataacgtgttcacactcctataaatgtagcacacgcatcctacccctatgaacacttctggaaaaattgagtgccgtattttgagattaacaaagtcaccacaaatatttacatcgtctatcaatgaaataaattaattagtcgtaaatacgagcacccatgttaagtatagtactctccatgtagtattgtagtagcattgtatagcaatattagagcaaactaaaaacataaacataatatgtatggtgttagatagttttgtatcaataaaatcaattttctcagtctatgcagtcctagatctaattacttttttttttggtatttctagcattttcgagagggagaatattaaaagcaaagaaaacacctcaccggaaaaaaaactagcaacttgccacgtaaagatagaagtaaaatctattcagagaggcctctcgtttttgtcttaaccagcgacacctaaattttgagaaaacgtggagtactcgtactatatgcatgcattttcttaatagacatgcatgtatttttcctcttcaaacaaaattttctctcaaagtacttatctgatctacaatccgattacaccattgtattcgttacaattaaatcttcgtaacaagatcttacatgattatattatgatgaaaaaatatttatattcataaattacttttattatatatctaacttacttttatcatatatatataagttacttttagatttaactaaattacttcttagacatactacctctgtttttcaatagatgacgtcgttaactttttctcacatgtttgaccattcatcttattcaaaaattttatgcaaatgtataagatataaatcacacttaaagtactatgagtgataaaacaactcataacaaaataaattataattatgtaaattttttaaataagacgaatggtcaaacatgtgagaaaaagtcaacgacatcatctattaaaaacggagggagtataaaagtaaattcaataaagtctaaaagtaatgtacatatattataaaagtaacttaaaacaaaacggaagtaagtttgtcatgacactataagtaaattcgttgtagggataaaaatatgacttcacgtccaataaaaagaggcattcattaaagttactatctttttattataagttacttctataatatatgtaaattacttttagactttattgaatttacttttatatgtctaagaagtaatttagtgaaatctaaaagtaatttataatttttcatcaaaatataatcatgtaagatcttgttataaagatttaattgttacgaacacaacggtgcaatcggattatagatcggatgagtagtttaagagaaaattgcatttaaagtatataagtggatagtatcttctcttagatggagtgatagctggtttagacaaaacagctactactactgtgtagtcacgtttaaagatagaggttgaatggtctctttgttaacttttagatgataaattacatcatgatcgttttcatcggattaggtctcaccataagagacatctcttgcccttacgtctagaaaagaatcatttccttgcttgatttccccgtttatggacgtggtgctccggcaattgtgcaccgcaaatgccgttcatcgttgtgcacgatagcgacgaaacaaattaatatccgtgcaattatgtgttgatacaatcatggtgggcagacgaagaaaaactcgttgtgatggctactagcacgtacgatagcttcactccatcgatttcagccaacgggaaagttgatcgatagcagaaaaaaaaattaagtcacaaaattgttactatatactagtatgagattatacagtttcatcctataacttttgtttcgctcgggttctaaacttaaggcctcactgcagctgaaaacatcgtaaaagtcgaagaagtgcgatgagatgcagcagatccattcatcggttcatcagtcatcatcatgtcacgaactctcgacgaaggccactgcgatagagctccacgccggcgttgtcctccctctttgtttttctcttagaaaaatgtttgacggttgacgccggcaaacttttctccattgatgcgtacatgctgattttgtaactgctgctatattccgaaatataattattttagttaaacacatgtattaaaaagtaaatgaagtaaaaataattgtagaaaaattgtaaataagaaaagaaattagataagtaatgattgtgatttgttgagataagtgggtaagttaataaatacttcctccgtcccaaactaagtacagctttgcactatttatctccaacgtttgattgtttgttttatttaaaacttttttataattaatatttttattatcattagatataaaatataaatagtaggttatgtgcgacttttttttaaatttttcaaataagattgacggtcaaacgttagatatattaatagttgcctttatttttgggatagaggtagtacctttattttacaaaggagtgaatagccaattagaaagcggttagctttagcacaacagcagcacgtcgtgttgggttgcagaacagtacacttttggctaagctggagcattattagccccaaaatataccattacagaagcatacagcgaaattaacgaattgaccgatccgtccggtcgcttgcttggtgtctgtagatatacagttttatttaaggagaccttgacctggccggccatggctctcatccctagtcaaggtcacctcgagcaagttcaataggagccaactactagctccaattcatctatagctaatctaatagctcattcatacaatagttatatactacactattaatatctggtcccatctgtcatgcatacattgtgtcttggattctgtgctacagctggctataaatctgtagcccgctgcccttctctctcctcatttatctctttaaaatatgtttgcagctagcttatagcctgctattatacctgctctcacgagccagcatttgctgcgacccagtggacctgggaacaaggaaatgtcagtgatgtcataccaaagcaattggcttgacgtcacatctctgaatgtaagcaggtgaggtcagtacgtatggcctccattcctgattcttcagagaaaggtcgtcgctattgcggatattttctttgccggagagaaggcaaagccaaaccattctgctccaccaatgccctgggaaataaacgctcgggttgttaattttagtttcattccattatttgtacatgattaatttgatattagctattataagtttaaaaaatggttttaaaaagcacatcgtttagccgtgaaaacgtgaagtagctcatccaaagaacgaaaccaaatggagcgttggtcaaagaaaagagtcaagtgtctttacttatatattttttgtcattaaataatgtgttagttgaaaggcatacacccaagtgcccaacaccgtgaaaatcacacgccaaaacgagggtgcaatgtacacccaatctaacaaacgagcatttgatacgattatagttattgtgattgacaccaagcaagccggagtacttttttttttcttgagtttctccttgaggtaatgatcctcaactactaggaagatttctctgaaatcagataaaagatctctgatgcattagctcctttccttcattttttctattgtttcaagctcggctcttttggttcaacagaacaacttttctttgccggcccaaagatagttggccaaatgcccattttttttgttcatagagaaagcacggcagtagaggagtaacaaccaccaagtttggcaaatcgagaggctattattatctgtttattggcttagaagacaaatgcaaaattttactacttaattgtgtggttgtatttttaatttttctttcattagctaaatgcccgtgcttgcaatggattattgaaaataacaaaattaagtccttgcaaaaaaatatttttagttattgaaacaagatctttcatcttgctatgcttagaaaattaaagagatgcaacctacatgatacaaatagcaaacagaatattaatggcccacatctccgttgtggttgtgggtggcagactcaccatcacagttttataatagtaatatagattgtggtatatatttttcaatatctacttttagtccattattaatatatcaacataaaagttttatttataaattatagtatttgttactttgttcattttcctgcggtttatcaatcgaagctaatgcacatgcaatctctgctcttcatccctctttcccccgccgtgtcaatcaccattcacgattgctccttgccactcatgttgttgcttacagacacaaccgggtcgcattaggaaaacgctccgtgaagatcagtttcaccgcctctttgtcttggaatctaggcacataatatcgacgtggatggtacagttgcgctgttttgtcgcggtgaaaaggaaattcgtagtgggctggtggtcgacaaattaattggttcagcattggttggtttgagggtatgtgtgacctaagaataaaggattgggaccccagtcttgaagcatcttacagtaattatgaaagcaatttgcttaagctgcatcattcatatacagtgactccatcgtctctgcatctcatactgtaacaaacagtgctagaaattcattgctttaccaatagacaatttcatgcttgcaagttactactagtagttgcgaatctatcactagaatttaattatctactagttaccttttatccagttgatgatatgatttccaaagctcatagattcgcactttagcaagcccaagtgcaccaccagctttactgttttttctctctctcacgagttgtccacaaaagctgcacgcttgagtacaatcgtatcagtggattcgaagaagaaatatgaagggaacaaccatattgattaagctaagaagactatcatggagtctcgttttctaaagatgttcagttccaaaccagcttgtagaatagtactaaccactcgctatgcgatttgtcaatttctttgtgcttgtggacagggcatagctaagacttttcaaacctcttcttctagcttttctctcccctgatgacgcctagcaactgaactgttatacgtcagctttgtgacgacacgaaactgtttaggtgctggagtactcgtttttaatttatacgtattgagcacatactgactttacgtgacagtatattaatactagtactgaccaagacttcaaagttcaaagtcccctctttctccaaaaaaagaaaaagacctcatagtccaaatctcttaagtccttctatagattatactagtagtaataaacaaactcagtgacaccagctatcttttattatttttctttactgttacacccttctcagtacattctcacttgtagtatattgctatatcattctcatgaaaaataaacattttttaacttgtaatagtaactctagcacaatgaggttaatgtcctgctggttgcactccagatcatacattcacatactactattccagagtgatggccagagtagaagggtagctaatgatcgatcaatattttgggggtactgcaccctattcaattcgattcgattggggctcatcaatttctgatcaaatctgcagaatggtccctaacgctgagatatgttcatctagctagcagtacatggagccatggaggtaaacacaaataactccttcggttctaaaataagttactccctcatttcttattgtaagttgtttaacatttttatctgtcaaatttatttaaatttgataaagtttatagcaaaataaagtaacactttcaatacaaaacaaacatgataatgacactaattctataccgtagatatatattgctaactttttctataaatttggttaaacataaaaaaatttgactaagaaaaaaattcaaacgacttataatatgaaacatacgaagtagtttttatacatgtatatgaaggtagtgggacatagggagtatcaaagttcatcgtacagtacggattgacattcactccggttatccaattatacggagtaatacgttctacgcataggagtatcagatacgatcgagtatggtcctgctcgtgcttaagataccacatgacaaaggatatgagcatagatatcacacccaccatgcatatcatgcttgctaattaacttgattgaagagaagtgttattcgacttgtcctccgcatgtttgtagacctaacttaattgatctgttttctatagagttaattagccccgctaaaatggtgtcgattggattttcacacgagaaagtaaatgttataattagaaaaatactccaaagtttaacacttgtggtaaactgaggcgtgaaattccaattgttttgggtataagaggtcggcagaataattgttgtgacgataaaccaataaaagttttcttaaacctcacttttttacacattgattcattttgagtggggatttggaacatcaacaaaatcttcctattagattttggatgaacgaaaggaaattgccatctcgtatgaattgttgactttgcaaggggcctgtctttcgaaaaatattaatatacacgagaaattcacttctggtgtttatccataaatgtcgtttttaccatatttttgaagataaccacactttagtgatgagttggtgtattacaatggcccatataattatggatggaccggaaatgtggatcaacgtaaaacaatttatcgaactgtttttttaattaaccaaccgcttgggtttttgttttctgttttttctcaaagaaggttgcgcatttcacataacataaacaattcttttatagtgtaataaaaaaagaaagccgtataatatggcgtatcaaataatcttgttttatttatttagcatatgttccgatatcaaaatgtactgtaaggtgtagtaaataacatgccctaataataataaggtaaatagtcaatggtgtgccttatttaaaaattttatgcaaatatataagatataaatcaagcttaaaatatattttaagtgataaatcaactcacaacaaaaataaattataattacgcaaatttcttaattaagatgaatagtcaaacgtgtgataaaaagtcacaacattgtttattaaaaatatggagtagtaaaccaccacaaaattttctctccttttcttaggaaacactcctcatttctattctactatactacaaacacggccacacgcacccaccccccaccaaacgtctatgctgtgacgaacaccaccaccatggacgccaccaccaccgccaagcgcaagcgcccagccgcctccgacatcgccgacgacgcccccaccaccgtcgacgaggtctccgacgccgaggtcgaggagttctacgccatcctccgccgcatgcgcgacgccacccgacggctcggcgcccgccctcccccgccgcgcgcgccggcgtggcgccccagcttctcctgggaggacttcgccgacgcgccgcccaagcaggcgccgccgccgccgcagcagcccgccgaccacgagcgcgtcgccgagaacgccaccccgccccggcgcccggcgcccggcctcgacctgaacgtcgagccgccgtccgacgcgccggccacgccgcgctcggcgcgcgccccggcataggcgcgcgccacgaggaaacgcggcgcgtcgcgcatgcgggtgctcactgattacaactactttgctagctagaagcagctagctgcagtgttggattgatccatccatggcgctgccttgtcctccttgtgtgtgaacaggtgagacctggttaatcaatcgctcttgctgggaagaaacaatccattattggtcccatcatggagatgtactatcatgtaccaagacaaaatgacgggtttaattaattaccccctatattattcgttctgtaattcagtatatgtcattgttcattagctagtgtccacttgttatccttgacgggactgggttttattttctattgttatttcttcccttttctttggaatgagcacttgggcatgatcttgtcttaaagctttaaacttagttacaacatttctttgtttacttgtacatgcgtcgattaaatcaatatattctgttactgttgaacggtaaaaaaaaaagaattttgtaaggtattcgtaaagtatgtctgaactctgaatagaaaagcactccgttttagtgaatacaagagcacactgttttttttctttttattcagaaaatatattccttttttcagcaggggaaaagaggcaaagaaattaaagcatactaaagagtgatatgaatgtgcaccatcttttattcccagccgtcggcagccagcatctagctatacgcctatatatatattttccgcgaggagcacctagctatatatttttgcctacagcaaagatgtagtattattcttcaattttaaaaaatgggagagcttttgaagctaccattagggctttgggagaccctaaccatcacctgcaacgacgaagacaacgagcttgggggagcactactccaaacagatcaaaaggtagaaatttgaatcaattttgtaaaaagaagagatagttaagccgaatactttttcgttgttttctcttggaaggaaactctttcctcgtctattcttcgttctgtgatttgacaatatcttgtgttcctttctatattctgaaatgaaattcaggtggagaaactccctcctccccccttgacctttctttaaaaaaactcctttccatttattttttctttgaaattaaggggactcctttcaaattctaaataaattgtcttaactatcttacctttctaacttgctatgactaagctacttttccaacctccttccctcttatgacgactttacaagctgatgctatcgttctcgtgaaaaatgtacatcatttccattgtgtaacattcacaagggagaaaaaggataatcgacatgcataagaatacaacaaattcgattgaggcattggcatactcgaagaaaatgacatgacgcctttatatgagctcggctcttcgttggcttacaagcggtagctagaaaagggctcaaaattaatgtgaccaattcttccaagaagctcaaagataaataaacgtttcatgtctgatatggtgacatgtttaactttggcatgtaaaaccaagcgttttcttttcttgttgtctacatatactacctctattattttttttttcacttgatgcattgatattttctgtctttaagatgtgaattttgtttgtgttagaggtgtatgagacaaacattactgtgagcagtgttagaggtgtttatattttgatataaattttaaatacgaaaaacatttttattttaaaacggagggagcagcgctagtgtatcacatgcagctaaataacgtatcactatcgttctagtcttctagatgaccatattatgaattcgaaagaggttgtactgtgccacagtcggtagctcattgtagccagtcaagtcaactaattagccatgcaaatccttattaccatggtgcaagtgggcggaagttgtataattattctggtgcagaaaaagaatttgagccgtcgccactcggacgaaaaacaagtgcaagttccacttcagaaaacatgacaacaggtatagctcgccacaataaaaacaaaatttacgtgagcttctactccctttgtttctggaaaaaaaatagttttagactaatcatttgttttttaaaaaattatagtttaaaggtgtttaaaatagactaagaatccctttgttcgtgtttttaagctatggaaccgatagtactccctctctctctctctccttgttttagttggcttttaatctctttatttaacatgtatttcaactagtaaaaatatatctttttttaaagaatagatggagtttttttaattttttggcttgaccgtgggtggtggtcaatgacagaggatcctggtgctatgcacgcagagcggtaaagacaaaagaagtctctgtggcacaaactgcgatgatatatgcacatggctcggcgttattgcgccgaaatgaaataggagtactagagcggtgtggacggtgcagacgtacgtgcagctagcaggcgtcgacaccaaacccctcgccgtcgacggacggcgcgacacaaatgcacatgccgcatttgacgatgagagttatctgattctatctttattgtttctgaaaacagaaacatatacgcactccaaacacgtgaaaaaaaattgcgtggttcgttcggttcaaactctaaaccaatcttttcttgtggatagcggaactgcggaaagcttctgccgacatgcacactgccaaactccaaaaccaaactgatgcttgctcacggatttgcgtgtgagaaactagtttacgagggatttgacgtcgtgtgtgaagcatattgggaatgggatatcttatgggccctagcccttttggcccaatactttacagcgtgtgatcgcgcaaattaggcccaatattcaatcagagatgggccatgcgatgcgacagatgaaggaatatgtccattttaagtcccttaacttgacagcgagttcgattgtcttccctaaaccgatacaacgggtcccttaactgtcaaaatcagtgcaaacaagttctctcgatggtttagatggtgtttttggctgacgtggcgttcaagtgacggtgatatgacactagaagcaaaatataaaaattaaaaattaaaataaaaggtggggttcacatgtcagtaagacaaaagataaaaaaaaagagtagcatccacatgccagtgggtcccaccctcctctctgtctccatgcacgagcgcacgcaaagagggagaaggtcgaggggcggtggccatagggtgtcgtgatgtacctcatcgcgatgcggggtagttgttgtcgccgctgacagtgatccaaaacctgagccccctttccacacatgcgttgcacggccggccagtggagatgacgactggggagattgaggtctctatcgccgccctcgccacaaagaaggcactacaagaggccttcgacgtcctcactgctgcctgctcgcccttcacctggggcgacctcaactcctacatatcctcgctccagtcatcgattgactaacagcttggccggctttgggtcctcgagacgcccctcccagcgattgcaggtcccattgtggacgtcacaagcaatgacgagaagggctggccgcccctccccacccttctccctctccgcgctcgctgggtggctgacaagggagctccaggaggaaagaaggatagccaggagggagagaggagaaggaggtgccgacgcgccatggagattgagtgggggtgggacccactgacatgtgggtcccactatttgttatgttttatttgattgacatgtgggtcccactgtttgttatgttttatctgattgacatgtaggtcccacattttttaaattttaaatttttatattttgcttccagtgccacattactgtcacgtaggacgaagactaagtcaaagcaacaaagtaggcgtcatgtcagccaaaaccgtcatccaaatcaccgagggacttcgtctgcaccggttttgacaatttagggacccgttgtatctggtattgcggttgggggatgaaaatcgaacttgctatcacgcgaagggacttcagatgaacccatccttggcgacacaacaaactattgggccagagagagagagtctttcttgcatctacttagttgggtcagaattcgatcgtggttcgcaatcgcaccggcaaagcctacaagatttgagctacctgtcacatcctagctaagatagaatacctgatttgttgaggcgagatcgccatcaggaccagttgatctttgcaaatttcgtcaatatcccttgtttcaaatatctgggggtagttgttttatatacatctcttgttgaaaggctacaacgaggtgcggtggtcacaagagttggatcacccaattaaggtcgtcgtcgcaccttaattggcagctaatacaagagatgagcacatgttgtagagtattccactattcctgtacctatcaatgcgcagtgagtgacggcacctataagacgtgtgtaaagcgatagcgagcgagagaaatccaaggcgtaaaaaccgcctcgaaaccgtaccgcgcgccgctgcacaggagtgcgcgccgtgtctcatctgcatcgtcatgtcccacttaatttgattaacaaactataagtatttgtctatgaatggctggtgtgtgtatgtttgcaatagggagcagctgaaaaggagcgaagcgtgacgctgatgagaagaaacgcattgataaataagacgctcgatcgatcggtgacgcgaggtcggcaacaaaaaaaacccatcgcgtcactcttaaccgtgccacttcttgctgcctccatccggttcattaatttcgtagttttctgataagaagaaagccaataattacgggccgcaagtcagccaaatcagttactcctccttgcatgtctcgtgaaccagttaggcggttaacttgtatatcaaacagacgccgcgcgcgcgagcagttcgtcgtcgtcttcgctcgatcgtagtagttgccggccggcatcggcatgggcgacggcggggagaagcaggcggcggcggcggaggggtggcggctgagcgtcaacgacttccagttgccggagcggcccaaggacccgcacttcgtcaagagggtcatcaagcgatgccacggtacgttgctgttcatgccaccgatcgatctcttcttcaattcctcgatcgctaatagcttaatctgcctcctcaatttctcattttgcgacgtttgatctatacatggatcgatcggttaccaaccattggttggaactcgatcaacatccatggattaatccaagtccggcctgggactctgtttcgatcgaactcgatcctgggttccttacaatgaaatcaaatttggggggtgtcctgtttgtttacagtgatgtcaccaatcaaaactgcccagtagtttgacgcatgcatgcgtgttatatttaactccaagataaagtgccgtgagggtaaacaactaaagatcgattaggtagcttcatcaaattgcgctactgttagtggaatcatacgtacgtgtacagtactcttgctctgaccgagtcatcacttcaccaatctagcatcaagaatggcccttctgaagtagttgttcaggacaattaatggtaataaacacttcagtagattcgtgtcattacaaataatagctgttcaccaatcttaagcatggagaagagttgccattattcgtatatattgccgctcgttagacccaaaggctgtgcactcactgcttcccaagtgatctaaggcctagtttagtttcaaactttttcttcaaacttttaacttttccatcacattaaaacttttctacacacataaactttcaacttttccatcacatcattccaatttcaaccaaacttccaattttaacgtgccctaactaacttaaacttattaggagtagcactatgcgttcctttcttgttttgtcagagaacatctgaactactactgtagtactttttttagagggaaagaccattatattgaaataatgatctggcctttttattaagaaaacccacacaatagtctgaactagtacttgacacttaatcatgatctagctgatcaacgatgccgctaatctgccatgtcttgcggaaatcgatatatcttcgcgatgatctcaaggacgagatgtgtcacattgcgcacacaaaagaacacacacaatgcacggcggctaaatcgatataagaagctgacgaagccccttacacgtgtgaagcatgcagagttgcataaacttgcattcatgcatgctcctcacaaactaggcagcattggtggactgctagcttggtcctgatctccccgtttggtatgacaaaagcaattgttatattttctagcattggagtagctagcaagtaggtagcggctggtttgtctgcgcacaagttataaagaaggccctgttcagttcatactaaacttttcttaaatttcaaactttctattgtatcatattacatttaaaactttcatactcacataaaattctaactttttttttcaaactaccaacttttcctaaacttctcctcaaattcaggaactaaacacagctgaagtaatgcaatttttttgtctctaacagttgatatggcccgtctagattcaaactttgaacccaaaaatgtcacatcaaacttttctatacatataaacttctaacatttccgtcacttcgtttcaatttcaatggggtgtgtttagttccacgttaaaattgaaagtttgaagacggaaaagttggaagtttatgtataggaaagttcgatgtgatgaaaaagttctaagtttaaagaaaaaagttgaaatctagacatggcctaactactaaaagatacagtataagataatattcaaaattgtggtatcttttggtgtctctttcggaaaaaaacgtaaaaaccacttggttaataagaaaaactagggatcgaatgttcggtccaagtttaattattagacagctaagccttttcttctacggagtaatttgttatggatctctccataacaccgtccccatttggcttaggtggtgattttacatttctagccattttcaggagttggtacatcagggcatgtacatcaattcttattttctaacataatgggcctaaatgggcccgctttatctggcctagttataggatatgtgtcttttctgatgggccttgtccgatgattatctggcctactcctaagctcgaataatcatcccaattactcttcaaaagatctttaaaaaatactccctccgttttgaaattttgacaccgttgactttttagcatatgtttgaccgttcgtcttattaaaacttttataagatatgtaaaattatatgcatacataaaaatatatttaacaatgaatcaaatgataggaaaataattaataattacttaaattttttgaataagacgaacggtcaaacatgtaataaaaagtcaacggtagtagagaacaaacgcaaaattatgtaaagtacattagctcaacttggtactagagaaaattcttgtcccgtccttgcgcccacactatcgagttaataaatctctttataaactttgggcctataaactttaggcgtataaactttagatatatagaaatactatatatatatatataaatatttgaatttaaattcaaatttgaattggatatataaacttttgacttataaacttcgtgtctctaaattttagatgtataaatttgaggtgtacaaactttagttgcataaatttactaaaataaaagtaatgcggtgtaaaaaaaaaagaaaaacacgtggagaagaggggtgatcgctaggggtgatgtttcggagtttggtggcatcatcatcatcctgcagatatcggagaaatcgtgtgtgacttgtgatgatgatctgggagtcccaagtgtcgtctctgttcccaaagcctttgtatgctttatccaaagaagtggcagcgtggatgtacgcgtggccgatttcctggaaaccccggagaatctcatgttgcctagtcgcctaacccgcctaaatgacgcctaatccggcacaattaccccaaggttccgtgacggcacatacatgcaccggcgcgcgcacgtcacgacaacggacggcgacgtgatcgcgtgcgggggcggagcgaaacccgtgcagcctatagcctttggattctgctcgcgtcgcgactattgaaaccgatcaactttcggtgatcagtagatagatgtggagagatcgatccttggcgatcgctaccacgcgtgcccccagacgtatcagtcggcctcacgcccgcgcgcgccatggatatattctctccagctcggcccagttggacatttcgatcggatgagtacgatcgagttgcgtgctcctgatcatatcgctgcctctgcaccggcctagccaccagcagcaagcaggccatggggagccgaggacgacgcggcggcggggagagagagacggagacggaggaggatgagacgtggaagctgcgggtgggcgacgacttcaccgtcccggagcgcttccaccgcaagccccccttcttctccaggatcttccccgccggctcccatggtcacctactcacgcctcccatcctcaatcctctctcccctttcctgtttaatactagatggttttttttctcttgattgatttccctttgagatcaattctcttagattttctgcatatatactcactcgtactacagtaatactaccagtttagtaatcttcagggagaaaggaaacaaaagatggaaaaagcagctactgctctgatcatgcttcttcttttccagctttactttactcgtgcagcttttttacctcttcccttttttgttcaattcgtgatcgattatattagaatctcggtgtcttgtgatggcttgacccgcactaaacaacacgattgtctttactcatagtattgcagtatactagttgctcggtagactcagctggactcaattctgtcgttccactagtgtctagtctttggttgtagactgacgttaacagcacaagcattattttgatgcgaaggggccgtcatttcagtactgtccatacttctgcatattaagaatatcaacgaagaataaccattttgtctcttgagtcttggcaactaatacgtgaggtgctgctaattctcaagcatcgatgctcatatgaagaatcaaggtgctgacgatttagacacctgaaggaaatttcagtaaattgtgttttaggacatcttttattaaactaggagtggtccaacgtaaaacaacgctaaaattatctagtccaaagtaaaaaagattgattaaagggtgatctaaaatagatcgattaaaagatggcacagactgcaatttactgtattgcaattacatatagacatacttatcaaccttatattggcacatagcattagagatggcccaatggggggtccaaaagagtgatagattttgaggcccagcccgaaaatataatgggccagacagatttttatttgaggaccagcccaaaaaaggaaggaaggctcatacagtcttgttcagtcttttatcttcacctatgaataatgttcttactcaactatgtttgctaattacgtccactgcattaggtccattagtagcaaggaactgaaggaagacacttcccatgctgctaggactctttccaatctggactatatatatttttccttgtgtgaaactgtgaattagcatatgcatttatcctagtggaataccatgtttcaatcgaacagtactttaacttgattgatcaagctgttaaatgcatgtggaacatgctatggactgaaaaatgataagttccattaagcttaattaactatttggtttaacactctcttctttctttgattatttcgtttattagtacttctgagtactgaaaaagtcggtgccccataacaggaaagcatcggaaaattgcaaaatactacaagaagcaggaaaatctcctgaaggatttcagcgagatggaaaccatgaatgagattggttccttagatcagaatgctcctactgaggtaaaatcttgttaagagaacacatttcctcaatgcaatatgcaattgccagatttgtaactataaattggatgctgtatatttctttttttttttgtcttctatacacatagtgatatgaagtatatcttcatgttgttttgttaggaagagttgaggcaaatggcaaagggcgaacgattggccatcaacctgtcgaatatcatcaatctgattcttttcattgggaaagttcttgcatcagttgaaagtttatcgatggcagtaatagcatcgacactggactccctactggatcttttgtcaggtttcatactctggtttactgcacatgctatgaaaaagcccaacaagtatagctatccaattgggaagagacgaatgcagccagtggtaatgactcggttaattaaaatctgttctcttttatcagttttgcattactccgaacttaagctgtgcttttatgctagagatactaaaatgatctagacaaaattccagagttttcagatttcagattacctgcttcttattgcttcatgacaactattggagctaactgaataacctgttattttcagggcataatagtatttgcatctgtaatgggtacacttggcttccaagtgctaattgaatccgggcgtcagcttatcacaaatgtacccacgaacactcttcgtcaaattcataatccattatttatgtgatttatcagctgacactagcttaatctattatatgcaatggccttacaggagcaccaagtgttcgaccacaggaaggagctgtggatgatcggcagcatgtcctcagtcgcagtggtgaagttcttcctgatgctctactgccggtcgttcaagaacgagatcgtgagagcctacgcgcaggaccatttcttcgacgtgatcaccaactcggtcggcctcgtcagcgcgctcctcgccgtccggtacaaatggtggatggatccggtcggagccatactggtgagtgcccccattgctgcctgcctgccactctgctagctactccatgtgagaattaatggtggatatgcagatcgcggtgtacacgatcacgacgtgggctcggacggtggtggagaacgtggggacgctgatcggcaggtcggcgccggcggagtacctgacgaagctgacgtacctgatatggaaccaccacgaggagatccggcacatcgacacggtgagggcctacaccttcgggactcactacttcgtggaggtggacatcgtcctccccggcgacatgccgctcagccacgcgcacgacatcggggagtcgctccaggagaagctggagcaactccccgaagtcgagcgcgcctttgtgcacgtcgacttcgagttcacccatcgccccgagcacaaggccgaggtctgaattctcatttatgcaaattttctcttcacttcacttcacttctgtttctgtttggcttgtacaagtcatcgtttccctgtgaaacccacaaggatgtcagttttactaccactgtctctgtagtctttaagtagctgtgggtgaaactgaattcttgttgttcttgttttattgagaagagaaaactgatcgaattcttctagtggattatatacgctgtcttttgctggaaaatggccaaaatggctgggcatgtgtacatgttgtacccatctgaattgtcatatctgtgatcagaagtactactatatatatatttccatttccggtggtcatgtcactggggcagtagtgatgaaccggactagtttgtcattagccccaggcatgtccattcaagttagcttgggccctatccaactagggcagaaaaactcacaaaaatacaaagggcaaaccatgcatgaggacagtgcctgtgacttgttgttcttgctggttcgttttattgggcgagttgcagctgggtgttactatgtgggagccctaagtgacaggacaaattatcaatagcttcttcagctggaaggaaaagaaaggacatggccattgtagctgtgatcatcactaggatccaaacagccccacaccttgtgttgttgcttctcatcgatcagctgggattggaaagaatccagtaatttttttttcacgaatgcgcaaaatgattgcatgtcaatatattacaagaagacataatatatttttaaacaatgcaattggtcatacggtcattgcctggggacaagaaacaaagaaaaaaaaaagaaccaccaaagtaaaggaaaaaactactactggaaggctgttcacaactcagaaggtggaggcggagccatactgctcttccaacaagcctctaaagacaacggcgtgttcacaactcagaaggtggaggcggagccatactactcttccaataagcctctaaagacaacggtattagtacaagaccacaaacagccttcctgaaggatggactttcaaaccacagagacctaggagagagaaaaatcaagaattctagaatttcgctcctttcaatgctgccaaaagatgaggactagatagtcgaagcccactcgaagatgctcaagcaagtagaaagcgagcagccatgaggaggaacgaggacggccagcccgaaagaatccggtaattgtaacaaaataaaattaaattgctgggtgagatggatgcacacccttgtgcatcagcagtagcatggacttgtggtgggaagcattcatctgacagcattattggtaacaatggcaccccatgattgaattgccatatgctattaatttgttctctttacggctatactagacagtccacgcctaatgtttggcggttgttttgtttgatatccttttggacgttttctaatttctagtgcagaaaaatagcagcagcagcagcagcagcaaaacaggggacgtttgagcgaataatacggctataaacgactcacctaaatgctagaacaaatgccaaacattgttcatgacattttacaattaacaccggtttggaaaacaaaatgctgaacaaccaaagagaactgaacaccgaacattagatccaaactgcatacccctgccttgttttgtacttcctcagtttcgcaatgtaagtcattctagcattttctatattcatactaatgttaatgaatttagacatatatatctatctaaattcattaacatcactatgaatatgagaaatgttagaataatttacattgtgaaacggatgaagtggaacagtaaaaggcaatgaaaaaaaagctagctccatttttgagaagaaagtacagcaattggtgttcgtccaggcaagttcatcacgtgcaaaggagaaaggtagcaacaaggcaacctatacgatggatggattgagatggaggccggccgtggcgcatgtgagctatccgtcgtcgtcgtcgtcgtcgtcgtcgctgggtccgggcaaatggaccccgggcgaggcggggagccgtacaccagcgtcagccccaatcgcggcacggtgtaacgcgccgcggcacagtcgtcgtcaccctgcagcatctcttgcacttgctgttgtactacactagtagtactacctctcctcctctcgatcagtaactcattattataattactattattctactctgatgaaggtcctacgtcgtactgccagagattaaacaagttccctacttgcccgtgattctcagtttcaggactgctactactgttcttctatactgctcaggagtaggactactgtacttacttgtattagtattttttttaccaggcaatgaggcattcagtctctagatgtaattactctttccgtcccaaaatataataacttttagctctcaagatttatcctaaaacataacaacttcttcaccaacattctttttccaaccaatcacaatcctccaccatttactcctacatacttttttaataaccatgtcaaactgtaaaactttttatattatgggacggaggagtagctaggagtaacacagtaacttaattaatatcacatctgcacccatatgctcttaactaatgtaatttacctaggattttcaggtggtcaaccaagtaaattgttaatgtgttgcacctgtaaaatcttcttcttccagtagaaaacgaagtgtattatactactccaaacttatatacttggggcaactctccttgattcccgcttctcacacgcattatttgtttcagagcggaaacagccaacgctaacctaactagttaaaccaaaagcctagctttccaagcacaaacaccgaccatttcttcactctctaagctagctcgatgccgccaccgccggcgacgacgccgctgcctcgccgtcgcctcgcgctcatcctgtgcctggcgtgggcgctctggctccacggcggcggcggaggcatcagcctggcagacgcgttccaggcgccgacgccggcgagactctcgtcggggtcgtcgtacgccgtcggctcgcggccggtccccgcggcggcgccgaggtggagctcgtcgtcggcttctgaagctgccgcccggttcgccgacgacaagcggcggattccaagctgccccgatgccctccacaacaggtagaatataagatacatacatgcatcgatcgattcagctagctagacatgagtacgctcgatcagatcgatcgtagctagcaatttgtagtagcttgtacgagcagagaatgtgtgtgtgtcatactgcttggctgttcttccaaagccaactcgatctaaattgccggctatggtgtgttgcacggatcagtgattactgcaagcacggcggccatcgaattgggtgcctttgatgtgttctgtacaggttcctgcagggaagtgtgttcttactttcagtcatatactcatatatacaagaattcgtcattgcatattgtcgttgctcctgttcacaccagcttcatgcatgcggcggagatcagaaacttataatttgccatggttatttcagagagagagagagagagagagagagagagagagagagagtaattctctacttcaaattgctcactgcatcagttgagtgctaatgtactcactccgtttgaaattagttatcgttctaacaaatttcacacaaacctaagagatatggcagattacatagttaccctcgtttcaattcacacatcccattaattttctaaagaaatgagccaattaaagttgtgacagtataactatatcgatgaaggtttttttcatagcctattctttagccttggtttataaactgcaagcaaataacatataaaatatttagctataaattaattttagttaattcatttatttttttatatctcattagccctaactcaaccacaatcagagccgaatttaggggatggttattctcaccccgtaggtattggcaaagcttctgaaaatagataatgatccaataccatagggaaaaaaactgcatgaacttcataaaaactgcaacaatgctgtaatgttattctcaagtttaccacaatatatattattggcttgtagtcaaatcgtcaaatttattataaaactatttttttacatgttctacttctatctacagtttcatatacttcacaacgcattcgaaagatacggttttgcgataattttgcgaatcatttgtatttgatgaaatttacttaaaaagattttatgatcaatgattttggaaagcaatctgcacggtgtatgcacaaaatgaaatcagccttcctccataggggtagtacaatgtcaggatcgatgcctcatcaagctagctctccatcgatgcgatggttaatttccagatcgagcatcttttgtcccgctctcccactacgctaagctcacatgtagaggaacatgtaggatgactatttaatttcttaatgaatttgtacattaaattgagcgttaatcagctgagcgagtgcattattaattggagcaatcatcgacagagtctgcaatttcagacaccaatgggtcaagcttatattaattgcgttgccaatccccatacgtgatcttcatcagggcgtgacgcgtgcctctccagcatgcggtagacagcacgatcagatcactaggccaccatgtcgtcctcgactaattttggtttatggatgcgtttagatttaggttgaaaatttttgccatgtcacgtcggatatacagacacacattttaagtattaaatatagtctaataacaaaataaattacagattccgccgataaattacgagacgaatttattaagcctaatgtttattgtagtactacattgtcaattcattgagcaattaggcttaaaagattcgtttcgcaatttatacgtaatctgtgtaattagttttttctatatttaatactccatgcatgtgtctaaacattcgatttaactggattaaaaaacttgctagggcatctaaacaggtcctatatatatatgtatgtatgtatgtatgtatgtatgtatgtatgtgtacacacactacactagtgctgcctacacgtatatattggtgtaccatttcttcactgataaaaaataaagattaagttaatgtacgtacaacaagaaaagatattagcacgtgactaattaagttttaattattacaaacttgacaaataaatatatttgatattttaaagcaacttccacatatcttaataaggtaaaataattgacaaggatcaacaatggagatccaaacattgtcatggaatcctatttatttttgaacttttagcagtttaaatacttgaagttagtatagcatattaacaaagtatattagttccacatcaaatatttagaagttttcatggtcaaaatgtgaataacgcttgtggcaacttaaccctgaaaaatatttgaaaaatactttcttcgttctaacaagaattaacttattatggctatatgcaaattcatagccataagttattactcttatcatctactatattattaggataaccttaaaattatgcaccacattcgctatagagcctaaaaatttccacattaatcattaaaaaaagagtccaggtagaaatataatttaaaaataactgaaattcagaattgaaaataagcaataatatttgaagaagagcccagatagaacacaatacaagattaaataaaattgagaatacaaaaataaataaattctaaattagaaaaggaaatagagagttcaagacttcgagtagtaatataattttgaaattaaataataaggaatattgaaatgaccatccattagaacacaacacgagtttaactaaattcaaaataaaaataaaataaattctgaaattagaaaaagagagtttaagtatgaataaaatttataaataactgaaattcagaattaaaagtaacgaatatatcgaataacaatcatataaaacctaatacaagattaattaaaattcaaatgaagtaaattctaagattaaccaaaaggaaaatagggtttaagtaggaataaaatttaaaaaactgaaattcggaatataaaaagaaatattgcaaaaatattccatctagaacataacacgagattaattaaaatttagaagaaaaataaaattaagttccagatcagaaaaaaatttaagtaggaatacaatttaaaaataaacaaaatactaaaaggagacatcatccagaactcaataataaaaacaataaatgggtacagtagtagcgtttgatggtacttctaaaaacaataaaacgagaacctgacgaggcaataaattctaaaaactatatggtataattttaaaggtctcaatgaaaatgaaataataaatagaaaccgtgacatattggacaagtaaattaaggggtagcaaaaaaaaagtaagggggtgatgactggtatgacttactataaaactggaaacccgatatttgatttttttttaatatggtaatacaacgagacgactatttaacaaaatttgagaaaatcatgtataaaacaacttaaataattttatataggtgctagtcatgcaattatacgggccacctaactagctagttttgatggagagagagtatagtacctgatgaaaaatcccttctttcttggtctcggactgggccaggctacccctcgcgcttagtgggccgcttctgggtgaatcgagcccaactagacagtgggatggcccgtatgctcgcgttgttgctccgtgggccgtgggccgtggcccgtggatgcacaaaattcaagtgggttgccaagttgggctaagcttgtcaaaatctatgggccaccccaccgtcgctttctccaacttgttcaattgttcgctgcgaaagccccgtgtgtatgtatggataaagctcatactacttcgctttcacataaaaatggttcctcacattagcgaattaattaatgggggatatagtaattcatacgtaagtacgcacttcattatgggtcaaaatattaatttgtccgatcgagcagctagctaacagtacgcaggaaaaaaggtttgtacaggcagttactttatcggtagattatactattagctagctatagctaggagtataattccaaattaacccctttgatccactgatttggacgaaattaaattaatctaaatgtacatatatatataataaccttttcaaccctagccgtttcataccggccatgcatgcatgcatgcaaataaatgtgcatcaccacatatagctagcataagatatgtacagaacatataatcagggataagaaccaatgatgaagtcaattagtactaattcgctgatttggattaattcttatacaagaatactctgaacaaagctataatcgcaacctacgttccggggctccggccgtttcgttaaaagcattattaatttaaaatgttttgacgcgtctcgggcagagtcctccccattttcctgtgggatctgatatgtgtacaaattattgtggaaggattttattatcgagtcacttgttcaagttgcacgtaattaacaccgcctctcttgtagattattcactcacgggctacgacatcgtccgtacgtattgcctgctcttaatgggagaaatgcactgcaacattaacatatcgtctcaaagctaaaactacagttaatgctagctagtaaataatataagcaagtttacatcatttacatacttgcacaattttctctaattaactgtatattgtttggtcccattttctttttaaaacgagacacttctttattatataaaatgtcaataacgttccgatcattttaaaacaatatcatgtatctctactattataaaaattgaacatgtttttaccgatattttggtacgtcatccgtatttgagtcggtttttaagttcgttcgtttttggaaatatatatccgtgtttgagttggattttaagcttgttttcttttcgaagtataaaagagtcatataagaaatcttttgaaaatactcgcatgctaacttgagatgaaatacaggctcttaattgcagctcatgattttctgaaaaaaatatacaagcgaattcccacagtaaattttaccctggctaatccgtataacaataataaaattaaaatcacatttacccgttgcaacgcacgggcattttttctagtaaactaaaaaaaatatgcgtgtagatatgtatatgttgcaatttttttctttctaaactaaagtaaaatgtgcttgtgtataatatgcttatttgaccccgttttgaactctaactaccaatttgaccctactttttgaagtttgcttatttgaccctccttttcaaaaacgaagctacggtatgaccctattctgttaagggcatctaacggtgttgactgaagcacaaaatgtctcttctgcccttactcatttgaccgtattacatgtggaacccacccgtcagttctcttctcctctcctctcttctctcttctctacggattgaccacagggagaggtggccaaaggcgagacggcgagccgacgccggccttggtgatgacgtcgacgacgacgagtggcgacagcgtgttcttgtcctctcctccacgtatccaccacagggagaggcgacaaaaggcgagacggcgccggccctggtgacgacgatgacgaggagtggcggcggtgagtccgggcggtggagctcgagctgcggtcagcggatctggcgccgccaccgccgcctcctccctccttccgcgcgcctgcgccggaggttccaccaccgcctccctcatcccgcgccggtgccgcctcagccgccgccgcccctcagccggcatggatcttctccctccacgcccctcagccgccaccgccgctccctccctccgccccctcagcgccgcagccgccgcctccctcatcccatgccggcgccgcctcagccgccgccgctccctccctccctctctccctccgcgcccctcagctgccgcaccggcgccacctcaaccgccgccgctccctccctccacgcccctcagccgtcgccgccgctgctccctccctccgccccctcagtcgccgccgccgccccctagcaccgccgccacaagtcgagcgagcaggaaggaggaaggagaaagagagagaaatgtggataaggttgggtggatggatagggtttcctaagggtattctggatattatgaatattagttgcatttcttttttattttaaatcaaaacttaacggactagtggaaacagggttagacgggagcttcgttttagaaaaggagggtcaaacaagcaaacttcaaaaagtagggtcaaattggtagttagggtttaaaacggggtcaaataagcaattgcccatatatatatatatatatatatatcttttcaggttctcaaattaattggtcatcgtttcagctgagtcaaagttcagccaaagttttgtgacatgcatgccacagaaaccgtgagccattaaaccattgacatataaagtcaaaacatatgccatgccatccgagaaaacaaattcaagcatgactaaatgaaggaacaagcgaccagctgatcaccgcaccaattaggtccagagatttgtttaaacatatattagttctttaattattactaactacagctgcatcggccaaagaggaggctggctttggcgtatctatccagtgtgtgttgggaggtctcgaggagaggaggatgaaggcaaaccttcccacacccaagaaagccaaaactgcctccaattagatctatacttttaatatttgctttctttgttatgcaagcaatgcagagtcctctctgaccacatggaccaaacgattcccacaccgtggtcaccacgcgccaattgcttattttatgcaggggaatggttcaataaactttctatatagcacagtgacgtgtttgatgggcctgcaccagctgttattatatgatctaattaagtgcgtttgacaccgcttcagttcagctccatctctcctaaaactgaaatctaaccaaacggtttcatctccacctaaaaaaaagtagagctagttgaagtgctcccacaaaatgaactgaaagaagctgggcttaaacaactttacaactccactccatacctaaatgctggagttaaatttagaaattggagccctaccaaatgggccctaacttttcctatttatgaacgattaactaattgtaaaccaaaaacattctacatgatattaagagatatggcatgtaattttttttggtaattttggttgatttgttgatctttgtgacatgtataatttcttcgaatcacaacacaataaaatattgattggttgattttcactatggatctaacttttataaatacaatctttagcgaggatcttccagctttttacatgaactatacaatatgatgacggaatatattgttttgaggtggttgtaaacatattttcatatcatattcatggagtttatttatatatatcactataccacataatggttgtacactaatatgtcattctttcgtcctaccttttttctacatcttgccatattttgatcatcccatctttccactcaggcaccttgcgttcatacacaaaaacctcaatttcaactcaaaatcataggagagatttcaatcggttgctagattggtgggttgaatgattcaagcatcaattggccgtggtaacgaagatgccaacttagatttcagcgatttcactatcgtagctagggttcatggtctatttattgatgggtgatggatctccggtggtgatatggcatatagaggaggttgcgtcaacaaggagctttctttcccttggttgaacacggaattcatgcgtcatagctagagcgtaaaatgaatattgcaatttgatcacctaaagctagtactacacaccaatggagtcatattacttgcaaaataatatttggccggggcagtttagtgccgcgggtatgaaattatacatctaactgaaatagacacaaagtcgtccaatccttgtcttctgaggtccacccaacagtctcagctccaacgccgttcgactttggagctctttagacatgtgtatatgcacatcttcatgtgatgcaactggcagtgtctagctactacatgttaagtttagagaagttctagaagaggggttaaagaattgtggcaatgaaggttcttgcattatgccagttgtcaaaaagtgacggtaccagttctcctaaacaatgttggatgaatactcatattttaaatggcccaaccgattgatctgatctgcctagtatagtcgtcacattggttacttgactagtcttgcctatgtaaaaggagatccttagtgctagttattaattaatataccattacatgttgctcaatatttgttagagaaagcttttaacagtacatatattggactaaaacagcgatataacaatatgctatattaaaagtttaggtgatgtatattttgaaacattttattctaatagcggtatagctagttaaactcatgtgttaagcatgtcatgtaactttttttttctgaggttaatttgtgtgggtcgctgtgctatactgcatgtttattttggcgtgg

SEQ ID NO: 67085 - DNA, 755 bp, Oryza sativa
tttgtgaaatgtgtaaaactatatgtatacataaaagatatttaacaataaatcaaatgataggaaaaaaattaataattacttaaattttttgaataagatgaatggtcaaatattttttaaaaagtcaacggtgtcaaacattttgggatggagggagtatatgctaagaatcataagctccttaattatggtatgctttgccaggagagttctaacgtgtatagcatatatatatatatatacatatatatatatatatatatatatatatatatatatatatatatatatacgacagtcactctatgtgtgaatctcccgcatatatatagcatctcatttatcttcagattgctcgtaatgaacttatgaactccaaactgcgtatgctaatttatatatgacaaaataaatattaactccgaattccgcggcttcgaagttgatccctactcttgtggttgcaatggcaactcacccccggccccaaaatttctcccctcgcgcacacattaaacgcaaaacacagtctcctccccctcaaacaactcaaacactccctccctatattcgcacctgtcgccaacaaataaacaaccccctctccccactcccctgcgtttttggcggcacgatctatagccctaggcccgttatctctctccccccccgaaactttccgcaaatctccccgatccttccttctttcctgtcaggccctccttttccacccccccccccttccggggccc

SEQ ID NO: 67086 - DNA, 2210 bp, Oryza sativa
aagaaccccaacttcatggaatgaatgcactgttgtttttttaaaaaaaatgctagtgaagaaggttcaagctgtttgtctgctatatgtggccttatgctatttaaataagccaccttgaggccaacccacttggactaagcttgtggggtcttttggcttaagttcaagcacctttacactggctcctgctatgatgaaatagcatcccttgcattcttgattggtatcgcatataatagcacagatgcatgacaacatagcatgaagtgttcaaattcagactatagaacaataacatggctcaacagcacaaagacgaggcaagatacaaaatgacagaaacaacattttccaggaaggtatttttatatatgacgtaagatgagcatacctcaagggaagagtatagttcttcctcaacacttttttggatggatgcttctaaggacaaagcattagcttcgctataccctgcggtattgtatatataatctgtgacactgtgagtaaataactcttcggatgatggtgcatttgatagcagttgcattccaaaagggccctgatcatagattatggttaataaaaccacaaaagtatctctcaaactgtgaacaaaatcaaaacttatgtaaaccacatgtaatgaattaaattaccattgcatatcagtaattttgtactggtctcgattcatgattagccatctccttttaaagtagtaaagataacaaatccagcaatatttccatgtttatggaataaaaacctaaaacccaactaatgtcatggggtagggttacaaaacatacaggaaccagcacaaacaatatattggtggtaatgtggcatgtgaggcatttttgtttgttcactattatgtgttgtctgaagttaaaatgccacaaagcgggaaattttgggagaaaactccttttttttttcatgccaagatatgaacagtaacatgtctagggttatatgcatttttctaggcgggtcaaaccctgtgcagtaatacagtaaaggctatattacacaggacaaaataaaaaccaaggattaaattcgaaagtgttacatgctgttatccaaactaaagacaaacctgttcaaatagctgaactaatcttctaatagactttgggaaccaacatgggagcatttgcaacaatgaagtgtctcctccagctgaggaaaaaatgttatagcgccagcgcaaatactctgaaattggtgatttcccaaactctgaaaaggaaatataattcaatttctgtgtagcacatagaaaacaagaacattctaatataaagaagggaaaaaatctgtattttgtttaccattagttggagaacagtttaaacaaccatacccatcttgcccaaaacaagaagaaagaagggtcttccatagtgttggaaattgctgaaggtgagggcttagattctctaatgtgcactgagaagataccccacgatttctgttcacacttccagtacatatggacttctgaattggtgttgaagcatacatcagggttgctagagcagacatttccccgattcgttcagccatatcatcaacagtgtacagtatttcatctatctcaatagcagcaagattgttatgcctaaccatttcctgtgacagattccaaagtgcattacaaaaggatgcctcgtattcataacctttgaccctggagaagagtaaccactgcgcccacttgcaatcaccctgaaaatttcatgacagagcagctaggtgaggcttactcctactataagttataatgaagaaacaacagacaagcatgttaagaagcttaatcttacatctatgatgaaaggaagcatgccaagtacttcccgtaccacaactagagtattgacactattgaccataaattagccataacagtatgcatgtgtctctagtatcaaagtagctataacagcaagtctctactatcaaagtagctataacagctgttcctagtatcggcaagtaaggcaaatctttagtcagatagatggaataatccgctgtagctgcaggctaataaaatcctgggcattatattaaggcaggcttcgtgaatgcaacaatgttctcattcgaacggtgctagcagtttctgataataattggtttactgggtaccgagctcgaattcgcctatataagtagtcgatccatcccgc

SEQ ID NO: 67087 - DNA, 737 bp, Oryza sativa
agatcaacaatgggattttttggtaattaaggttagcttttattttcctactccttggaaagaggtatctccttcaattttataaattcaatccgggggttgcacatcagttctgtttacagctcaagcaatgtatgcgtccacccatagagcgctaggggcacggccccctgaagggttaatctggcgtcagcggctccccccctaaaaacgcgtcgtccgcttaatgacagaggcgccggcaagttcgtcgagctcgagactccggcataattcggcggcatcggctcgagattcagccctagccagtggcggcgaacatatgtggccaagaatgacagatcggccaataacgtttaagtgttggttatgaagccgagtgcgcgccgggaataaagatacccctggatctttactcccggatgttgagaagaaccgggactaaagatatcaagatatctttagtcccggttattctcaacaaccgggagtaaagatccaggggtatatatattcccggtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatg

SEQ ID NO: 67088 - DNA, 739 bp, Oryza sativa
atagcctataaattttcacatttatgcgtggcatatagcagctcatgctccatattgaaagacgatggagctaatgcctatattcatgctgaaaaaatcatgtgtattttatgaggagactagtgtccatttagagctacactttagaagtggttgaaattcggtgtgaccaaataatgtatatgaaaagaggagactctagtatgtattacacatgagtagttacgtaaagtgattggctagtttaaaattatggtgcgcgtgtcatatctttcaatgatattatgcgagaacatctatgctattatatcatagaaaatgtgatgatgcttgctgcccaatcagcacgggccaccgtgctagataaacgtgcattaacagtcggatgtaaagataagactgtacgtactagtgcactgaactcctatccatactactatgatatttcatgagaccgctcacgctctctagtccatttaatcatgattaaagaactctaacccgtctcgctctcttggataggtatgagctgaaaccgatcgaatattgagatctacttctagagctactaacttttgcttaataccccaccggttactgaaaactcgtctacgttatattactaggatacgtacaacatgcgctatatgtaagttattatcaccagccttactaactaacttcactatgaatacggtgctaacctaaccactgtactgcaatagtagtataatattcc

SEQ ID NO: 67089 - DNA, 29639 bp, Oryza sativa
tccttcatctatgcagacaaattttgatgtcggcctagtattttttacctaacttgttatggaagaccatatactactatgtataatcatctagctagttggatgagatacacttgatagtgcagtggtaatgtgtgtggtttcaaccgtaagctctcgtgctaaattccaacatgctcataatttcttaaaaaaatgtttggagagatgtttcttccttcaagtcttcttttttcttatccagctggaaacggagtagtacagtagtttttcatttatcatatgtgtgcatgccaaataatcttgcagtgcacaccgctttcgacgccgtccgagaaatgtccggttaaatccgcacaaatatacagtgtctgcatcaaatgtaaagtagcagctatagttggtgatgcagtaccattggcgatcgagatacttaattaattaactagttggcaaattgtctaaacaaatgctttatgcgcttcatttgtcagtcttgttctcctgcttggaggtgatcaaaccctagctaacttttccatttttattgtgcaatttggcctcccattccgcatacttttgccatatacactgaacctctccctgtgggggcgccgcatgcaccaagaaaatttaaagttgtccatctctctctctctctcaatttgtttctctctcttagcaagctactagacacacaccaatgctagaaaaaggcttgtctttctttctcagctgcttgtgcatctactgttaactgtacacacacattaacgtggacaaagaacaactagataaggtcatgtgcatcagagagagagagagagagagagagagagagctagctagggacagtcagatcgaaatcttttcaagttccaacttctatgtgaacccctttaccttggaggaaaattttctagtactggatttaattaatttctttgcctttttttttttggttctgagaaatatatccaatcaagctcaagtatttagtcaaaatcccatagagttatattttggtaatttatcagaaaatttgatatgtttgctatgtggaaacaaatattcatctacatatgaaaatttaagtgtgtgcatctgcatcatatatatatgaactcggaattatttctgttaacaaagaaattcgtctatatagttcctgtatcataaatagcatgcatgcacatatgcatgacgtacacgaatccctttcaggtgctatatatcggtatcatagtcacgcaagcatacatcaaactctctatacatggaaaatattgatctcaaactaaaaaggataagagatgaaaagagaaaaatgaatatgacagtgtatagaaaaaaaagaacaggtggatgattattacatcgatgtctccaatattggaagacatcaaatacacactagctagctcctatgaattaacacctaattaattgacacttatgaccgtcaaaatactcctcctgatccatatatatatatttctctatcagtatatgtccattggaaatttgatcacaaatatttaggtatatattgatcggtcattgagctgctactttagttgagatcgccaagccgagctccaccggcttctccttccgatgatcgtgttgctgctggctgccgccgtcgctgtccgccggctcggtcttttgcaccggcggcggcggcggcggtagacctaatgtgaggtctaggccggcgtcgtgcacctcggtcgccgccgacgtcgctctcggctccggctccgactggctgacgtgggagccgtccacggtgtcggccgtgtcgttgctgtggccctcgctctccggcggcgcggcgtcgtggctcgccgactcgtggctgagcgccccgggcgcccagttgagcggctgcgcctgccttatcacatcgacggccatggcggcggcgggcttggagaagacgagctcgaaggcggcatggtcggacctgtgggcggcggcggcgccgccgccgggcctcttgaacttggcgcgcgagctgatgtcaagccggtggaggtcggcaaccgggccggccgcggcgccatggacgtcgcctctcctggcgccgacgtggcggatgtcgcaggtggggagcgggggcacggcggtggcggacggcggcggctgcgcgatgggcatgccgcggaggacggactcgacggcggactggcaaagctgccagttccccgaccagaggaggccgacggatccgtacaccgggttcagcatccgcccgcaagcctcgtacagcagcgaccggaatatggctgcacacgtacgcaacccaagagtcagagaacgaactcaaacgccatggccatgtagctagctagcaacaagggctaagcacacgtaccaggacggacgtgctcggggccggcggtgatgaggttgatgaggccggcgcggccgtagaacttggcgaggaagacggtggcgttggcctgcgcatcggggctgcgaatccactgcaggcaggggcggatggcgcagttgtcgctgcaccccttgcgcagcacgcggcacccgttgcagctcatccgcatgatcctcgcaaactaacccgcgcggctcgccggagacgacgaccggtgagatcgagctagcaatgccgagctagaggtagaagaaggaggaggaaatggtggtgggtgtgtgggcggagaggttgggtgtatataaagcattgggaggtggagccgtgggttagctcggcagcggactggaaagcctccggtttccctgggagtggaaagctggttttctcccctacatgtgatgttaccctaatgcccctcacttttccatctcatgatctctctaagcttcttctaaaacttataactaaactttaattacttagataattatatatacatactaggtatgtgatggtgatcgatctggctgaccaagtggtcctaggttgaattaacttggttataattaatatatatatatgggagttgaatatatattgtgtacttgcctcaaaaagaaagggatctgacagaaggttctgactaattagaaacccggtattaggaggaaaaaaaagaagtcatatgtttactccattcaagctatagtagtagtactgctatagctgttgcaatatgctgacctagctcggaatgtatatatgacatgaaaaccacctcagtgtagcaaacagaaaactaaatagataagtgtaacgactctagaacgaagcttaatttacttgattagctgtggtcttgtcaaatcatcaccttacttctcaacatttagttggttttgacggtttctccgcgagggataacatgcgcgtttgctttttcttcttctaatataatatcccctatgttataattattcagttttataagaacaaatcaactaagtgtgttcttgaaaattccaacagtagtaatatagtagctacgactctcactagccttgagcaataattagggcttgatttctaggtttgtctctttaatatcttttacgatcctatctaaaaattttggaaatacacagtaattaagatgccctataagccctatatgcttggctcattatcttggcttaattcaccccctggtttgctccctgaaattaagagtgaacatacctcaattagtgtatagtgacatgtttctcttagataactccgcgaagatgaatgattcttcctcccgctcaacctttaccatagctctagttgacattgtttatggtcgagacaagtacggtatcagatctccaagttcataccatcctttaattattggacttaattgtgttgtgcttgatctatcttgttttcctttcctcaagactcaagagagataatttccttaggatcttgttagtctcttggatcacacttatttgaccattgcatttttctgattatttgttattggataaattccttattgattttgggcattaacatggactcatatatatacacctgtattaatttggccattaaccacttccctagttgtatgtttgtagctagaaaaatactaaatatttcccgcaaaaaagaaaaaaaactaaatatgatgataccaacatatatatttttaatgataaacctaaaaatcatttcttctatgacaaaagaaaaattttctgtctgtgctttgctgcagataaaatgtatttttcgtgaaatgttctacctgtcgttttgctatggaaaccatttatcttaatttgattctaggaatcactatccatttagattgattgtttttaatatagagttcaggaggtgatttaaaaatttacaataggagtagttggggtggtagattcactactaccaccactagagccttttaaaatagtatatatagatgagcggaagaagttcaaatattgatgttggataataaatatatagtcgcaatgctaattaagtaaaataatacgtatgagagcagagaaaatgtcaaaacatatatatatatatatatatatatatatatatatatatatatatatatatatatatatagagagagagagagagagagagagagagagagagatatagatagacacacacacacacacttcctgaaagttttacaagatcgatttcatgcatatatcctaatacatagtagaaacaaacaaaagtgcaccatacacgcacacacactggcaggcgcatcacattaatataatacacatgctcagagagacggtatgcaaaagaaattcactaaagtcactaaatgtaggaaatgttttcacccctcgagaggatgtcttatcgtttcttgcatgcatgccacctaaagagttatatttcttttaaaaaaacacaagatagattaatatgaaatatatcactacacaaacatgcaagctcaaattcgacttccaagttgttacaaaaataactgcaaagtgtacgttaactagttgcagtttaatttgttctttttacaacttgtgaaagtcgaatttaacctatgcatgtttgtagagtgatatatatcgtattaacctatattgtcaaaaaaaatatgttttttactatttaggtgacatgtaggaaaaaagctagcggatgtcgaaggatgaaaatccatatcactaaatttctactgaaaccacaacaacaattgtgtaatatctgttggtacttggcaccttgaatggagtcatatgaagaacttcagtcaatcggttttgtacaatgcgatgaatacatccaagcaaacaggaattgtggagaaaaggggattatgactgaaaaaaattcagacagttcgatggtgatgaaacctaactgtcatcagcatgcatgcatgcatggaagggcacaagctatatatcatcataaaatagttccagatggaaccacatggtatcatgcatgcatatgcattactagctagttacagcattaagcagcaggcaagaaggcaagggcaattaggtcaagcaatccgaggatagcatactaattataaatccggtgcgtgtgggggacacatgacagcgcgtggcggtggttgtcagcgtcgtcatcgccatccatcggcgggcgaatcgcaacgctcgtttccgggaggaagtgcacgcggcgagaggagggcggcccccagcgacctgggcgtggggcccccacggtatagtcgtacgagctatagctaggcttaagtgggccccacgcactggctggtgattggtggaggtggtcgtcgtacgtcgtcgtcttcctcctcgcgcacagccaccaacatctgtgggcgctcgagagagccgattcgatttccatgggcggttttgctaacccttttcttttccttttttttcgatccaacttggtaggaggcagcgagagtctctgccgtgcaaatcatatcatatgcttctgtgggggatagcagctgctaaccattcatgcatctgccctcctccgatcccaaatgctatagctgcgtgaatcatgatccagttttacgtgcgtttcagtttggcacgcttattttatgttgggaatcaagctagtacctagctttgatactccctccgtttcaaaatgtttgacaccgttgaatttttagcaaatatttgaccgtttgtcttattcaaaataattcgtgaaatatgtaaaactatatgtgtacataaaagtatatttaacaattaacgaatcaaatgatatgaaaagaataaataattacttaaatttttttaaataagacgaatagtcaaacacgtactaaaaagtcaacggtgtcaaaaattttgaaacggagggagtatatagatagatcataggcctacgacagtttaggttgagagctcacatcaccggcaagttgaacctccctaattagtaccgttttatatgtgtgtgtcctctctctgtgtttaattaattaactttgtgtagtactaagagaaattaagggggtccccgtacgccatgcatctccattggggaagctatatagttacaacttaaaatggagaatcctaggagcggtcgtacgttaatttctcttgtttaattgttgcccttcattaattaattaacaaaaccaaatgtttttcttatgctaatagcttgctcgatcacactgtacgtatatataccaacgatgtcattgtcgagttcttatagcttgctaactagcttcaagtggtgcttcccactcctagctagttgcatttctcaaaaatactaacaaagactacatgttcacagtgtaatttgtacgttgttttcacttacctcatcaagcttcaatttcgcgccgtcgtttatctaaaaaacgatatgaccatatgcggctgattaattgaagtttttaccgttctttacttaaaaaacaatattcaagacattaattactgatcaagattaaacaataggcttgaacaagcctatatatagaataaatccaaataattaatatattaattatagatgaaaaatcgtttgcccttccgcttatcagccacaaccaaaatttattttttttctaaacttatagagttgattttgatttttatcatattttatttttagtattagcttttaagttactaagaacacacatatacagaagttttatgcattaattaatttttttttgcgaatcgaatgtagcttaactgattagattcttttggtgaaaccagcccacccaaattcaaatcctagattatttgacatgggttctcacatttacgtctaattattattttttaatggtacttgcgtttgtaatgttaaaaaaattatttttaagtcgctgataatcaggccaaacgatatagcactactacaagcttgttcgagcctatttatagaataaattcatcgatatgtgtatccttaaaataacagacaacttctaaaaccaccagtagtacgcgccgcgggaggatgtgcttaactaccgagattgcatgtgattcgatccgtttaagattcccgagccctcattagttgggtattttaggtcatcacaccgtgaatccaaaccttgatgaaggctccatcagcaaagaaattgctagtttaattttgttgtacgacacaagaacaagtggtcgatcgattagattattagcacacatatcagagacaatgaaccaagagtgtagtacgtacgtagtacacctcatattgacccggcgatgtttttgtggtactagtactgcatcccattaaatttgccacttgctcatatacaaattaaagattaattaacaaggaagttgctgatttataaataagcctttgttatgaccagacaggtacggcgtacttagggaaaatgggaagagatgccaaaggggggttcagactaagaagaatatatatggcagacaggctttgcaaattaagtggaactgttgcttctccgcatcccccaccatgcaggcatggatgctttttgttaattattcggattttatttgttcgcatccgacgttctctgtccaattgcagcacacgtatagggccgtttcataactttgctctgcttgtccctccatcccgttaataaaacaatctaatatcgaatgagacacactctaatattacggatatgaacgaattatctttttatattcagaatgtaggatatgtcgtctatccagtactaaattgctatctttacagacaggggtagtaactttgaactatttattagctttatctgatgagaggtttatggttttgttacattcgagcctcttcattttatgggttttcctaactaaggcttctttatcgttttcagctagcacgcttttcgaactattaaatgatgtgtttttttttcaaaaaaagtctatatagaagttgtttgaaaaattcaaataaatttatttttcaagtttataattattaatactaaattaatgatgtggttatgagctttctagttttgcgtgccctgaaaaacataaaactcatcctaagccccaatgaggtatatatgtattcgtaatactatgatgtgtctcattgggtactagattactatctttgagacgaaggtagtagacactgaactattcactagctttatctcatgagagctttcataaggtttcgttacgtttgagacccttcattttaggagttttcctggttaagacgatcttggactaaaaaccgcctaaatcttaaaccatgtccaattagttaaatccatgggtagtgtcatttattcaagctacaatacgataaccggatagtaaaattcaggaaattagctattattatgtatttttgcgtggttgcaatttaattaccgtaatagagttcaatcctacaccaaaactgcgcaaacaataatttagggggtactatatgtatgtacaaacacatccaatattttaatcatttagtaaaacaatatatcatatcaaaagtggacataaaatatttagctgtacccacaatggttttggtttaaaaaaaagctttagctgaagtaacttgtcaatcaatcaatatatatatatatatagctcaaaattatcaacttacaaacacacaattgttaactacatataagcaaattaagagacatttgatcggaaactcaaccagagtaaagagctaaaataaaatggaaatgaaaatgaaaaaaacatatgcataaatactctgaatatttgagggctatttaaatgagaaaatagatttcaagagcttaccttatattgcttatatatgtaattaaatttcagatattttgagggttcatattacttatatttgccttattatcttacaaaaaaaatataatggattttcttttgttggaaactcggtgcacattgttttttttttgacaagtcaaattccaagttcaactttcataataccccgtacttctcaaattaagttcttgtaaccactgtttattatgtaaaaaaaacacatttatatcctgtagaaaacttatatgcaaacttagataaatgctgtgaacttttaatgttgcaaattaattaacaggcccttaattaggttgacctttgtaaaccatttcattatctaaacaaaatatatagttcgaccaccggtacgtacagtgacgcccgcacattatacgtacatggagtacatatatatgtacgttagaacatcactaccatgcatgttgcaattttctccattaaataaattaaaaggaaaatttcttcaaagcctctttcttgatttgatgtgagtagtttaagtttctgaagcgtgaggccttgcatttgggctaatggtactgaatggcttacatttattaggagaaaaacctagctactactacctccgttccaaaataagtgcagccatagaaatccgtgtccaacgtttgaccgtccgtcttatttgaaaaatttatgaaaaatttaaaaaaatttagtcacacataaagtactattcatgttttatcatctaataacaataaaaatagtaatcataaaaaatttcaaataaaacgaatggtcaaacgttggagatgaatagtgtaaaattacacttattttgggacggagggagtagtacggtaaaaaggcatagggacaataaacaaaataatctagcttggtttctccctaatatttgtgcctccacttgtccaatatgcatgagctgtgtaatataatgtgaatcgcatggtacatgcatgaatccatcatatcgaaaaaaattaaaaaaagaaagcgcccatggttttgggtaatcctgttcgtagcatcaaggtcaactaaacgtacgaggcatcaatcaatataattcaggataagcctaataccctcttccttgcattattccacgagtattgcctactgttttgcaaacatatttccatgacgagttcccactaagatttcgtgttgaatgagaataatatcataaaattcatgagaaacgaattaattatccatccagaacctcatttagatccgtaccactaactaaaactatttgaatagtatgctgttagtagccgcatttaaaataaggattaaacaaaatttcgatctctgcattccttgcaacatggaataaagaagaaaggtgcacaaagagaggagccattagataaatcaaagacttctagacctaggttaatttaaatctagccaggcacgcacagtgcaaacttgcaaccgctcaagaatctaagaaaaaaataattcgtatgactacgtcgtaccctcataaactttgtaggtatatagtttttgtacttacgtgtaatcgcacagctcatcaatgacataatcctcgaccaatgtgtcatttgatttgaggctctcccgacgaagctgtgtgcaaagttgcaatgcatctggaccctcctccggcctaatggtggtatatatgctaacctttatcaaccgcccacttgatggctactccactctaattacgttttatttactgctactagtcaatgtgatcaatgatatttttctcaatttagaattgttggattagattaacgagaaggcgtgtggtctccacgcaaaattgttccacgcgcgtcgtgtgccaggactactaaattggtcagcactacagtttaatttgggtaaatggtaggtagcttacatgatcaatctgatcgaccgatcgatcgagatcagcttttgacaaccaggttaatatttagcaattttgagccatagttatttcattgtttttttctaaaatttgacaaggaactaagttgccaaaatattttttggctagattgaggacttggagttactattaatagaaaagaagaatataggagggttgaattggtgggacttacagctttattactagtaatcatgctttgctggtttatcttaattatatttttttacatgtatcttaattaatcttggattagggagtattcactactagagaacaaaccttttgacgtagtacccaaaatcacaaatacctcggttagattaaaaaccagtactaaaaatgctttagtaccggttataaaagtccaaatccctagaaacatctttagtcctagttgatattaccaactggtatctttactatcggttggtaacaccaacatggactaaagaccagtagtaaagcctccagggttagttcaaaagtaaaacatctcttcaagctagatgtgtgtagtaggtgagttggttacgcgtgtgagggctgaggtgagagatcttgagttcgaatcccatatcccacatatttattttcacttgctatgtatcggtactaaagattttgaacttgagtcccgatttgctcgtctcggttgctacaattggtagtaaaggagttgtaaaccgggactaaaaatcgtttcccctatagtgattgaaagctttggcagagggagtttttaaacccgcaagcactatatatagagtaggtatccgacacacacatatatgtatactcataaaagaaaatattatacacggtacacctagctaggtgtatatactcatccttttcatatactccctccgtcccaaaatataatgagttttggttggatggggtatatcctagtactacgaatctagacaaactatctatccagattcatagtactaggatttgtctcatctaattaaaactacttatattttgggatagaggatgacggagcgtggggctcctcaccgggagaccgcgcaggcccccctttgccggttcggccgggggcgctgagtgaggttcttcgccctcgatctgaggaaagtcagcgggagaggaagtgcacaagacacgggcgacgtagacaggttcgggccgctgagaagcgtaacaccctactcctgtgttctggtggatctgtgcttgaaggaatacagagaaccggagagcgagagtgagttcaggctctcgcccctcttccccagagtcccaaccccctttctcctaggcttgggcctcctttttatctggtcaggggtcaccacatgggcctctagttgcctaagaagggaaacatgctttttacaatgagggctagtctacagccggaaatgacctctgacaagcagagcacacgcctcctgccccgctcgcccgctttcccggtggacgcccatttcaaccttcatttaatggccagcgacttccttgccatatttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggatcggataagcgtgcgctgcgccgcattaaatgcgacgtggcgcgctcgtccaacctgctataaatgcggttaggtgagccccgttgtgctcacctaacccacacacgtggcgccaaaaccacagggggtcggggcgccccagccctcggggccgaaacgggggcgccccagccctcggggccgaaacgggagcggcccgacccctcggggagacagagggaggggtggccacgtcaccctcgggcccgacccccccgagggggtcaggccacgtgggtgaccgcggctacccaagtctctagtcacgatacccccggccccatgtcaccgacagaggaagtacaaattatacatttacccatgtgagatatcaatttgaactttaatcggggattttactatttacgctagattcacattgagttggcttggtgcaaatcaacattgagagggacgagtttgcacaaatgaaattttaggactaaaccgacccaagaaacatggcatttgcatttctatccctgttttcaatagcaaattgtgtgactttatctttactcttttaaccttatgatttttttcccttgttgtatgtttgctagtctatctatactccttataaaagggagtagctagcggtgatgattgttctgtcaccacccgaccatcaattcccaactttcttttagagcgaaaatggcatgtcggttagaggacccacgtgtcaaccaactcccaacaatagccgattggaataagaacgtggagcactactacacatattttttttaaaaaacaaaaactcttacaaataataatttcaacaatttgattaacatagatgagtggatatctagtgatgtacccacagcatatataacacatcagtgttattaaaagttcagtaagaaagttttagtatgtatagcctttttcgtcaagaacatagagcatatttggtcaggtttaattcaattttaagttcggacttaactatatatgtacttaattatatatgctatgaacgtacgatgtctcatcagctaggacgcaaacatccaaaaattcagaaacagacacacaattatttcggggaaagtaaaagtatatatgctctgaaacagtaaacccatcttgttgaggacaaaatcgaactaaaaatacatagaacaaatcaagctgtccaacaaaatttggggccccctcgctcgagacagaatctcctggtgttcatggcgcattccccaatcagatggcccgatcgattggtagagatgcaatgcacctaataagcacttggattccgagtgtacagggccatcagcaactggataccaatttatttatatatggtttagctgcaaatgattctaggacacttgccataaaacactagttttattgctcaacttgtggcaaacttgtgtgctgctggggctgagtgcatatgcaagtgttcatcctagttggcatgatctcatcaagcttagctcgtggtggtgattaattatatctagtgcctaattacacttcaggctttcctagttgatcttgcaaagcagtagtatatactatatgtgggaaaattaaagttgttcccatggtttcgaccttcttttgaaccaagatagcgtgtaactttttgtttctcgttgcttgattgagaaattataatttgacgacgcatgatagagagcgtgaattacgttgtcacacggatcatcagtccactgacagcccagttaattaattacgtaccggtacggtccctgttttcaaccggccgtcgatcgctcgttcctgccctgttccaagtcaagtggccacaattgttgacgacttgagttaatttgataatgtgcattaaattatgtagatcaagtgcttaattatgcagggcttttgctcccattcttcgacagtaacaggccagttactgctggttttagagcacgtctaactctgttaattttatactgatgaaagcccaacctgcttattggttaatgattggttaatcgatatgttaattgaacgaggtaaaatgaagcactaaaaggagaagaaagacatgtttagatgtgaactaggaggaaaacagaggggaattcagaaggacaaaagaggacttgaggctcaataaagcttttcgcaagtgggctgagaatgtagggcccagtgaggcccaaatagactaattgcgcaacaatatagcccacttgaaaattagcccagatatatagcacaaaatgttgatggcccagaagtttattactctatgttgggcttattctgtaaccgggcctaataactccatattcggcctatttgactatttctctaaccgggggcccatttcgcaagcccattttctgattcatgttctgattctatgttctgattctattccgacattgttgctgcatgatagcgtgttctttgacctacttatgcaagtaaccaaaatcataatggtcagaagatgctctcgatctgctagatatgttacgtactaccactagctggatgatcatatatactgtcaaattaaagctagctatcggcggtgatgagatgatgagaaaatcgaagtaagagaattataccaaaaccccaggtgatgaaacgcatataggcttacctcgtaatgcaagtaacttgagacagggcatgcctcctttgcctcacaatcaaacaactaatttaaccactgtttaatgcttcttctgctaactctcctctcatcaacagaatcatctgaccatctttatatcacgttgggccccatgcttctctaatcactcgatctctcccagatgctttatgcaaagcctatataaactttgtgttgtcccaaaccattcgcccgatttgatccacatcaccactttggttcctcccatttttcatttcaaagtgatactaataagcaagtgcaaggatagctagcttgacagtgtggaagtagtagtaggagcaagaggcaaattaaggggaagctgcaggtggtagatgcgtaatgcgagcggcagcagctgctgctctcgggtggcggcgccgttgcatgcgcaagtgcttggctcgccgtctccttctcatggctacggcggcgccggcgacggctgtcttctgcaggcacctcccccggcagtcgtctgcggggagatgctggcactgacgacgccggcgccgccgtctcttctccatgcactggcctccctcaacgtcctcctcctcgtcgcctacctcctcctcttcctcctcgccaagctcgccgccggccttcaccgccggtgagtgagtgacagagctagcttcagttcagagagatctttgtgccattaattgcatggacgtgtcacatttttactgtgcgtatgtatgtagaggccatggtagctgtgacgagcaccaggtcacggagacctccgggagggaggagttcgccggcgccgacgacatcgccggagtgcagcagcagcaagcggagatgctgttctggttcgacgaggccgtgttcgaggacactgctctgcttggtggcgaaggaaaggatcagctcatgtacgacgctgccaccacaccacctacacctacacctgcacgttgcttgcaggtggagagcacctttcccatggtggaatccacccgacgaatctcgccgcaccatcgccagtgcagcttcagccatgaggagcccaaggccgccgccgccgccgccgccgccactgcgtcgagccagaaggatatcattccggccgccgtgccatcaccggagaacgttcccgtcgaaggtataaccattaattccactaacctctattacttcttgttaaccatgcatttcatcctggttctgacactcgtcgtacgtggttgcagccggggaagaggacggccatggcgaacacggagaagaagacgatgaggaggagaagaggtttaggggagatgacgtgaagctgttcgtgaacagccgggcgctcgccgacacgaagaagctgcttctggagggcgccatggccgggaaaggaggagtgcagcgcgagcgcgaggaggagagcaggttgggcgcgtcgacgctgacgagcgagtcgacgtcgaagagctcggtggagtggcggagctcgacggtgaccaaggactcggagacggagtaccccttctcgtcgtcgtctcgccggagctcgtcgcggtgggagtcgtacgctctcttccgcaagtacgacgaggacatggtctacttccatcgcgtcggcgcccagaagctcaccgagacaggtacatactaattattcttccaaaatcaagtcatcattaccactcattacccaagctagattaattaaacctttctcgagaaacataaacctcaatcaaacgacgcaattccagctccctgcaactctttctctacacacaatggggctcacacaacaaaaaatatttacagaaagtttactgatcagttgcgtttgctggaacggttaatttgcagagtcgtacaggtcgataaagtatcagccgcgatcggtgtcggagcggatcgtgcagaagctgacgccgaagccgcggccggcgatcgggctgagggacccgtacccggagctggagcgggtgtacgtggcgcagatctgcctcacctgggaggcgctcaactggaactacgccagcttccgccgccacgccggcgacatcgcggcgaggtgctgcccggcgcgcgtcgcgcaggagttccagcaattccaagttcttcttcaccggttcatcgagaacgagccctacgagtacggactccgcccggaggtgtacgcccggatgaagaactcatcccccaagcttctcctcgtcccagagttcagaggtaactaactaatttctctgatggaattgaccaaactttattgttttgttagctgatttagagtagctgagaattgagtagtgcgttgttaatttttgaaaatattgcagatgaggaggacgagaaggacgatctgatatcggcggtgcagttcttgtacatactggaggagtcgatcagaacgttcatggcgttcctgcgtgcagacaagaggagccactaccaaatgttcagagaaatggtgaagaggaggaccagctccatggatcagactctggtcatcaccctcaagaaggccaacaagaaagtgagccacataaataaacatcacacacaatgctgatcagattttctttcatcatcatcattaattccactttcttctcattgcctgaaaatgaaatcttcagaagaagagccggctcaaggacctgacgaggccaagacggtgtctgaggaggacgaagctgagggaagaagaggagatgtcaatactgctgggcttaatcgacctcaagatcgtggccagagtgctgcgaatgccggagatcaccgatcagcagctgcactggtgcgaggagaagatgaacagggtcaaagtcgacccggctcagggcaagatgcagagggacccgtctcctcttttcttccctgcacattgacagcagcatcagcagctgtaactagctagtccctgcttgtaatctactacttttttcttgcccatctcctcttcaaatcttcctttgttgatatagtgagaaaaagataaagttgcatagacgacatgagaatatgcatggcacgcagctagcctgatctagttctgtaaaaagagagtcagagatcgatgaagagatcgtgtaaaggcaatatatgtgtacttatgtatttatacatagtagataaataagagacccacatcaatcttgtagttgggtgcatgtgatgtggtgggggtgagatactataaatttgatcgttgcatgcatgatggattttggaatctagacgcttcatgtcattatgtatataaatccgtgtgagtgtatgtgacacaatctgtgtgtgcatggaatggaaagcaaaagaggtgaggtggtgaggatggagacaagcacagctttgacaatgctttatctttttcatgtgttcttctctctctgctttataggctctcctccttggatcacaagatgatgatagcaacaaatgtcacactagatttgcctcaacattttaggataaccacatcatcctccttttcctttttattttatcttttgttttttttcctttgtggatgttggcactcttatgttatgtcatcagggaaagcagcctctcctctgcataacaaaaggaaacagaagattaaagaggtgttctacaagttcctgacttctctgtatccaactaaataaaatcatccatgagctttgtgttgtgctgacctgcatttagatatgtttggtgctgcataaacaaaccaaagattacgccgaagtgatcatttatatcccttttttacattggataagctcttgacgtcgattgctacgtgcagagtcgagtacagagatggtccatggtgctcttgcttttggcaaagaaaagattagcagagtcagaaagtggctggccactgtaaacaggtcaaaaagagtgggggaaaagatttcccactgacaaaatttggttaccaagaacaaagtgaacaacctcaacaaaatcaaaacgaacacgttgatgatgcagttttattttggtttgggctgagttgtttcaaaataggcggggcctcttggctaatgtaagataatatatatagaagttgttggcctttggcaatcaaagcccacaaatttcacaagccagtaccgcaggccgaaataagttcacttcaactcccttaactgggggccaaatctaattcgtacctctgaaccacaataccagatatctcgatccccaacaattaaaaaaaattcaatttgactccctcaacaattttggagagcggttttgctagtgtaaccctttgacttggtcaactttgtgctgatgtggcaacctagtcacacaatacaagtgaggcccacttgtaagtgactaggaaaaaaattaaaaacatggggaccacttgtcaacccctttctcccctctatttctccgaacactccacgctcggcgatgtgctgcggcgttggcgcgacttctccccatccctcgcagcggcgagcggtagggaaatgtaacgctccgctttttgcgtgacgttaaaaactaattcggcaaaatcctatatgcaaaaatttcgttctttgagtgagagtctaagtcgtgccatggatctcaattcaatctccatcgttgttccctctcatcaccatcaaaatcctccacctcaagtttccaatcccgattcaagtttccgaaatcaaatcctgaaattcaatcgcctcctttgaatcctcgccaaatacttgtcccgattccacaaatatccgagtccaccttgaatccattccttgactcctccctgtttccctgagtccaagtaatcaaattcgaaattcaattccaaatccaaatcccttccaaatcatctctctgcaaaagtctattttgcctcccccttggtcgttgggccgattcttccttccttggccgatctcctccctcagcctcgcacgtgcgttgcacgcgccgagccgagccgagagagagctctctcgctctctcgttctctctctctctcgatgctttctctctctcacgcgccgacgtcgatttcccgccggcatcgctcaaacctccaccgccttcgctcgttcccgcgcgcgctcccgccgtggtggccgaccgccctcggtcaccgtccgccctggcccgcctgcgccgcgcagccgcccgtgcccactctgccgctgcccccacctctgcgccgcagcgcgcgtgtgtccaagacgcggaggcagcgcctctctctcccacgcgctctctcctccctcagctcgcccaaaatcggcaaggagccgagctcctttctccctccccctttttgctttttccccgaccggcgccaccgtcacctcctttgccacccgtgaccgcctctgtcacagcttgaccgcgaatccgccaccgcctctccttgatcgcccgtgctcggttccttcccctcgaagctccacatcccgcgcctataaaaccacagccgagcccctcccctccatctctctcgttttcgccccccaccgcgccattgcagccgaacaaccgtcgccgccctgttgccgctcgactcgatctcgtcgtcgccgtccgccgccgagcaccggaggaaccggtgcgtgcgtgggcgcgtgacgaggagctacgggcgccacctctcctctattcctccccggccgcgcccactcggtgccgcgccgtcccaccgtcgcgaccacctcgccacgactctctccgatccaccgacgccgcttcctcttgtcggtgagctccccgccgaaccctttcctcttaccgctcgctatgccgcgcccgccgctgcacgccatagcctgccgcacgatgcgccgcgcgcctcgccgttgctctgtttccgccgctgcgcgcagtcgcgcgccgtcgtcgggccccagctcgtcgaccaccctcgccaacaccgtccttgagctccctaggacctccccaaaccattccctagcaccgccgtcgcccggcatggcctcaccgccattaccgtccgctcccggaggccgctgctcgtcgccggccctcctcagtgcttctccgccccatccgacaccggaaacagattccttgaaccccggagatgctcccacccctttgaatcgaatcctcgtcgtctcgttgtgttttcccctttttgctcgccggtgattgccgccgccgcaatcgaccgccgtcggcacctctcgcgccgattcctctcgccgccacgctcccggagatccccttgagctccccctgactgtccctaggccgccggccttctcctttgcctccgcgccgtgtcgccccttccgccgccgcataacgccaccgcgcgtgcgtcgccggtgaccatcaggtcccgcgtcaccgcgtgcgcgtcgcaaccccataccggttcggctaagcccgagcccgcgtgcccttcgctcttctcgcgtgcggccacgtcggcgtgccggcgagattggccgccgccgccggccgtcgtcgcgcgtcgtcttcccgatctgagccgtggaatgagttccccttctcctcctcctgccgccagtgctagccgcccctctggcttgccgccgttcgccggatcccgccgtgagccgtccgatgagccgcccggcctcctctcccttccccatccgacgtgacgtccacgttggcgccacctcagccgtcggccccgcttgaccaagtcagccgacgcccagtcagcagccgccccctctctcttgctcttgggcttggcccagtagccaccctcctcctcggcctgataagtaagacaaacaaagtccatatacactcccttcgtccaagcccagtgtccatcacccaagagctaaaagtccacaattactccctccaattgctcctctctctctctcaccttcttgttggccccacgtgtcaatgagtcaaagatattcttgggaatatctttttcaatactccacacatatttctcttttctagaaattcaataaatcatttcctatattccaaattccataaacccatcctcttaatccggagattccaataattcgtcccctcgagcctgtatgtcagtggatgtcaataatattcttgagaatattatttctataaattccataaaccatttctcgtattccagaaaattccgacaaatcgtctccttgtccagaaaaattcatttaaacttccaaaattcatatccctcgatccgttcgtccgattgcctccgttccacttccagtaattccattgaattgtgatctatctaatggcactattaattagcctaaataggacattttatttggtctttgcttaggtttttgattgtttgcgcctagttgcggttatcggatatttttcttcaagcggatttctcgaagatttgtgaagcttcgtgaagaccctgagcaaggcaagccacctttgaacatattgagcctatatttgaacttaattatattgcttgcaaaatattatgcattgataggattgcacttaatctgtttgccccgtctgcaaggcagaccggtgggcctacctaacttgttgcatctgatccttctattgttaattgttatatcatgttcccttgtaaccatctagttgcgcctcgataattcgtgcactctatgcgagtatcgacggtcgccttcaaacttaaaatttgagtaacttcttgggtaacacttggtttacaaaatctttggaaaacccgacgcctgggtcggtgccttgtgaaagaaaatgagttttaaaaatgaaactcgcgacacaaggccattcctgggtggaatacttgtgcggtcgcatttaaggaccgattccttcggaattacatccgagaatacaacagtgcgaccacatgggtgtaatgggacgcccctggctgagtaattagctaattaggggaaccatgatgccaagagacatgtggattcaacggggtggtgtcggggagaaccctcgggcttcctggcacagtatggtctgggacctaacctgttgttggtctgggacccctctcattggcatatggcaaccctgtgtcggctttggaaacaccttatcgtgaaagcctcaaagtcgccagacgtggctgttctgcacgggctaggtgacccaggttagtaatgtcgtgtgggtaaagtgtaccccctctgcagaggttattaaactattcgaacagccgtgcccacggtcatgggcggatgtgaggtgattccttagcgtagtttttgttttaccctgttttatgaaaaggtgttaaggtttgggaaacctaatgcttgggaagcatttagctgtccgggggacagtgggaccgggagtccctggaagtgattggtcgtttggggaccactattatcgggaagtttggaaaattggtttggtttgggaaaactagatttgaagccaactcttggagttgtgcaaatcttgataaataaatttgttacttctcaccccgaccgagctgagactttgtctcgctctggttgtggaaagcacacacttagattgttgaaaaccttgaaaacaaaactgattgctaaataaacagccttcccttgaagcttgcattaaccacctaagttcccctggcttgctgagtacgtaagtactcacccttgctctctatataaatatagttctgccagctccgaagatgaagttgaagtgaagtgaagattagggtttcgtcctagttccttgccgttgcttgtggcgttgggtgttagtccgttggttggttcctctgctgctgctgttgttggtgtttgcctcgtccgtgtcgccagttgcattctcgggctgtctgagctgcaacctaagttaaggtaaataagtcctctattaattataaggatttgcaatgattcatgtttgtcaccgtgggtaccagcgctatgtcctgggactggtactgagatcgcggtttcgtaggacgcagttcatgccgttttcctacgacacgctcctgtcaggtgccgttgtacggcggtgccagattggggtgtgacaggaaaagaggccgcaggaaaggagagtggggagtaggggcggcatcctccttgcctaccactccgccccacttcgatcgatgggagaggagccggaggcggcggcaagggcaaacaatgacatcagtggagatttaggtggcggtggagcaatagggctgtccaaagtgaagctttggcaataaaacatggcccaaagtgcaactcactctaaactaattctggctatatatgaaactagatctagtatatatgtttagattcatagctagaaattacagtactactatatggggataaggagatttaccatgtatctacacacatactaagtgggctcgcattggggtgctcttgtactcttatgcatgccttgagcggggcggttatttgggctttggactgacatcaattaacatgtagatgagactatagatggccatatggcccgaggcccatggcccggcccaaagcccgcaattttggcccggcccaagcatggcacggcccgactggggtcgtgcccgtgctggcccgacaaccgggccgtgcctgggttgcacccttgtcacggtgggccggcccggcacggtccgagtagtattgggccgtgtatgccgcccgtgggctggcacggcatggctcggtgcgtcggtcgggccataccggcccgacaagcctcggcccaggcacggccggccgggcttgggccgtgccgtgccgggtggcccagatggccatctatagatgggacatgaagcttggcccaataattgaggctctcatagcggcaagctaccgtagtttagaactcatgtcctgatcagtaattgtgccttatggatctaacagggagggaggatcccaaaaatataaccttctccaacaatggtccaagttaacctatacgcatagttaaaatcgacaagtattcaggaaaaggagagagtacttgaaaaccgaagtcgatcgaccagcaagaaaacaaacgaacggacgttgcctaataggaaattatcctgagaaattcctaggttccaaccatccatagcatgaccattctctccgtgagtccgtggtcgatcaagtgtccatatttgagaactgtagcataggagtactagctatgctatagtcgagtaaattatggaggatagtgtactggtactaatgaacaacgacactggctagctgtgctggctaaagcgctagctagctcttggttgtatactactagtcgatcgtactagtctacactactcatacgcatactacgtacgtgtgtatagttgtaggttttcaccgtgcatagtcggctactatacctgactcagtacagcactccacaagtgctacggtctgatcgttttctgctgctgtactgcattgcattgcatggagatggacagcaactgcagcatggtatagtatttttctttcaagaccgagctcaagctggaccattcatctactccgatcctacatgagatgtgcccagaggtatctatcagaagctcatcagaatcaaatggggatcgatgggacccagtacatactctcagctagctgcatgtctctctctcaagagaagccatgccaaagggtcccactggcttaccaaagtaaataaatctcagctagttttgttgtttatcaattgcgcgacaaggccactagcgcagcttcggagagctatagcgacacagaaaagctaggttcgacttgtcatgagattatagcttagagtagaatctatcatttgctgtaatgtacaatattgtctttcattcacacgtacctactcttactccctctgttactaaatgtaaacatttgtaggttatttactataaagattaaggataagagaaaatattctctttcagggtgtgtttagggggtgtttgggagagcccctctctcaaaaacataagtccctcccctagggacttattgttttgtgagagtttagcccctctctcccaacacccccttagtttatgccaaaattggaagtttggttgaaattagaacgatatgatggaaaagttgaaagtttgtgtgtgtaggaaagttttgatgtgatggaaaagttggaagtttgcagatgtttttgacaatatgatccttataaaagaaatatttcaaacatgaactgtgccagtacttattttaaaatgaaccacgaactcaacgtcaagcccgatgacactatgatccaacgtctcagcaccagtcacgctagtgttaaccccctgctatcatggcaccgagttcaagctggatgatcaacgtggcaagtggtcaactctaagtgctctggcattgaacttccaacctcaacgccaataagcatgacgctgaggtaggaggctaagcttgtgctctggatctcaacgagctcgtagtggtgctagagtcgacgagactcgacaaggacaatggcgatgtggaagagcaagaaatcggtagcagcaccggagtcaattggtgttggaacatcaatcgaagcaatgacaccactgcatgatcgatctagaggtcaccaccgccattgagctcctggccacattcccctaccacggtgctatgtccattggcactgaggttccatggttagcaccatagcacttggaactcggtctgccatctcggacccagtgtcatagagacaattaggttgctgagatgttggactttagtgtcacaattcaattttgaaataagtttttagcagggtttattctcaaaataagcttttcaagagggttagttttttttccgtaatttcattggtcaaactttaaattgcttgcattctctcctaagcaactgattggttgaaaatgcttgccttcctgtgcatttgaaatgtgccagaaatgcttatattttgtataaaatttgaattatagaaacacttacacttggaaatggagagagtatgaacttgtcattgatattgtttatgttttcctgaatctttttttcttcgaaatagcatatttcctaataacttctattattaggaggaatcaaaatgttatttcagagtttagcacataagtctagcacctagcattacgttcaagtatctacgtacattgtttgctgcctctcacttaatccttgatttcttctctttcccttttctctcgatcggccaggcatatggccatgtcctgcaagtgcgatcctgaagatttatttccatgcccttggattgttcctcttgttaatttgtgtgccaaatgggggcgcagatacaggcatacagcagctaaagatcataaagaagaaagcggtgcgtgtacgtatagaagacagcagagagaggagaagctatgcatatgagcagagcttagggttgtgcttgtgcagcagggctacctattagcttcaagctgcagctatagcacccatccactctcttctctgattctctcttgtgttgcagtacaaattgtagctgcggttgtgcatgcatgcatcatatgtcctgtgctgtgctgcttcgccataaacacattgcaaaccgcctagtttctcgtctctgttataataattctcctgaagaaatgcaagtagatgtatagactgatcgatatgtgctcatcaatcttgtgatcatgcatgcaaacatcgctgattaaagttgagtgtgtagtaggactgagagctagctagagatcggaagcgaagagtgtagctttattatattaggaggcagcagccgcggccgtagcttttctgacaagtcgatttcgccgattcgacatgatatttgtacatgcaaacatgcgtgtgtttgtgtgtttgtatctcgagaagctcacggggccagtctcgtttggttggcctgcgagtacatgcatgcaatggctggtttgtgggcgataggcagctgcaaactgccctgcaacacagccaccggcctgccggccggcgccctttagattaattagtttaactttggattctactcctactccatatgtactatatgtctgtataaatctataaccctccatctcaaaaaaagaatcgatcaacttttatacacgaatctagaaataaatatatgtttagattcgtgcaaaaaagaaaaaaccggagtatacgtattgtattttgggatggagggagcatgtatatgtacatgtggtatcctatataaattagtacaaatgagagcaagttcaataaaattgccaactacaatatatagcaggctatatatagcacatagagttaggggtgaaaacagtacggaaactttccggatcctggacctattttcgaaaacggaatctgtcggtcggaatttttcggaaacggaaacgaattcggaaatattttctcggaaacggaatcggaaatgataagggcagtttccgtcagaactcgtaatcggtcagaaactttccagaaattttctcggaatttccaaaaattttctcagaattaccagaaattttgtgactgaaataccctggattctttttttaagcactaaatagtgaatactattgtgtttggctattattttttttaaaaaaatatttgttatgcaaatctaaaattacataagaatatttttttgtcctgcattaggatttatcaacaaccttactcttttaaacatagataatttattcaattggatttatcagtttgaggggttttttattccgataaattttcgttaccgtattcgcgccagttcgttttcgctccgttttcggtttcgataatattcgattccattttcgtaaccagggtttccaattccgattccgaaaaaaaaaatgaaaacgaaaacgataaagatggtttccgtccatttccgtaccgttttcaccccctacatagagtgaaggtcacggcagcagaaattcacacttctcaggcaggtgagtaaaaagttgaacatgtgatgaaatttaagaatcaatttgaatgatggaacaaatctagcatggattgatgcgaaaaagaattttcaggttattcattccttcaattaatatatttgaaatccaaatgcttatacgtatatggctctatatttaaggttgcttaaattttagaacaagcatgtactccctccatcgcaaaatataagggattttagatggatg

SEQ ID NO: 67090 - DNA, 10490 bp, Oryza sativa
  unsure (1)..(10490): unsure at all n locations
aactttctattatatttgagaagaacttcatgattataccagagaaacaacaggaataggcactgattgccgacggttgcggtacagcttccgatgttttcggacagactccaattctttccttaaagcacttatctatcaatggcacttgattcaagaatcattagaaacaaaaatattatccatgcaaattggacaatacacttggtgaaaaaaaatacaagccttccaattaattatcaatggagcttgtcattaactattaaatggctacagatcatcaattttttttattccacgcaggtgataaaagtggcaagtcaatgatcaagatgctgcaaaatgcatgttctttcactgatggaagtagtaacaaccaacacataaaacatatctggtgatattctccacagtccacacatctaggtgacagcacatacacacagaacggaagtctacataaactatttcgatgaggaaatctgaagtagcaaatacatggatgaggaaacaatgcataaatatgtgtatgccattcaattgaaataaagatcctgacagcaaagtagtttggcatttggtgcaaagcaaaacatataaatcgttgaacttttagtaagagaatattacttgtgttctcaagatgcgcttgtcaacttcaatttgtttctcacccatacccttgacttgacctcctgactgtcgttcaagatgactccacatctttgtcaaccttggaagttgatattccatttgtgccaaagtgacctaaaaggatgattgcacatgaaaatcaattctaaatcaaatgcagtactgtagttagtttcaactccaaaggagtctcaatcgaggccatacatcacaaaatatctatgtagaaattttgatattccgatcttgcatagtcaatgcagacttgcaaaacactaccaaaagcaatatgattttgtacagtgcacgccatttcatgaagatagtcagctaatgtactggcatgcagatttttctaccaagatatctactgttccgatatggttggacctaattactcaacatgcgttgagccacatcatctagaaaagaagggctgttggatcacgaccacaaatgtattttgtatgctaaccgttatgtattaattatagcttaacatattgtctcacctttaattcaatgttgtttttaagtgttttagaaggacttctaaaatcctgcagcaagctgcagggtatccactagttatagttgtaatagttcgcatttgccagagcctaatagcccaccaaagcaacttaccactggtagctggtaaaggaactgtcattagcattttattgaaaagattatgttctttatcacccaaatatagatgagtgaaatgtcataggaatttttataactacaaagacagttcttgttacaaggagaaatttctgctaataacacagctgcttattatacaattaaagccatgtcgcttgtctagaaaatgacaccaagatgttcagttcagttcacctgtagagcagcttcatgtgttgcagccctttggttaaatatgtccagaataagagcagtcctgtcacagactcgaacgcccccaccaaatgacttctccaagttacgcaattgtctgaattgataacatagcaaatgatcaaggataaaatcttggaataagatatagcaaacagggaaaaaaagagaaatcgagtcttgcagaagtaggtaatgatcatcttacccaggggacaactcatcatcgaaaatcacagtctcaacatcatgggcatgaattgcgctcttgatttcagcaactttgcctgaaccaatataagtccttggatttggggtagaaagcctgaacaaaagcagaaaccatgaaacatctgcagctcaaacaagacatgtatagaataacacactaagggaatacaattcatatacattatctcgaaaggggatataattagccgggccggcctaagataggcggaccaaatttacttaagaaaggggtatgtacatatttacaagggaaaggggatataattcatatagcaaaaatgtaatatgattcaacatttcaactggcagataatagactgttgtttgtggcatcttttcatgccatcagggtaagataacaatgcaaaaacttttgaaattaatttatactggattgatgaaaagtcctggtaaagctgtggcacgttttcagaaccatacttcaacgaacattaccatgtccctttgcagaggttgaatttcgtcatagaattccctaaagccagacatagggtgtggcatgaaattgagtgtcattactttcctcagaattcccaatttatgcttttgactgaacagatatgattgcacaaactagctaaccggaattttcagtccatatgatacttttccatcaatattagttcaccttttgcacatgaagcatcacaaagatggacatccctgctatacatatcccccacaggaaaagataatgtgtagcaattatgttttgtttatgcaagaaacgaggttgtatagcaaaatgcatagtcgcataccatttcttaggaagcataaccacactacaccaccacattcaatcaattatatggcacctaacgccacgccaacaaactacaacatgacctgattcgggacttacttttgataggttgagccgacaaccatgagcccggcggtatccgctagctgctccagctcctcaagtgattcctctatactgaacatacttcctccactcctcttgcactcaaccccaaccaggtatgccttctcttgaaaaatctgcaaaaccctccaatttcagtaaaattcgaaccaacaaattttcaaattgctatgtacagagtgaattatccattctcacatgcaacacaacacaggtgagttaacatcccaattagttcagagagaagagtttaattggacattaaaaagatagataaatctacaggaggccacgatgaggtgccactacctccttgccgttgatgagcttgaaccggtcgtgccccggcgcggcctcctcctcctcctcctcctgccgccgcctgctcctcaccggagccctcgctggctcctcctcctcctcctcctcccccgacggtgccgaatcctccacctccccctccccttctccacctccatccgcaactccgggctcctccacctcggtttccgcgggcggcgcggcctcgacgagccgctcgtcgagcgcccgcgccacgccgaagctgcggcgagggcgggagcagcggagggaggcgggcctccgttgacagcacgaggaggcggaggcggaggtggaggggagggggagcgaggcggtggcggcggcgccggtgaagaagcaagcggctctcatggcgcgcggcgacggcgagtgacgcggcgagtcttctcggcgagtggcagtgcggctcaggtggtggatgggttgaggtgggtgaggcgggacacgtggcgcgttctccgccgttggatagcgtgggaaaggagattgggctgttaggtagcacgaatctcgatgcagcccagaggagagtagacactgctctgtgtgtctgaactctgaattttgtgtgtctgaattttctgtaacagcttacgagcagtacactgaagagcaatttctttttaaaacaaaatcaaaacacgattcggagagaaaatgtgaatgtacgatttgaacccgtcaatgaaattttgcaatcaagtaatactccagaaggcaacataatcaccaaaaaaaagaaaaagaagaagaaacattgtgatcacaaacactgttcatcacagacccatcaaagcaactctgaaccttaactgaagttgagtgatcataaataaagtaaggtactaattgctccgtttcacaatgtaagtcattctagcattttccatattcatattgatgttaatgaatctagatagatatatatgtctagatttattaacatcaatttaaatatgggaaatgttagaatgacttaaaacggagggagtaacaaacagtgttccttgccatcaccatcaccaccaacaacaaagccttctgtttgcattgtgagtatatacattatatataaatacataaattacatcaagaacacccacatcacataaattaagaaaaagaagttatgactgacacatgccattctcacatccccaaaataaacaaagtgaaaatcagcataaattaaaaataaaacatcacttctgaacttcacccatggcaggcagtctcacacaaaccctcttgtgcatcatcatcatcataacttattatctacaccaataccacatgattgaagattgcagaagcccatcatatcactcccaataattacttagagaagaagaagaagaaaaaaaacaagaactcgattctttttcctcctgaattgggtggttggttccttcctccatgattgatccatgcagccaagcaagaaagagagagacagagagagaagcagctagtggacggcgatgttcatggcgctctggtcggagagcttgtgggcgtgtggcttgggctgcttcttggaggctgccggcttcgcggttgcaggttgctgcggnnnnnnnnnnnnnnnnnnnnnnnnnnnnnnnnnnntgctgtcgaggctgtcgcggctggcgcggcagcacggccgcggcgtgctgtcgctctcctccgacgagttggaggcgtccgccgccgtcgaggccttcctcctccccagctttggcgacttgggccgcgtcgtcggcagctgcagagaaaatggtgcagaaacagtcgtgagatcaatgttctttttctgtttcttcttctgaagattggatgtgatgaagttgagagtgttcttgccttcttgtattcagccttgggagaaggagcctcgtggtagaagcttggcattggtgtggccttgaacgtcaggctcttcctcagcagcttcagtgcttcctcttgttctttctgcaggttcagattgtgaaaaattattacagatcagcttctgaaaaattgttcagcctgaggctatgctctttagactgttggtaacaattaatttagatatttgaaagtaaacctgattttttatttattgaactaagagatgcttatggatactgcatctctgattctattcttccagctagaagaatattgtgactatagagagcagttccaactaatcatgaactgtttttaactactgttttcaaaagatcatttctcactaatctctagtactcttgctcatataggtagggaaaaaagtttaggtttagttatatgcataactgaaccatgatcaagagtactgacagaacttcagctactccaaacagtggacaaatttcaggttaagctatctgaacctcaaagggggttatggtgtatggagacagagatgaatatacatatctgggaaatggccgcgtcaaaataaaagataaattaccttcaattttgcctccaactgaatcttctcttcctccaaagcttggtgcttctcctccaacttcatgtaaaactgaataaaaccatgaaaataaacaaatgagcaatttccccctttttatccaccatatttcatattttaattgttaataaataatgtatatacttctctgcgcttctcggcacgttcagtacatctgaaaactgggcctgctggaactgttgtggtccttccatttgatgatttcctgcattttcaagagataaatgaattaggcgctgttcaggaaaaagaggttgtacacaacatgaggttggtgtaaaagttgtgaagcttacgagttggtgagagtagaagcattcccttcgtcagtattagtagcttgcagtgacttccttgtagttgcagatgcacttctctgtaaaaatatatagaaggaattaatgattcatatgcaagaaagcattcaatttggtcagatttatgagaaacttttgtttctttagtgagaaaaatacggcacttttattctactgtaaagaaactgaaaagacatacagtatactttccatatgtttcagttcacaaatttcatgaattccattacttaagtgaaaaattaaagattcatgaaattgaacatgtcaaagaaatggaattaccttcatcttctttgtcgaagttgtcaagacacactttgcattttggaagacatttccatttccatttccagcacaagctttgtcatttgacagatcaggagggtggccagtagcatcatctgtctctgatggagcagcatcctttgcttcttgaacatcttccatcgatgtgactgaggtactgtcacttcctgctgtttctgccattggagacaacagatcctgattttcctgtttatcaccattgttctcatcactctgctgcatcacatctcccttttcagcattattagcaggagatgcttcatatggttctgaattcactggctctgaattcatagcatcattgttgtcagtagacttctcacttgccaagggaacaacattttctgtagctccattggctccatcagattccaaaggttcagagattgaattatcagattgctcaactagaacaacatttactgtggcaggcacttctgatggatgaggaacacttgtatcatcagacacatctatgttgtcactagcaggagtgatagtaacagtagaatccagctcctcattgaaggattgaggtacaatttcaatacccatactactcctgaagaagtgatacttcaatgagtacttactgttgataaccttcaaaataaagatatcacatgttaggacaatatgatacttttttaatcaaataaagacatggagtaagggacaatattgaccagagaaaggaaaataggaccctgcactattttcaaagaactgaaattgacaagccaactatgacaaaatcatttatcctccctgtggacactgaaattatttactacctaccagggtccaggaacatgacatgcataggtggaaaagaatgacgtgtggagtttgacagcatatctgattgaaagctattattttattttgagatcattttattttgttttcttgcaataagttgtgggaatgttgtcattattaaattgtgagcaatcatattattttatttggagggccatgcaataagttatggaatgttggcatcatcaaattatgggaagacaaagggaaaaaaaaaaggagataaaaaagatcaccaagaattgacccctgtactgctacaaactagaaaaaagaaacaaagaattagagcacaagacgtgcacatgtaaatcttgaattgaccaacaaaataattatttgataatttaacatttgaaagtgctcggtgtcctttaaaaagcctagaactgctgtgaattgtacttgttcactttattttaggatttagcagctaagacccatccaatggtaaagaaatacaatttggaagtttgttggcatctaatctgcatgtctgttaaagcaacaaaacagcaagatctccatgaagattccggttgtgcatcttgctaatattataaaattttatcaaatttagataactgaacatttgacgacagctggtacagggccatctgcacctcaacccaaaattaaagtagatccgtacgcaacgagactgatgatgtgtgcagaattattcttgacattttgccaaccatttccaatgaacaaactgaatacatcctaaattattctaaacaagttgatcatttctagtgctgaacaaaatgccacaaaacgtactatctagcatgtattaagtccgaagtccaaactagtatgatgttcatatcttgtaagacagcgacatcacgacaactcaaagtcctgtcggcttataacaatacaacatgacaaagaagataagattctcaattgcgtcattcatgataatgagatcaaagactgacatatctatcatcagctctgcctctttctgatgcaaaaattaacagtaagtttcagagcattgagcgtcctttttccaaaattgagatgctttttaatctcaacgctttgctccgtagctgtacttcccattatctaaactacgagatgcagagaacgacaagagggctaaacagtaaacactttcaccatttcgcatcatcatacaaaccactaaacaagaaatgaagagatgctctttctttcctaactatagctagtagctaatgcaatgtaagttcagataaaatgttaaaacaagagtaaccatcaacaacaacagtttcagataaactaataaacaagagtggcaattagcccaggtttcagagttcagacaaactgtcaagcaacagcagcacttgatgcaggatttgcaggttcagataagctgctaaacaacagagtatcaacactttaacccccaaaaatctccaaaacaaaaccaccccctaactagaaatgctaatcgatcgacacatacagaaaactaaaacaatcagctcatcatcctacttcatcatctgagaagcaaaactgaagagaggtcaccaaccttttgcgtttcttgactcctctcttctcctctcctcttcttggttggcttgttgagttcgattcccggataggcacagtgaggtggtggagggtatttgtaacggggaggaggctgtggacacagtggtgggttcgttggttcaaaccgggttagctcggaggcagctttccatgagaaggggggggccttgcctttgctttgctttgcttttctgcttgggtccctctgctgcctcctcctcctctcttcttgttagctctgctttttttgcaattgttgcaagctgcagcttaggctgtgtttagttcacgccaaaattgaaagtttggttaaaattgaaacgatgtgatggcaaagttggaagtttatgtgagtaggaaagtttgatatgatggaaaaagttggaagtttaaagaaaaaaataggatctacacacggtgttagctgcttggagtatggtggtacgaatgggtaccgggtacacggttggttcgaatgaattgggcggcctcttcttcttcctcctgccttcctagcggttgatcacttgattgtcagccatcttttctgtgttttttttccctttcttgggaactgcagccatccttcttgtttgtgcaattgtgtgatcatctccttctaaatcaccggcatgtaaaagaggagaaaaatagtttctcgtgaaatagttccatttagtttactgttgtttgagtcgtgtcgtaaatagagacctaatgttgtggttgggtttagagagcaacttaaaaaatattgataggtaaaaattttatatctgtgtttttagctgtttaaaagcaaatgctagtagtaaataaataatgaaaaatatattaaaatcaactctaaaactaaggtttaaaatttaaattttagctgcggctgatggtaagccaaagaaaaaacgattctctacggaaattttaagggttaactcgagatgtgtcatatatactccctcgaataaggaacatttgacgtcgggagaactacgtcaaatgaatttgattagagtgagtaacaaaagagttaaacagtagattaggtaagttaagctttactgtcattgtgggtagagtgaaattatgtaagcgtgaaataaaggaacaatacatttcacgtgaaatagttcggtttagtttacggtcgtttggatcatgtcgtaaataaacaacgattacttttctccacaaaattaactcagaaatgttactatggtcccgttcgaatctgattacaggatgaagattaagtacgcacgtaaaacgaaacaaatcatagttaataaagttttaattattaaaaaattgaaaaacagatttatttgattttttatagcaacttctatatatagaaagttttcgtacgaaatatactatttagtagtttgaaaaacgtgctaatggaaaccgaggaaaaatctggatgttgttggagtttagaacggaccacatgatatacatgttccgtaaaaaaaaaaaagacaacctctaaagatgaatctggaaaaatgcttatttaggtttattccccgaagttaattttttatgagatggaaggcgtattgaggagttaaacttatatcgattaattaagtaaaaattaaagtacttttgattatgaaattgggattacgtgggatggaaaatctaatgatactgtcgaataattaagtatagcaggtacggtttgatggtggcgattagagcactgtgttgtcaagataatttgacggttggttggcccggaagttaaattagttggtcgatgactatttgattagttggctgattgctatagttaagccttgtttacgcatgtcgacacttcgtcgtgataggataggtttacagttccatggtcatttcgaatcaacagtgttttgaaggctat

SEQ ID NO: 67091 - DNA, 4594 bp, Oryza sativa
  unsure (1)..(4594): unsure at all n locations
tgccccccacaacatgcagacgtatatattagccaagcatgtgtatatggctgagcacactcacatgtgtgtgtgtctatatatatatatatatatatatatatatatatatatgcgccattacgtgcatgactcatgcatgagtcatatttaattcattagcttgcttagcacattagcgttgttagctagctaatttacctgcttcctgcaaccagccactaacacacaatatgcgagcgcggcggaggagcggcggcgggcgagcgcagcagtgggcaaagcagcggagggcgagcgcggcggcggaggggcggcgggcgagcgcggccgcgggcaaagcagcggagggtgagctaggcgaagcggaagacagtggatgggatggggagctcccccgtgctcggccgccaccaccgccgtgccccgtgccctagcgggtgccccacggcgccggcgacgaaggcctcgaggccgtcgatcgcgccgtgagcttggcgggcagggactcgacgaggaggacgaggtcgtcggccttgccgaggacgcgctcagtggtcgggaagagcaccgcggcgatgtcctggacgacgaggagctgcctgtccgtgaagaccagcgtggggcccaccagatgtgccctaaagacggtgtgaaactgacatgtgggacccacgtgggccccaccttttttataattcctgcgtgaaactgacatgtgggtcccacaagttttatttatttttcaggttgaattgccacgtaagcgtcatgtcaatgccacgtgggacagagaccatcagccaaaacagggacgaacttattccgctctagttggatcactgcgaatatgggccgtcccttcctcggcccaaatgttaactgggccttttggttagctgcattgtgaccaatcggatcactgcgaatctgggccgtcccttcctcggcccaaatattaactgggccttttggttagctgcattgtgaccaatcgaatttggcccgtccccgcgatgggagcggtgggttctcttctccgacctctgcgtttcctggttctggttctaaatggcatcgtccagcaatgtccgtatacagattgtacagaatattgtccaaaaaaatcttctgaagcgcaagcaattgggcaaaaacttgagattagaaatattctgggtcgttcgctttgagaaactacttccagaacctgcccaaatcaaaaccctctgtcgaagcaacgttcgtatcaggatcacaacaaatgctaaacagatcaaacttggcaagagaaacagcaagatagatctgaagttttaaaaaaaatggaatgatagataggattgtcacagaaaagccaaactgggtggccattgggacgggccgtccagcattaaatcctgcggtggtttcctctagggaagagctctccgagagagccatggtgatctcagccatgtgatctcgaatgaacatcacaaggccgcacctccttcccagcaaattcgccgcaaagtcaatagaaacgaacagagaaagcaaccaagaaacgaaaaaggaaggcaaagaaacgaaaaaggatgactgacgttcccgtggttggagaacggcgacccattcgcgagaagatttgcggccgcggtggcggtggcggcggcggttgggggaagcaggagagtccagcgccttcttatatagagaggtggggtggggtggttagggcaactcgcctctgggccacgggacgccgaaaagagagaaaatcttgagcaggccgaagtgtacgctacccaaactgggccggaatacgcgccatcaacacatcatgggcctctttattaacagagagcaataggaataagttcactttgtgaccctcaaaagtcatcgaaatataatctgaccctaaaccacaaaaccggatatctcgacccccccaactcttaaaaccggtgcaatttgactccctcggcggttttggagggtggcttcgctgatgtggcacctacgaggcatcctagtcatcaaataaattaaaaaattaatgtggggcccacctgtcagtgactcccctcctatattctctctttcttcgttggcagtagcgacggtggtagtattttctctttcttcgttagcagcggcgacggggggacaaggggagtggcggcggctggcagcaccggagcgtagccgaaccgggggcggcggtcggcggctagggcggcggcggctcgcggcagtgggaggacgagtggaacagcggcggcggctggtagcaagctcccatcgcggtgcggcggaaccgggggcaacggttggcatctgggacgacgagccaagaaggacgatggcaataaatttcccctccgcctccgaaccccaccgcaaactaccgccgtcctccatgcgccgccgccactcggcgaagctctcgtggcgctcgaatcgctccgctccctcgccggggctagtctccggcagcccttccgcgtccaccacgtcgaacgccatggcgtagtaccgtagcgcgcgcgcgaaccgcgcctcccaccgcccggagttgaggccgccgccctcgtgctcgccgaggaggaggatggcggcgcccgtgctgcgtgctagccctatgatgtcggtcagcgcggctcctgtgtcgtaggcggctcggtgagcgccccaggaagtcggtcagcgcctcggtgaagtaggcacgccgttcttcgtgtcgaactcgggcagctacggtggcatcatcgccgacgaaccaccaagatgattaagctagcgtttgtggatggagcaggcgcccaagatgacgaggaacatgaggatgacgacggtgaggaaggaggcgacgacggagccgctggttcgctggcagaagccgtggaactgcatgcatatgggaacccagttcgcctgcaggttgctgttgtgcgccaggtccacgatcgccgccgccgcggtcagtagcacagccatgatctgcacaaacatcaatcgctcggctcatcaggagccgctcattcatggctccaaatcaatccaaagaaaccatcgaatctggcgcggaactagccgtagaactcggtgaagacggagagcgtctcgtctgtaaccgcgagggcgaggacgacgagcagcagcgcgggctgccgccgccgttcccctcgtccttccactaccgcgagcctccgcagccgagccgccaccgtcctagccgccgaccgccgcccccggtttcactgcgccccgatgccaacaagccatcgccgctccccccgtcctcccgcagcagcttccaacgaagaaagagaggatatacgtgggggagtcactgacaggtgggccacacattattttttaaatttatttgatgactgggatgccacgtaggcgccacgtcagcgaaaccgccctccaaaaccgctagaggagtcaaattgcaccggttttaagagttgaggggtcaatatatccggttttgtggtttagggtcacagattagatttcgatcactttttggggtcacaaagtaaacttattcctacagaatgtacacccagcagcacgtacccatgtcctagctagtgcgcaagctaagaatcgtcagagctaaaataaatcaactggagtagtactaaacaacatgtcaacacgtcaaaaagtactacatcctccgtttcacaatgtaagtcattctagcattttccacattcatattgatgtcaatgaatctagacatatagaaaatgntagaatgacttacattgtgaaacggagggaataactaatgttgaacatgtcgtgtttcgataacttgactttttgtttcattatgtacaaacaaatgttccatgaaacattttaatgaccacattctttttcagatcggatacgtagtcccatccatatcgaaatagggcagaatatcgaactagcttcgctcagctcgtaatccaaatgagcagaatgtatcagctcgactcgtttgtcaccttgagccaacttgtttagcttgcgaaccaacatatccacccaaaaaggtctgcaaattaaacataaacatgatcttccaggaggatgaaatctattggcaggaaaggagtggggagaaacggctacttgagggggatgctaacacagccttttttcatggagtagctaatggtaaaaagaggaaaagtaccattagaagtttagaagaggatggaagagtgattgaaggtaactcagaactgagagagcatataacccgttattataaaggcttgtttggttcggagttaccaccaaaagtgttcctgagctaggatatgtggaggaataggggaagggtggatcaagaagataatgactttttaatcagacctttttccgtggaagagattgagagggctttagcaaaaatgaaaaccaatactgcccctggtcctgacggcttgccagtttgcttttataaggagttttgggagcagttgaaggatcaaatcaaagagatgctggattctttgtttgaggggagactggacctttggagacataactatggggtgattacttcaattccaaagataaaagaagcaaataa

SEQ ID NO: 67092 - DNA, 3783 bp, Oryza sativa
gtttaaatccaggaactttagtccctgtcatatcgtatgaatttagagtattaaatatagactacttataaaactaattacataaatgagagctaattcacatgataaattgtttaagcctaattaatctataattagcaaatgtttactgtagcatcatataggctaattataaattaattaggcttaatagatccgtctcgcgaattaatccaggattatagaataggttttataataatttatgtttaatatctataattagtgtccgaacatctgatatgatagggactaaaaagtaagttttagtcccacctaaagagggtcttagctctagctggccaccaacctttgccaacgtcgacgtggctggcaggtgcaggtaggctgcacggcctacgctctccttgctagcctagccgtttaaccaaaccgcccaaaccatccagctagccagctaaccacgcaaagcgaccgtcgccatcgtcgtcgacgccgacgccccagccgccgtcgccaccccatgcacgcgtctccgtcgccgacgccgccaaaagtgcgtagtgtatgtttagttcacgttaaaattagaaagtttggttgaaattggaacgatgtgatggaaaagttgaaagtttacgtgtgtagtaaagttttgataggatgaaaaaagttgaaagtttgaaaaaaaaaaattggaactaaactcggccgtagtttggtacaagtacagcgcgcgtgccgcggatggatggatcgctcgccgccgccgccacagcatgcaagcgcacgcggccaggggttgataaggccgtgcggttgccgcgtccgctttcgccccggagatcccaccgccaccaccaccagccgcgcgtgcgtgcgtgcgcgtcactgtaggctagctagctgttgcgcgcgcgcggccggggcggtgcggtgcgcgtcgaggggatgggggcaaaagcgatgtgtcgagggaaaagggctaattaagccaagtacaccgtacgatcaagcgcacaaccgtcgcgcgcgcgagtggggacgacggcggatgcgggggaaggcgagggtggtgatacgagggctgaggccgtgtttagttttctccctattcctaacttttcatcacattatatcatatcaaaaactttcttacacacacaaacttttaacttttttcaggaactaaacacacccaaaacatatatgagcagattcgaagattgaaccggcatatatcttaaaatctgctcaagtcaaccatgaacacctgttgtcgatgggtgcgtgcgtcgatggcggtggccggggacgaggagagtgatacaactataagggttgggtttgtagtttttgttttgagtaaattgcattggtggtaaggtgggtataatttagtacacgaacttatctaatttgtacgaactaggttcaaaatgacttggcaaggttaattttacctaactgatgttgattaggatgtggcatgtatacatatatactccctccgtcccaaaatataagtatttttagctatgaatctgtataattgtatgtccagattcatagctaaaagttgttatattctgggacggaggtagtagtgagtatacataaaacatgctatatttataaatttgttttctactttatcttgaatttcgtgtgtttctaaccctttattatttctcgtttttttatatctctctctacgatcactatatctcattctatctttttattgaacatgtgtatgactaagtagcaaccttcttatatatatgtttatgtagtatcctaatcggcacataaatcaacaaaattagtcatgtaatgtccttttgatcttaggtcgcacgcacaagataagttcatgtatcaaaacgagcattttacaagttcatacactagattgcacccatctgacacgttcgtgtacgtaccgccgatgtaatttactcttttgtttttttccatacgtgatcaaatttagactaatatatttatgtgtcttatcatcgtaatcacaatcttgttaaattttataaaatttttatgtaactgtttaaaccatgtgtatatatgtatgtgtaattatatctggggtgtacaaattaaatattttccggtagagtatggactgatcgtgtgtgccggccgtagacgtttggggtgctgttcacgctgacctggcccgatcgacggcggattcttctttgcgtgcacgtattcgtatacatttgattaattggctgttttttttttgttttggatcctcgtaaaaaagaaaaaaaaatcatgctgggaattcgaaatgatttacattttgtctttattctctttaaaaaaaacaaactcttccatttatccaaagctatctccagatctgagcattctagccatgccatgcatcgtcgttgtattcaaggtaaagtcaggcgcattaaaaaccggtagcgtgctaactaatttaatatatcaccgttgcatacatgccacgtcataagcaaggttgacaggatcgggatactagatagtatcgttttgctcaaagtaatatcgtatcgtaggatcgtatcgtagtatcgggatactataagattttctttttttaagtttaattaatatttatattaattatatatagccattctgtataaaaaaatatagtaatgatatatatcatgcaaatagagacatttatcaagagaaaccacgtaggttttgatatatttaactgattttttatataaatttaagcatatttagttacattattttcaaaccgtgttatttaaaataatattttgtagtatcgtagggatcgtagaatcgggataccacctaagattttgtaggatcgtgtagtaatgaataggaggatcgagatactataaaaattaagatactatgtgagatcggtatcgtttcggcttggtaggatcgtaatatcgtaagatactaggatacgaatcgggatactgacaaccttggccataagtcttgacaattaaccataccaatattacattgctaaatttcgacaattactaaaatcttgttaacgtttggatgcttttttttataaccttacctaaatttagtagtacgtgtttgtatgagaagaagcttccgaaaatgccagtaacttttagtagagagataaggacaagagtatatttagtttgttaccatacttaaaattggtaataccaaaaattaatagagttcaaagtaaaaaagcaaagtgaagtacaagcccttggacttgtatgtttatgtggtgtcttatatcatcctaaataatcaatcttgtcatttttgtattatcataaataatcaatcttaatgaatctagacatatatatcaatctagattcattaacatcactatgaatatgataaatgctacaatgacttacattgtgaaacggaggaagtaattattaacagtttggttatttcaatctagggtctttctttgaagtcatcctcttattgttgcaacttgcaagagttattgactatttttttctccgattagataggtactccctccgtttcacaatgtaagttattctaaaattttccacatcatattgatattaatgaatctagacatatatatctatctaaaatcgttgacatcaatatgaatgtgggaaatactaaaatgacttacatcgtaaaacggatgaagtagaagaagtacatacagatcatcacaaacgtatatcgtcgtagttatgcgctctcaatagatggagcaccaatgataaa

SEQ ID NO: 67093 - DNA, 19574 bp, Oryza sativa
aagccttatgcagacccaaggaggatggggggctgggcttcatcaacactaagattatgaatgaagcactcctctgcgaatggatttataagttggaatctgggaacaatagtccctgctgcaatcttttgaggaagaaatatttaggtcagggaggtggcttctttcaatcttctcccgaagggggttcacagttctggaaaagtttacatgaggttaagaattggatgaaactgggtagtgcctacaacattggcaatgggggaggctgtcaggttctgggatgatgtttggttaggggaggtgcccttaaaaatccaatttccttacatttatagcatttgcgctgaccctgataagtctgtcagccaaatgttgatagaaggggggtgggaaattaggttaagaaggtcgctaggtcaggcggatttgaatgaatggtgtgaattgcactcaaaacttagcacagttcagttgacctcagaggaagatataatgttctggaagctgacaaaaaagtcaattcataactaaatcgttatatagagaaatgatctttggggggggtcaaagacattgttatccaggacctttggaaagccccagtgcccctgaaagtgaaaacttttgtttggttgatgcttaaggggagaattcaggtggtaaaacagttaaaaaagatgaaatggccaggtagcccaaactgcaagctctgtcagagtgaggaagatatagatcatttgatgtttagatgcccatctgctcagtttcttgggtgtatcttgagaggtacctttagctgcccgcatatccctgcttctaggaaagaattgcttaatttggctcagttacagagggtagacaaggccaaagttctttggcttctttttgccactagattttgggcaatttggcttattagaaatgattgggtctttaataacaaactgatgacaaatgtttcttctctgccttataaagctctttcgtttgtaacgcagtggaaaaggctagctccggtaaacctaaggggggaggtggagactgtacaagggttgttgcttgccagcattcgcgagacagaaggctcaaactgatgatggcgaactgaagaatcaacatctcttggatagtcccctgcatggaacttttacttctatgcttctatgtcgatccttggcttgttctgctgtgccatcagcattagttcctcgctttcttttcagactgtgtgccttttgtttgtaagctggaatccccagcaatttgtgaaccttttatgcttttagtaaaagctgggccttgtgccttttctcaaaaaaaaaggtctgcaaatcaacggccgaagagtggtgacgacgaagcagagcggctggcggctggcggctagcctggctctcaagggtgaagacaagcttagggcttgagccctaggtttgtatcctaaatcccttgcaaatccttttcaaatttcatggaaaatttaaagattcaacaaaatgcattggttgagcactagagttagtaaatttctggctccaaccctactagcaataccacagagacgacggtgaatgtataaaacaaagacgtagaaggagccgtgcctgccgcgaagtgggggtggtgatgtgaagctgcgagctagtgggcagctggtggtaagtggcaacgacgagggctcgagggctagctaaatatgcattgaaccatgatatctagaaaattaatagttattggatccctctaatgtttgatgtattattttttctttagttttctttgaagtattttaaattccccgctacaacctgcgggatattaactactagtatattatatatcgcctgtcatgcaaacttgcaattcaatcacacggatatatgacaagcatataaatatataatggtgggtggtaagtagcagcacatagagattgatcgagaatggtagcacacggcatcacgcacgcacagcacacagattaggcacaataatctacaggttgtacaagttctcgacacactccagttagatacttaggctgtgttcggcactggctgttcccattctctactcctcgttttccacacgcacacttttcaaactgctaaacggtgcgtttttttaaaaaagtttttatacgaaagttgcttaaaaaatcatatagatgtatttttgaaaaacaatttagcaaatacttaattaatcgcacgctaatggatcgctccgttttccaggcgcacgcacacttttcaaactgctaaacggtgcgtttttttaaaaaagtttttatacgaaagttgcttaaaaaatcatatagatgtatttttgaaaaacaatttagcaaatacttaattaatcgcacactaatggatcgctccgttttccaggcgcacatcctgcgtaggggtgggcagaataagaccgaactgaaaaaccgaaccgaaaagaccgagaccgagaaattcggttagtagttcgatctcggcaattgaaagaccgaaatttattcggttaattcggtcattagcctcggctaaccgaatgctaaccgaattaaccgagaaaaccaaattatagcccagtaggcccaataaaccaaaccctagaggaactcaacccttagccacagagacagaggcaccgcaactagagatgaaaacggatcgaatacggtcggaaactagctatatcgtattcgttttcattttttttttcggaatcagaatcggatacggatacccggatatgaaaacataatcgaatattatcgaatacaaatacggagcaagcgaaacgaatacggtgacgaatattaatcggaatataaaaacctctcaaactaagcatcacaaatcaacgaagaaatataactcattattttttctaataggacatatcaacattttcaaaatttagcaattaataataaacaaccacaaacttgcacacactgatattatgaaataccatccatcatcatgtgaagtgaaaaggcaaagcactactaggcatgccagataatgtcaaccaatctttttagtctaaactctgaagtctgcaatgctgagttggtgtttgcaatgctgctacactcgcactgcataagctgaagctgctgctgctacttgcatgagaggaattcatcacaaatctgccacataacacatatacactaaacaaaatcaaatcagtgaggagctctacaaatcaaatcagtgaggactctacaagtcataccaaatcttggggcttgacggtgaggcaggcgaggaggcgatggggcgccgcggcggcggcgttggcttggcccggcggcggcgatgtggcgcgtgacggcgcgaggaggcgatggggcgcggcagagccggcgtgggttgctccgacggcggcgatgtggcgactgggcgaggaggcgattggtcccggcggcggtggcggcttggccccgcagcgaggaggcgacgacggcttggccccgcggcggcgccggccgatgaggaggtgaggaatcgtgcgcctgtgggactctgtctgggactggacggtgggagactgggagtggactggatctgaatggatggagattggagacttctaaggtttcttgtaagtcagaaaaaaaccagaaactttccgaccgttatccgattccaacggatatcatctatatcatattcgttttcgtatccgcaaaaaaatatccgtattcttttccgtatccgaaaatttttggatatatccgactgaaactatccgtatccgaaaaatggtccggtcggtcggaaattatccgaaacactttcaaccctaactgcaaccgcaagctacaacaccgcgtcgccatctatccccatccatcgcgctcgggctcgcggccttgcgcggcgcagacccgcggtcacgctgcctcctccatcgcaccggcgcggcgccgcctccatcgcgccaccgtaccgcctccgccgtccagccagcccgcctccacctcggtgccgcctccagtggcccacctccgccttggcgcgacggcgctgcctctagcgacaacgagccgcatccgcctccacgccgcctccagcgacagcgagccacctccacctccgcctctggctcgacgccgccatcgtctccagccagctcctgcctccgcctttttttgtctctctgaatatttttaatttgctagtcgcgtgtgcagatgctgagatgcttcgtctatctattgatctattgagttgcttttgatttgtcaatcaaatatttgctgtttgtattttatgaattttttggttctaatttctaaggacttctgctcgggttagttcagtcatgaccgagactgaaccgaactaaccgaggaccgaattgttcggtcttcagttttgttcaggaccgatcggtctcgagtttttgataaccgaaatttctaagagaccgagaaaccgaaccgaacttttcggttagacaaaatgcccacccctaatcctgggttgggaagccaggcttccaaacgcagccttagttagctactccagtatacttacttttagcgagcgttcttctaaaatacaggacgaggacgttacacatcaacactatacaaagcatacaatagttagttagttacctataaatatatactacactaatatcttgtcacatatgtcatacacacatacatcttcgtgctgcagctggctacaaatctatagtccactacttttctctctcatattttatcttcttgaaatgtgtttataactgacttatagtatgctattgtacatgctctcatggacgaaagcgcgcgtgtagatatgtgtatccgtaggacacatgcacgcatgcatgcaaggtataccatcacatcaatggcgtggccggccggcggccggcatcagtcttctctgtctagcccgaacttgcggtcgaggtagcggccgacggcctggaacgtcgggccgtaaaacccgccttcgctgcttcctgttcctgatccggatctctccctctcgctggcttcagtactttcgtcctgcgacgacgtcgtcgtagacgaacgtgggggcgagtagtagatgacattgatgtactcgccttcattgatgtacaccggcggcatcgtcgtcccggagccctcctcccacggcggagccggccagccgccggtgaagttcttgatgggaacagtttgggctccagatatgatgctgccgccgccgccgccgtcgtcagctctatcaaagcatcaatcagatttttaatgtcagagaaagcctgaatcactagctaggcaagcaaatatatgtggtgctgtatatggatgtcatggtctgttggtcataagttgatcacaaattttattttgatatattcttaaaaacctaactttatactcgttgtatatgatcgacctaatacgtactataagtttgtcaatcctgaattttccgcagcagtgttctagtatgaattcctagttgttcactgtaaactgaaatcagggtgttgaaagattaattagagatgtgtttttttttgcgattcgtagacttagatcaagttgaatcaatcgaatgcaaactttattttgggtgtctaatgtgaaggaagactattgcacattgctcttcagtgcgtgggcacacctcaaactttcctggatccaccactagttagtccaaagttatagattatatttgagttaacagtgataatctagcacaatggctcataataaaatggcagtgttgtataaagggctagagtatcttagtgacaaattaatccatacctgctttcggcagatttataaaaacgctcgaactggggctgcctacgccaccatgatcctgccgttaagactccgcgcctttctccttcgacagatttacatgctccttccccgtggtccttttgtagaaccacagatttctcattcaagccttctttcacaataaggtgttgtttttcagtagtcctatgttcttcatctcgtgtcctgacattgttattatctttatcatcaaaggtccaatctacacaccgtatgttgacaattggacgtcccggatgcatcctaatggcatcagtcaaagctgactctgcaaatcttctacaaagatcaccagcagtaaaatcgaccttaatttttgcagtgatctcttcaagtcctgacaaattttcgattccaacgggtatagcatcatgctgatctgctctgtggacatcaaaacctagcttgagcttccggagattaggcattgcacctgcctcaaatttcatccacgctaagctgcatctgaactttaagtatttgaggactgagaaccttgcattatcaaagacaatactttctgcaggctttgtgtggacataaagtgacaaaacagtgagagcaggtaatcctccaagaacatcaacatcatagcttgttacttccctaatcccaatcattaaaatacagagatttccaagctgcccaatccaattcggaaggctagaaaagatgcaaacacatggtaacaactcaagcctctgaagaagagctggtggggaggacacactgctccagccataaacagatacactcgtgcttgtagcactgtgaatatgcagagtatttgcataagaagagcctacaggtgatagagttatagatttgagattagggagtttccccagaatggatccaaggtattgcatattattcttcagattgtcagaatgtatggcagaataggtgagctgaagatcctggagattggtcagctcaccaaggctccatagattctctgatgtgttacagctgagatcaatatatccaagtgttcgaagcgatgacatgtgagcaattccattgggcgggtttgtcctagcaggtagactaagatgcagcaagcctgggagatgaacgatgtctgatggaactgcatctatttttccatctattttcagtgcctccaaatattgtagaccttgcatatgggttggcatttttaaggtgatattggaggtgaccttcaaatatctcagtcggacaagttccgaaatttcagtgagatcaaaactgatgctgtcctcatcaccgcagaaatgtagaattagaactttaagaagttgaaaccccgtaatagaaggcatacaattcaagaccccgcaaaaggcaagtgtccgaacttgagacagtctcatattagttggtggagttgcatcctctacattaccgaagtgaatagataatcgtcgaaccttgtcagcgagccttgtagtcgcttgtgtgtggtctattgcaatagcaaaattttcttctgttgacatgtatgtaataagattgagtaccatatggtgaaccacacaagacaaaacctcaccattgtcattgatatgtacaggctggataaattttctatcaacaagctcactgaaataggctcttgaaatttcttccttttcatgcccttcactaggacagatgaaaccttcagctatccattgattcaccaaatcatccttccaaattatgctattctcttggtacattctgagatataacatgcatgccttcaaatgctgaggaagactgttgtaacaaaggttcaatagttgtttcatcccttccaaattaggatttgccatcaaactgtaacctaaggtctcgtttatataatcccattgctcatgtttctcaagctgagttgctaagaggcttgcaatagtgacaacggctagcggcaaaccaccacatttccttacaatatcatacgaaacttcacagagttctggaggacaattagaatgagaaccaaaaactgtactgaaaaataaatttcttgagtcatcctcactaagtggtttcatcttgaaaatatagttcgactcataaccacaagattgcagagctagatcttcaatttctgtcgtgatcagtattctgctgcaactattaccatctggtagtgtgcacttaataatatcccatgtgcatatatcccataaatcatcaattatgatcaagtacctgccaaatattttcctcaaaaacatatgttgtacaataaatatattgctaatattaacctaagtcctgataattactgcatggagcatttataataatatatatttgggctttgcgtatctttgacattgcgactcgtttatccattatctacaaaaaaaaaggtactttgtatcacaaggcaatactgtacgcacctcttatcttgcagatgtgtccttatactggaaatcaggctatgcaacttccaattgtcaggtggctgctgcaggcgaacctgtgagagcatgctgatgagaagcctcctcatatcaaccttctgagaagaacgcacaaatgcctggcactcgaactgccgtccaagtttgcggtacagctcgttggcaagcgtggtcttgccaactcctccaactcccacgatggataccacctttagcttcttctctccatcagccagccactcctggaccttgttaatggcggcatcgagaccgacatgccggacgccatcggcacgctttctgcaaagcgtgggatgcccagcactagtattggctatgccaccgaggtcgctgctgtacaagatggcgtggcgttgaagcgcctcctgcacgcgaaggctgaattctctgatcttgtttgccatccacaggcgctgctttagcttctctggaaccagaggagtcttgctccccacaggtcgccggctgaacttacggcggcgaatcgtagatacgcttggataccggccgacggtggcagcgtgctcgtactgctcgactgcatcctcgtactggtcgatgcagtcctcgatgtcgtaggacagctcacgcacctccttcgtccagcacctgaccaccatgtcatggtagtcctccagttccgtggcatcgctgtggtgaccatggaggatggaggttatttcctcaatatcttgcctgatgagcggtatctcctggtctgctcccttgggcaggatgttgccgtgacgacgcaggagttcatcaagcctccctgggaggttgaccatggcgccttccatggatgtcttgtctgaagacaaatcaagctaagtgttacagatatccaaggtgtacttctaataaaatcgatgctgaacaagaagcagataatagaaatggaacgagatagagagggatctgatcactgaacctagaagttgaaggcatcagattatccgagtagaatgagcgagctctccgagcaaatgaggaggccggactttggagggacttcttccattttgcttcatttcctagcttcaagtctgacgcttctccctccttggggatttaatttgagtttcttcggatgggaccatttgtgtcgtgactagcaaagctgttggccaaactatgtatttggtagcaccctttcaagatagttgcaatatactatgatgtgatttagacaccaatcctcaaatacccctgaaagtgagaattacatttcaactctaaagcttcacataatttacatttgtctcaaaatgcagagttgtctgagtaattgtcacaaattacactctacctcatatattaggatttacagatgcatgacacgctccaccatggacaaaaaattccatcttaactacaaaattgaatggctaattaagagaccaagtctttcacaccatactatctcggtctcaacatatagctatttatgtcattttttggagagattaaagtcgaagtgattgcttaagatgagaaagtaggtaaaagaattaaatgagaaatggttatgattagttgagataggaaaataggtgaagaagtagctatattataagacaaatttaaatcctagatataggggtacatgcataaaggaggaattagtaaacaggcttttggacacaccaaaataaacatgattcttttccgctaagagcacatttatattgtactgaaatgcgaaataagtagtgaattacgaataaaaaacaagtagctatattcagtgtgcatatgtgtattccgtgtaatttattaaaaaaatcttctagtattttttggtatgaggataatttaccatccttaagaatataccaggagcaaatttacatgtaaaatttggtattttcaaatactacgtatcttaagatactaaaaatttttaatgtaaaatttaggtatctcaagttaaccgtaaaatttctcctggtataaagctgtgggttcatctaaagtttgttttaagaaaacacatacctgtggcagtagatgttgtgcatctgattttgcactcaagtgggcgtttccgcgcatatatacacatacgaatggtggattgttgacttgttgaaggttgcaggtctgcagctgccgaagctgctgctgctgctgctgggtggattggtctggagccatggagtccgcggtggcgagcgcattcttgaaggccgtgatggggaggctgttcatggcgctggagaaggagtacagcaagcacaagggcctcgcgcaagaagcccagtccctccagctcgacctccgcatgatcgccgccgtcatggacgaccagctccgcgccatggggagggcgacgacggccgacgcccgcacggccgtcgcgcggctccacgccgaggagatgctcgacctcgcgcacgacgtcgaggagtgcgtcgaccgcttcctgcaccgcctcacctgcaggcagcaccgcggcggcgccggcgccggagcgtcgtcgtcgtccttggtgcggcggatggcgcacgagctcagcaaggtccagagccggtcgagcttcgccgacgagatccagaggctcaagacgcgcgtcagggaagcgcagcagcggatcatccgcatgaaacctactttggatgtcctcgccggcggtggcggtggcggcggccaactcacaggcgctgccggcacatcgtcgacggcgccgtcgtgccgcgcgtcgcgcatcccggtgggcatcgcggagcccgtggaggagctcctgtcgatgctggacgaggtggacggcgagccggagcagatgagggtcatctccgtcgtcggattcggtggctccgggaagaccaccctcgtgaaggcggtctacgatgatcctcgcgcaaaggacagattctcccgccgcgcgtgggtcaccgtcggtagctcgccgtcgccggagaccagcaatgggatgaaggggatcctgcgtgctgtattccagcaggttcttcccaaagacgccatggatgctgacggacagcatcttgaaacctcgctcaaagaatacctgaaggacaagaggttagtgcacatttaacatttttcttttttttttgaactactttcatatgcaaaatttaacttttaattggacttttgctcctcattcatcaatttgactgtcgtgtgtatatattgatcagggttcactgttttggaatcccaaaaaaaaaatcagggaaaggaaatttcagacaaaaaaatagttttgaaaacttctttgctaaattcaaacaaattctgaaaacaggcactcaccggtggacacaaatatttgaatcaagattatgaaccctgttaccctgatactgatcagcagaatttatgttttaccacttaattttgctactcatttctcaatttggttattaggtatttaattatcatcgatgacatcgggatggatcaatggaacatcataagatcgacctttgaagacaatggtacaagcagcaggataatactgaccacaaccatccagtctgtggcaaatatgtgcagccatggcaatggctatgtgtatcaaatgaacacacttggtgaagaagactctaaggaactcgcttttccagggtttagatcacctgagttggagcaaggttcagcatcattattggggaaatgtgatggtcttcctcttgctctggtcagtgtctccgattatctgaagagctcaaatgagcccacaggagagctgtgcgcaaagctgtgccgcaaccttggttctcatctgaaagagcaggatggccattacagcttttcagaactcagaaaggtgctccttgacaactatgacagtttttctggctatcctttgagctgcttgctgtatcttggaatatttccaaacaatcgaccactcaagaagaaagttgtaatcaggcggtggttagccgaaggatatgcacgaaccgactctcttcgtagcgaagaggatattgctgatgagaatttcagtaagcttattgaccggaatatcattcagcctgttgacacaagaaacaattctgaagtgaaaacctgcaaaactcatggaattatgcacgagtttttgctgaacaagtccttgtcacagatattcatcgcgaaatcgtctcgtgatcatccaagactaggtgtcaatactaatgcgtgccacctttcttttcattctggtgaactgacagagtgtgtggcatctgatgaagagttatctcgtgtccggtctctgacagtctttgggcatgcaggtgatgcaatttgttatgttcgcaggtgcaaactgatacgagtcttggatctacaggaatgcagtgatttggatgacgatcatctgaaatacatatgcaaattatggcatctgaaatacctgagctttgggagcaatatcagtgagcttccaaggagcattgatggactgcattgtttagagacactggatttaaggaggacccagataaagtttttgcccattgaagcaatcatgctgccccacttagctcacctgtttggaaagtttatgcttcatgaagatgatgtgaagagtgtgaacaagatgagtaaactacaaaaattcttttcttccaaaaagagcaatctgcaaactttagcaggatttatcactgacgaaagcaaaggttttctgcaacatattggtcatatgaacaagctgaggaaggttaagatatggttcaaacatgtcgaaggcagcaacaattacatcgctgatctttcacgggccattcaggaattcaccaaggctcccattgacagggatactgaccgttctctctcacttgattctgaagaatgccctgaaaatttcctgagttcacttgatttggagacatgctctgaaggttccaaatatgctctgaggtcgctaaagttaaatggcgaacttcacaagttgcctccatttgttaatttgttgtcaggtctcactgagctttgcatttcatcacctatgctgacacaggttcatctatcaacgctgatcaatctgaacagactgctctacctcaaactggttgcatataagctcgagaatttcgaaataaaacatggagcattcccgagcttgcgacgcctgtgctttgtagtgaaaagtgtcacttcagctctgcccacaatcaagcatggagctctcccaaatatcatatcacttcagctgctctgtcaaggtccagttggtctttctggcatcgagatcagacacatgaaacatctcaaggaaatcacaattaactctggagtggttgtacaatgggaacaggcagcaaagaaccacccaaataggcctaaagttttgttcctcagaaaggttgatccaatggaaagcgaggaacggggaagaccttgtgccataagggagcagatgaaaattactgtagctcaaccaactagttcaggtgatggactgaactctagcctcaataagatcagactttcagagcctccttcttcacgacttgagatgcctgttcgtcatatggtggatggccactgaggcagcaccccagacttccttggcaaacctctagcacaatataccactgcagctggcagacttcaatgaagaccatccaaattttgctaaaaaaacttggaaatctagattgctgttcagttaaatggtccagatttctgtatttccgtacttgtcatgttatgtggttaaggttgtaaattggcccggttttttgtaagttcagggtgttaaataaccatattttaaattcttaaaatacaatgatctgtgattggaggtgtgcaattgacctcttgcataactaaatcgatcctgtttgtaaaaagtacttggtatattttggaaataccaaaattatgtatcaagtgccgtatgtgaaatttattattttcgatgaaataaacaaaataaaaaagttcaagtaaactaaaggactagtactacttcctagttcttacgaggaacgtaaaacaccaatgacataaccaggctgtttaatcagtcaaaattttttgaaaatttttaatcagtcaaaatagagtttccaagtcataaattctgacagaacatttgttctcaccatgatgcaacaaaatcaacaggagcacaccgctaaacacattattcagattctgcgaggaggactcaccgtccgtggctccaccgaatcaggcggcgcgatgcagacgaaggaggagggttcccggcccgccaccgtcggcccccgacgaggaccaagtcggacggacggaggaagaacggacggcggagaagacgggactccccctcgtgctcgtcctcgcaccgaattccctgttgctgcgggattccatggcctcccgctccagcgccacgccgacgcgcccgtgcgcgacggcggccgctcttcctctccctccccctcgccggcgcctggaaccgcagtgctgttgctcaatgggccacatcctacttaactcggcccgttttgatcgggtcgcagccatcctatttcctgatgggccggcccagtattgttggcaatggttgccggctggtgtgtacgcattccggcccatgctgggtctctgtctgtgatttgtctaggggtctcactctcacaggcaaatgagcttaagagcaagtacaagtacaataggaccagctccaattatttccacgtaatctaaggacaaagctaaacgccagaatatactggtaggtagtctctaatttatctttgtgcctttccatagcaatagtattttattctttatttttcttcaattctctctcttcctctgcgttatcttcctcctatctcccaggtaatatcattttttaaagaaggatagtatacatcagtaacacgtggaggtgattactgaggggtacaacatggcacgcaagagcttgctaaaccgaggcagttttactatcattgtgatccccaagtttccaaataaaacaaaagtggaccgacccgtttcaggttatcagatgttttgattttggtcaaaatcaaactaattcaagtttgtagaaaacaataataatattttcaactcaacataaatttattataaaaatatattcagctattgatttcataaaactaatttggtatataaactaagttaaatttgaagtagtttggttttaaccaaagttaaaacgtcatataaccttaaaacgtagggagcacttgccatagcttctctattagagagggagagcgagtagaattaaaaacctggaatgtgatggctcgtgcgatgcaatcgctccaagctgctgcttcgctgagctctcctgctcgtgagtgcagtagccacaagcttcgccaatggccaggacccaacctcaatcctgtctcctcccttctcgttgtcccctatcaacatgaaaggaggagttgtgcgcaacaagcgctcggacgagcgtgtgtatcaagggtgagtactactgactacttttgtttcagccaccgtcgataagccatggctacgaccgctcctctctcacacgtagcaggcccatttatcttgagcgtatgtgtcgctggcgactaattagcattcaaatctacatgttcttcttatcgttagcattgcgagctctattatacttgcttgaagctcaagcccatgattttggtagcctggttgaggcaacaattaattttaaccacaaagataagtaatatctgaagaggtatggcttgttgaagaggtccaatatactcccaagacagaaaaaaaaatgatgtgtttggaattatctgattcattatctaaaaaaaaaaactatggttctttacccttacctctttcttccccataatataacaccctttcctattgtccatttaaagtattagccttgatcatagccagtaagtaccataaccctgttgatgctgtcgtaagagcatcaccaacagtccaccaataatctatccccaaaaattaatttttgtttcctaaactgaaaatagatggtgaaaaaaccccttacttcaagagatagcctaaatttaatcccaaaaactaaaagtggaaccttctgctaaactaccaatagaaattctagttttttttcctttcccgtgcgcaggaggagatcgccccgacgcggggaggagaggagaaacgcacggaaggagggaattgggagttgttttctcgccctcaaatacacgtacctagaaaattggagatgggaactccaaaacgtccggagctcttttgggaatcttttggaccagtttttttaaaccaaaatccccaaaaaaataggattgatgatggaatagatagactgttggtgatgctgtaaatccgatgttctctgtgaatttgggctcgctacagttgcgctaccacagccacagcactaccggtcagacctattatccatgattcgcactccatcaaccaattttatcaagaatcattgcttcaaaaatagccaatttcgtagcatttgtaacgtctgggttagcgactaataataacaaaaagaaaaaaaatcattcttcaaaaacaactattcaaaacttccatcaacaatccagatcagcatccttcgaggtcgaagtcatgtgactttgtcactaacatgtgagcccgatgattcctgagcccacatgttaatgacaaaggcaacgtgcattcgatggcggagaacctcaatcccatccatccatcttagcgtgaggttttccccctttcagctcagcagtgagccctccatcaacaaatcgatcatggccaccgtgcgcgctcttcgcctcactccagccgtcgtggcagtggccggtggtggtcggagaccagcggcgccgagcacgtcctgatcggccggtgctgagccgggacgccgccggcgggaagggacagctcgagcacttcgttgcactcgccgcaccgtatcctggtggtccacctcctcctccgtggccgcggcggcggcggcgtccgcagaagctccgagcacttgccgcagatcacgaatggcgcgccgcccaggaccgggcggcaggggtcggtgccctcccgccgcgcgggcgccgacggacgcccgccgccgcggtcgccgcggcagctggatgacgacgccgacgtggaagcggtgtcctgcggcggaagcgcccgctccagctgcgactccagccggcggaagagccgcgaatcgcgccgcgtcagggccctcccgccgccgccgctcgccgggcgcggctgctcgatggtgacgatcaagctgcggaggttgtccagcgcgtggaggagctccttgtgaaacgccgggtccatcaggcgcgccgccgcgacggcgcctggctcatcgggaggtcgaggcaagccaccaccaccaccggacgccccgagctcctgcgagctcaccggcgacggcgactgccatggccgcccctcctgcgcgttccttggcgtgtagaacgcctcctcgctccgctccgaatccgtcgtcgtcgtccagtcagacgagctcgacggccgcttcgtccgcctcgacaacggccggacctcgtcggcgcgccggtccgacccggcgtcctccggctcgtcggagaacaccgacgcggtgtcggcggagaggatctccagcctgctcagcgcgtactccgcctcatccgtcggctccgggttcttgcctgcggagacagcaaaaaaaaaaaaaaaaaacaccaagaaacaccacagcttctgggcgtcagatccatggcgactaatcaagcacagctgagattccatggcgggcgaggcacctcggatcggagtgcggcatctgctgcagtagaagatgacggccttggggttctggtagatcatggcgcggcagtacggacaccggccgaaccgcattttcacctcctccgactgcatcgccgccgcagaacttctccgactaccaaagcatcgatcagaaatttcgtcagagaagaaggcgtttgatcaacagcaatcaattcggccggtgagatgcatcttgattcaaacctgaaacccccccaaatcaatgcattctttatgccaaggtcaagtcaatcaacttcagctcgctaactgaatataactgctaattacgactcctcattaagacattgaccaattgcagtggaattgactgcttcataatcatttaccaatcccccaaaacaaaagctgcgatgaacattgctacgcaaggacatgccgggaaaaaggactcattgacctctagcgaagatgggaaatggtgatgagaaattggagattgacgctgtctcgacatgaactttagtacggggctacggcgacagtgggcatccagtacacccgtgcacgggagtaaactgttgcaactcaagttaggttttttttcgacaataaacatctcgtggattgagagttcagattggtttcttgcacagactaattgcagagcaacaagaagattgggggagaacatggcactataatcaaattaaaatataccaaaatatcaaattaaagaaaagaacagggaaacccactagatccctgaaaaaaaactgaatctcacctagctgtcagaatcttcagagcccctctgattcttcagctcggcttctcagacacgagataataactgaatcgagccatggaagaaacaggaggaaatacgggggaggaagaaagagtcttgagccagcgaagacacagcgtacaatccgaggaaatattttactagtacagatcgtgaactgaaaagggcatcgttggaaagatgggattggagcacagcattgccgcttaaagaaaaactgtgattttaattggtcaattgcttgttccagttcactgaattttctatcttggtacaatactaggtgtgcagtttgctttaaaaaaactagcatagtggcccgcgcagattgtgcggctatcatcattatattttctctcatttaatagcatatatgttttctcattatattattcaaatatactaaaataacaacataattttaaattttgcaataactttataaaactagtaatattcatattatattttatatacgtgttagttattaattatttttaatatcaaattttagttatttgtaaattatatatattcctatatggactctagactcgtcttttaatatttctttttttaattccgaattttctataaattgtatttctatatagactctatgctcttcttccaatattatttatttttatttctaaattttcatattatattttatatgtgtgttagttattaatcattttcaatatcaaattttagttatttgtaaattatatatattggggtgcag

SEQ ID NO: 67094 - DNA, 11182 bp, Oryza sativa
ggtgggccatttcccaccacatgaaggaagaagccgtgggatttcatgagcaatatgtcttcgaggaagtgcaggactagcctctgatgtcatataaggctgtgtttgagggagaggggattgagaagattgggaagatacgcaaaacgaggtgagctattagcgcatgattaattgagtattaactattttaatcttcaaaaatggattaatatgattttttaaagcaacttttctatagaaaatttttgcaaaaaatgcactgtttagtagtttgaaaagcgtgcgcgcggaaaacgagtcacaatctcccctttctcctgtgaacgaacgcagcctaagtcctaattacaacaccaattagctgcattataataggaattacacgagtaattaggttcaaaaagtgaaaccaaagtaaagaagcgaaaaattgaaacctgtgatcatccacttgtttcttctcatccttctgtctgacctcatcctcagttatgctgtctggattttcttccaagataatatcatcttttgtcatcagtctagtcatttcaccatagaaaccacaaatcaattgaatggtaattgtaggatttcttggatcattccaaacaccagtcatcaaagcagaccctgcatcaacagaaccttcactctccacttttgcatatatctccttaagccttgacaagtgctcaatgttgataaggttattgccatgcagacccactctttgcagactgagaccaacattgaaccttagcttcagtttttcaagattaggcattgcatctacctcaactttgagccaaggtacagtgcacttgagtttaaagtacttcaaagctacgaatcctcctttaccaaaactgatcctttcctcaggtgctctttggatatacacagagagagaagtgagtgcaggtaacacactaagaacatcaacatcatgtcccaacatctcactaatggcaatcttcaagatactgagattgttcagttctttgattcacctaggtaggcatgaaaatatgcatgagcgccatgaaaattcaaaccttgtcagaagaaccggaggagatgaaacactgaagtcatcagaagaaatttccataattgaagaatcagcatcatccaatgaaccagtaaataccagaattagagacttcatgtttttgagtttattgagaacagaccctagaagtttcagattggcaggctgtccactagaacatgtcatgtgaagattttgaagatttaccatcttcccaagatccacaatactttctgttgagctcccgctgagatcaaaacaccctaaagtatgaagagacttcatcggctcagtgaaatggggcaaagtagtctcacttggaagaatcaactgttgcaatcgtggcaaataaaaaatatctgatggaacataactcaatcttgcttctatttttaactttgccaaatattgcaactgtcgcatctgcattggtagccttatattcagatggcatgcatcaatatacagatactttaatccaagcaactcagcaatttctgagaggtcataagttacatcatcatcatcagcagataatcgaaggatcaaaactcgaagaactctaaactcagcaatagaaggtgtacagcggagaggtccaaaaaagacaagcgtgcgaacttgtgaccatctcaacccaattggtgttgtcacatcatttgcattgccaaaacgaagggacaaccgacgaatcttatcagcaattcgcacatctgtctgatgattatcaattgcaatggcaaaattgtgctggactgccttagaccgaatagaatcaattatcatgtaatgcactctaaaggacaacacttcattatcaaacctggtctctacaggttgtattagcccatagctgataagctaatcaaaatagatcaatgccaccctcttctcatcatttccatcaactgtatcaataaatccttctgcaaaccattgactcaacagttcatcttttaaaattatatcgtcttcttcatatattccgagataaagcatgcaggctttcaaaggatgaggaataatattgtaaatgaggtccaaaatcccttccaatttagaacttaatgattttttttacaacattccattgctctgtgcttggtggcaatcgtgttaaaatactagctacaatagccatcatgagcggtaagccactaaagagttgtgcaatctcagaagaaatttcctttagatattcatggactctgctgaagaattcatcagattcaactttattaaatggttccttcttaaagatgtatttgcggttatcaacacagcacctctgagctacatgatcaatttctgtagttatcaatattctactgtaaaaattctttggcaaagtctgattgatagtgttccatatatatgatgaccaaacaccatcaattacaataaaatacctgccaaaagtcataatttagctaatccaaagtctcaaaaaataagggatcatctaaataagtgacgatataaaccagggcttaaagtagtcagattttttttttttgaccgcaggatctatacccaacgataaaaaaaaatctaataaacaagttactaaatggaggaaatcaattactaaaaatggaaaatgaacaattaaagctaataaattagattatcaaaatgataagccaattaaaagaaagaattaccttttgtcattcagatatgacttgatctcatgggataaattatccacctcaacagtaccagtaccaggaggatcatgctgccgaacttgtgagaataaactaccgagcaccctcttcatgtcaggtttccgagataaccttagaaaggcacaacattgaaactgaaatccaaacttctgataaagttcttcagcaagggtggtcttgccaacaccacaaagtccaatgatagcaatgaccttgcattcttgctgcccatcatttagtaacccaacaagtttatccatatctttgtccataccgaggtagcagcgttggctggtctcttcagctaacgggagagttaaagacattgttccatttgattcccacccggaacgtctctctaaactaccaagatcataacgcttataaagcataatcaattccttcaagcaagaactgaaacttgagacctcatcaacaattttttgcctccatgacaatttcttctggagctgagaagcgttgaagcgggataacttctcctggagctgagaagtcttaaagaggggcaatttcttccggagtggagaagccttaaactggagagctctttggatcttggcattagcggcagcatggaaaagctcatcaacaaagtcgtcgatgtcgtagcacagctcccgcacctccttcatccagtagttagcctagaagggagggccctccagatctgatggttccatcagataatcttctatcaaaacttggaggccgtctttgagcacacctagcgctttcatctcttccttgtgcagccgcagtccaggctcggagagcaaccggaccagtttcccaaaaacaatatgaatggctcccagcgaggcagtgatgggaggatccatctccccacccctctccatcttcccaacactagagaacaccaaataaaccatggggattgaattacggatagcaggaaattaaacgaatagcgagaaattgatgagagggtgaagaacataccatgcaaatagaatcgaaatcgatcgggaattcgggattatcccatagctatcgataccttgaacttggaggacctgtgcaagggcgggctagggttagatcaagacaaggatatggtctaccagtgagaagtggagacgggcactcaccaagacgaggtttcctcgccggcggcgggaggtcgcgaggaagcggttgtcgccggcggcgtcgctcgagacggaagtacggaagaatccgacgccgcgccgcgtccacgaccaggagaagacggcgctcgagtcgagtccaatcgacacggaacggctccgggaagagacgatgccttttgggctgggcctcgactccgtatcagttatggttatggaccgtgttggattccgtcctcgtttctatttttttttctggaataagttcattttgactcccttaactagtgtaattcatatccctaaccctaaaccataataccagatatctcgacccccaactattaaaacctgtgtaatttgactctctcggtggttttgaagggcggtttcgctgacgtggtgcctatatgacaatattgacctagtcttcgttccacgtgacgttgatgtgatgcttatgttgaattagaattaaaaaaaatctgtggaccatttgtcattcaaaaaaaaatatgggacccacatgctatcctctctcctttttcctccctctctccttttttcttcaccttggccaaagtggtgacagaaagcactttttcctccctctctccttttttcttcaccttggccgaagtggtgacagaaagcactggaacggcgacgacggcatgtgggcgagtacgggagggtggctgtgccggtgcgacctggcagggccgtgccgttaaatttacaggccctgtacaaggctctaagtgaggcctaaatcaggtatcaaatatagctaaaataatgtatatactacagagcaaatgcgatatattaagaatagtatatttttttaactcttgttttgcataatcagaaactgccaaactaaaaacggagaatatttgttgctgttgctggcttgctgcttagtgccttgcatgttggttgcttgctaacttgctattagctagatgaatgaaaatatgaaattggagaagctggctggcggcctggcgctcgcaggagacgagacgttcagactcaagacgaattgaataagtcacagatacgaaaacgaaagataatacaaaaggctgtggggcctcggggctcggagtcgagaatacgaagcgccacgtacgcgaagtcgccatgcggagacatgtgtggactcgaacgggttttcggcgctctagcctcacacgaatacatgggccttctctgattgggctgatttttttgaggccctgaaaatttggaggccttgtacggtcacatggctcgcacgcccacgtgcacggccatgagacttggtgcacgtgtgaagggaatccagggcgagggagggcacctatgcagctactacctcaacgacatggaaaaaagcaaacagtggtgagattcttttcaaagttatcttaataatataatagaatgatagattttgtgccgcataaaagttagttgctagtatcaagcgtagcaaacctaccaccctgcgggtcccgtcaggaagccgctgccctaaaacgggcacgccggcactaccgccatatccctcaactttctaccgtatgatacagctgtagaagcaatccccctcaccctctacccccaccatacatacgctgattcttattaggatggtcgctatctactatccatgaagaatcaaatggtctaaatagcatcaccatcaaggatgactagaggttggggtgcgccgcctgtagacaattaagttaagttaatagatcgtaccttgtcttgtatttataggaaagtgcattatgtaggacaagcacctaaggtgcaaagctaattagggtggcataatagtggagggaaagtcaatagtttacttccatagtgatgaattttacagtcgagttgtagcaaaagaattatcctatgataacacaaggcattgatgtgctcttcatagaacactaattgttgcttagatgtgagctgccttatagaagtggaagacgcaaatggactgaagatgtatgttattctgcactgcaaaatttgtccatcatttctttaggctgcatcgaccatctgttgatacatgtaaaaccatggtggttgaatcatttcctgctgtttggacctggatgttgattgttttcttgccttccatgagtggctgtatgtacttctgggaaaattccttagtaaagtactgtaatggagactgcatgttagctttttgttacaggcataaaaagaaaaatagctactccctccgttttatattatagactttttagtattattcacatttatatatatgttaatgaatctaaacacatatatgtctagattcattaatatctatatgaatataggcaatgctagaaagtcttataatataaaacggaggaagtattaattacagttactaaaagctgaatagtatgcggaagaacttactatcctatcttgctccatgaacgtggtgttgatagtgacaatgtagaatttgcttgattggctcaggaactgctcgatttcagttctttatgtcagatgtgacttcaacgttttttgcacaaaagcacagatccttgaattcacgtttggtggtccctatgggaaaaataggtaaatggtagtttgtagagagtgatagttataatcaggatgcatacgatcgaagattgactgtagctggtatgctacgttagcaaagggaactaaaatatataatgtaaaaaataagaatatagatgtttgaacagaacggtgattcatagatgaggttttagattttatgagtatatggtgagatgtatctttactacataaatgcattagggggtgtttagatggggctaaaactttttagcccatgtcacatcggatgtttggacgctaatttagagtattaaacctagactagtaaaaaaactaatttcataaatgagagctaatccgcgagacgaattttttaagcctaattaatcaataattatcaaaagtttactgtagcatcacattgtcaaaatcatggcgtaattagactaaaaaaatcgtctcgcgaattagtccaaagttatggaatgggttttgtaattagtgtatgtttaatactctaaattagtgtccaaacatccgatgtgacagggacttggaataagtctctagaaaccaaacaggcccttagccatctaatcgtgttgtcatatgatagctgatgtgactgtatcatgtccgtggattgtgtgattctattgtgcccaggtgtctgcacttaactgtgaacagaataaaatttcagaaggcagtttcaattggatagagatggatactaaatttacctgatttcttcattccggaggcaatatcagttgtaagctctttgccactgtcggaggatgtaatctgaaatgcaagaatgggaaaggagcataagtgaaatcatatatatacaagtactcacaaaacggttgcgatttaggtggttgaatcttagcatggatgatacgggtcgaaccaagacttaaaaaccctgaaacaaatgctgactataagttgctaccaagatgaggataatagcaggggaaatagaacagcaggccaaatttataatagcatgtatccaattaacccattttttagaataaaaaaatagtgatggtgagtcgctgacagactgccaccaccactattttatcctagtagtatagattaaatatttttagagcaatcgtgatttattgagtatacgtgaccatacgacgtgctagtcctggttttatgctgtaataataaagtggtaaccgagtaaaataagagcttatataatagtaggctataagctagttgcaagaagataaatgaggagagagaacggcagcgggctacagatttatagccagctgtagtacggactacaagatacagtgtgtgtatgacaggtgggaccaaatattaataggtagtatgtaactattgtatgaatgatctattagggcacccacaatggttatctataagctctctacaagagatccatgtcagcatattttcctacttagaagatattaaatgaagagagagagcaaagctatctactaacttagaggtagtctatagagaaaaacgaggcaatgcatgagagagctatagatacccatgtagacatactattgaggtggtttactattaatctagtctattactgagatgtgcatgttttatagataacaccttactttaccattgcgggtgctctttaattggctatatagatgaattggagttattagttggctatagtattaaacttgctctaagaagctcaaactacaaccggagttgtcgatctccgatccgacggctcacattaaccgagataccccttaacccgctccaaaatatcctcacccgctaaacccacctccactctcctccacccatggccgccgcggccatggccatctccccttccatccacctccacctccacctccacctccaccacccgcctcgcctccaccgcctcctccacctctccaccacctccccctacccatggctctccgcctggccgaccgcccaccgccgccgcgtccccctccgccgccccgcctccgcgctcgacctccgcccggagccctccccttcctccgactccgacgacgacgccgccttcggcaccagccgctcctcctcccgctccgccatgtccctcatcctctcccgcctccgcaattccggctactcctactcccccccggagctcccgccgcgcccgccgaggggctcggtggaggacgtgttccgcgtcgacgacggggtggtgccgaacgcgcggggagggttcgacgacgacgcggagtcggcgctggtggacgcgcggttcccgtgggagctgccgatgccgccgcccgaggcggggcccagggcggcgaggtcgaaggcgtggatggcggagctgacgctccccgaggccgagctgaggaggctgaggcacgccgggatgaggctcaagtcgaggatcaaggtgggcggcgccggggtcaccagggagatcgtggagaggatcagggacaggtggaggaacgacgaggtggtcaggatcaaggtcaccggcacgcccgcgctcaacatgcgcctcttccacgagatactcgaggtgcattgccgatttcgcaattattgtgttccttgaagttgtttaatgcagcactatagattattgcaagcgggaaaatgctgaattgctggaacatttctcagaagttaaactaattgctagacgctcacgctgcatcataaatttagaattggtgaccttttcagtttttcttagtggagttgtaactagtattgatgccctatgtgaactacaggagttttaggatttgattactggtagaattctttgtgatttggtacttgggaagcttaagcacaaaatgtgaggttgagcacggtttacttcaccgctttgtttcataaattgcttatgaagttatccctgagcaataccatttagcctgtaaagagattcggttgttgtgatgaactggagagtgaaggtcgggtgtgtttacagtggttataactattggtctctatgataattattgatactgttgtttgctcactccagttcttcccagctgttgaatttgttcaactgagcacctgacatccaagtgctattatttagctttgttgtaaaaaggttctgacgaaaaacgtttaaatgccaagcaaatatttcagcaaatttcatgcttataaaatcaaattttggaactaaactgaattgaggactaatgtcgaaagcaagatgttgtatgctgcataaatattccatttttgctgctgtaatgtagctcccatgataaataacagagaaattgacttaccggctaagtggaaattatacaaccgaaggttactgtggatctgttaacatgtacactgaatgtataaatttcttaatatggtatttcatttcttcattctgcaaccaacctgtcagatatttttggatatatgtgttatgtgcctggtaactctagttaatctgatctctgtttcttttgattgatggcggttagagaaaaacagggggtttggtaatatggaggtctggaacttctgtttctctgtacaggggagtagcctatgacatacctgagcccactaaaggaacaagtaagaatacacaaactcttggtatgaagtcctccatcaaagagccacctggtcattcgttgctgcctaatgagaaagtaaacgagatgcaagacaacaatggagcattggtatctaatgctgagaaagatacactagttgaaccagttccagaaatcaaatatgaagatgaaattgacaagctattggatgagcttggaccaagatacgacgactggccaagacctgatccatcaccagtagatgcagacttgcttcctgcaactgtaccaggatataagccccctttcagagttctaccatatggagtacgaccatctctcagcagaagggacactacaaatttacggcgtcttgcccgtgggctgccacctcactttgctcttggtaccttttctatcatttttagctaattattattatttcaatcaattcttactatgttgtagacttgtagtgacccttttcttttctgatgaatattagggcgaagcagacaactccaaggcttagcagctgctatggtgaagttgtgggagaaaagttctattgcaaaaattgctctgaaaagaggagtgcagcttaccacaagtgagaggatggctgaagatataaaggtatatatacactctttaactttactatccccttggcatatttagtgctttagagcttagaaatgttcatcgatttggcaacagcacagtacaagtttatgcatgcaacataaatgtttcgagtcctttctttcacatatattgagataaaagatacaacatcaattatattcctcctttttttagaaccctatacttttatgcgcctcgttttttgcctttcatttccctcgaaaaagtctgcatttcatttgtctagctaatttaatatgttgtgttcgtttgagtttgagagaatatagcctatggaatctaggaccttgatgtatttattagaagtcaattatatgttatatcattctctttgatctggaaagagaccatgcgttgatacatgcctggatgtttggtttctgaatggttatttgtagctccagttcatttgtttaggtggggcagaagatagctactgactgatgattccaaggagctgagaaagggctgcaggaa

SEQ ID NO: 67095 - DNA, 14914 bp, Oryza sativa
cttttttctacagaattagtcaaatttagagtagtttgactttaaccaaagtcaaaacgtcttgtaacctgaaacggagggagtagtttactactactcaattgatgactttttaagatggaagtcaacggaagctaatcagtaagcaagtaaatttggtggtctagttgtgatgtcggtcagtcttaagttgatcactaactttactttgatatattcttaagactgagctttgtactctttgcatatgatcaaccttacctaccacaagtaggtaaggtttcgcagcagtgttctcgtgtgacatcttctccaaaataatcttgaaagtggtgtgcaaaaatgtgaacattagtctttcaagtttagcaatcaactttgactaaattaattgtgttaaccaatcaaaggaaactcatataacatatttcctcgttaatcacaaatttttttaggcaagtgaagaacaacttgcagttgcagcctctggtctacagaaaaaaacaaatcttatgatcaggtatgtgtgctgcaagggcccagctccaacggcccaatccaaatgcagctgcaaagcctgcaagcatcagcaacctccatttctttttaaaaaaagcatcagaaaaaaaatataaacaaaaaatgttaattgcattatcccacttgcattatcctccgcccgccacgtgtcccgtctcccagcctcagctcgagctcgccacctgctcgacccgagtcctctccttcgcttcgccgctgctgctgctgcgggctcgcttgggatgagagccccctcctctccatggcctcctccctcctcctgcctcgcgccaccttcgccgccaccaccaagcacatcgccgtcctccacccgcccgtcgcatccgcctgcaggccccacccgcccaggctgatcaggtgcggcgccgccgccgtcccggacgacgagctcctccgctcgctctacctcgtgcaggccgacgccgcgtcgccggtggtgtccgcggacacgggcaatgatggatgggccgctctccttgacgagatcaggggctccctccaggcggaggactcgtcgtcgtccatcccggcggcgaccagcggtggcgtcgtcgtccccgacgagctcctgaccgcgccgccgtccgtcgacatcccggacgagatcctcggcgcggacccgtcgtcaaccctgcaggcgcccggccccggcggcggcgccatcccggaggaccttctcgcggcgctgcacctggacgcgtcgaacccggtggtgcgggcggcgtggggggcgctgtcccgcctcgacgagctgacgtcgggcctctcggggccgcagcggtgggcggcggcggcgttcgcggcggcgacgtgggcgtacctgacggcgcggccgggggtgctgagcggggcggtggacgcgtacgtgctggcgccgctgcagctggcggtggacagcgcggtggggcggcggagcctgaggatgagcgacttcgtggtcggggagcggatcggggaagggtcgttcggggtggtgtactccggcgcggtggtgccccggggcggcgcggcgccggcggcgaggaaggggaaggcgaagacgaggctggagctggacgagaggtacaaggagaaggtgatactgaagaagatcaaggtggggacggcgggggcgaaggagtgcggcgactacgaggagtggttcaactaccgggtggcaagggcggcgccggagtcgtgcgccgagttcctcggcagcttcgtcgccgacaagaccaagtccgagttcgtcaagggcggcaaatggctcgtctggaaattcgaggtaaattcgacatcaactcatcagttaatgcttgatgctagtatgaactgctgcaaccacatgcagcacagaaaattagtagtagtaacaacaattttaggaatcactaagctttttttttttttacgcaaaaaggtagagagtctctatcttatattccattatagaaatggcggtcaaagtacatggccaaatggccaaagaaaggtaaaaggaatacagaaaaaaggttacactggaaatggaagaaggagaaaggaatcactaagctagcttatagcatgcaaaaatctcaacagcctttaaactttaaacccaaaatttgaactgcttttatattttaaactcggtaatatgaagttttcaagctttttaaacgcaaatgagacataatccactctgtgatacaaaactttgaaagaatcaccaagcttacactacgcaaaaaagttcaataactttgtgatacaaaattttcaagtttttaagcccaaatgattcaaaaaattaaacccaaacgaaatgcaatatgattaaaaaaaagataaattggcccatgcaggtctcgaacctgcgaccttcgcgttattagcacgacgctctaaccagctgagctaataggccttgttcttttatatttgaaaaaaaacattcaaattttttaaacatgatttctggcgcgaattcatggcagggtgaccggacgctgggcaactacatgagcgaccgcaacttccccttcaacctggagggcctcatgttcgggcgcgccgtgcgggggctcgacgacggcagccgcgccgcgctggtggtgaagcaggtgatgcggcagctggtgacctccctgaagcgcatccacggcaccggcatcgtccaccgcgacatcaagccgtccaacctcgtcgtcacccggcgggggcaggtgaagctcatcgacttcggcgccgccaccgacctccgcatcggcaagaactacgtccccgaccgcgccctcctcgacccggactactgcccgcctgagctctacgtcctccccgaggagacgccccagccgcccgccgagcccatcgccgccatcctctccccgatcctctggcaggtgtcgaacacctcacaccttcttcttcttcttcctctccgttcaatcttgcgccgccgtcgatcaccgtcgtcgcgttgctgtttcttggctgaatgcagattaacagcccggacctgttcgacatgtactcggcggggatcgtgctgatgcagatggcgtcgccgatgctgaggtcgccgtcggggctcaagaacttcaacgccgagctcaaggccgccgggtacgacctcaaccggtggcgggagaccacgcggcggagacccgacctgcagatcctcgacctcgactccggcagggggtgggacctcgccaccaagctcatctcgcagcgcggcgccgacaagcgcggccgcctcaccgccgccgccgccctgcgccacccttacttcctcctcggcggcgaccaggccgccgccgtcttgtccaagctgtcactcagcaagtaggttatacaaaacaactcaatgcacaaaattaagaacacatgcagtgatcaggtcaccactcaccaatggcattagcatttttgtttatgatccattggagagatcaagaactcaagattgatccaagagagagggaaaaggaggaggaagaaacaatatggtaatatataattacattgttttgtatgaggttaatcactttgaacagtgcggtgcagagtttgcagacactagctaacttaacttaattactgcccgtattcggactgaactctactgagaaatccctacttctgttggtcagcttcttgcaacctatgtagatttctgaactgtttcttcagccaatccagtactttgattcgacagagagctcattctactgatttggctcaccaatttcttaattagacagcaaaccaaaaaaaaatgcttatacatcatcatataactttggccggttaagctgttcgaacttttcctgaagatcttcatggttgcctccaacaagcttatcaatctcctcattgtttttcatgaagatgaacgttggggttgcacgcacatcgtattgcgtcaccagctcctgacgaatcaaagtaaaaatgccattcatctttgttatctgttgccacaaaaaaaaaagtgtacagagagcaaaatgggcggcaactggaaaaaattcagaatattggatgtaccggcatttcgtctacatccacggacacgaaaacaatgtcaggatacttcagtgaaagttcagcgaatagaggggcagcattcctacacggagtgcaccaaattgcactgaattttagcacaacctgttcagagggacataccaccatggttaacataaacagctatgctttcatcatatatagtcagacaattgatcaacatcttactgttttgccatgctcagctacttcttccattgtattgtcccaattcttttgatcagttaccaaagtcacatttccgccactgtagtccaggtgctcctcggcgtctacagtgctctgaaaaaaaaatagaagcataatgcaggtcccctaattatgagcttgaagatgcaaataataagcagcactacttgtctgtggattggggcagtgcagtatattgtaatgtctagttcaataaccacaatatgaattgtactggagaaggagattatttacgctgccacagcaacccatcgacttgagaaaattcgtcaagatgcaagtgtcctctgctccactgatgaaaaaaaaaatcgggaacaatattcagtactggtgtcaatgccgctaagccaagaaaaagaagaggtcacacaaaacattaacctggatgttttgatggaaaaagaaagtcacattcatgtaaataagctcctacttcctctatcccataatataaggtatacatacatttcaagattcaactttaaaaatatttgactataatataaattaaattttatttgctaaaattaatatcattagattggcatttaaattcactttaagatggttataattttgttgtaaaaaacttatagtatatgagaaattataggtcaaatattagttttaaagactgtgccaagtttgaccatgctttatattatgagatggagagagtttttttttctagatgggacaagatcctgttcatggtagtgatctggttaaggggcaatttcgttcttgcccctactttcatcttcaatattgattttacccctgtttttttagggttttcgtttttacccctacttttttgaaattaaagcaaattttacccctactttggatggacatattgacggtgttacatctctggcgaaaagacaatcatacccctatttgatattgaatatttgtctgaatgtttattcaataattgtgtatttgcccccatttttacattgcatttttcacaaacttttgcaaatatgacaattttttatagaagattaaaatttttgacataatataattttgcgacaaatttgataaaatttgtatattttgcaaaagaaaaaaaaagacagaatttgggcatggtttttacacagctaacaaaagacatgtaatagcaatcatcacaaaatcaagcaaatccaaatcatgaggtcaaaaaaatccaatctagtagcatgttgcttcttcctattgccaggttggtgctgcttgccgcagcgtgcacctccggccgtccgccgcgcccggcctgctcgccatcagcttgcagcgcccctgagacctgctcgctgcgcgcggcctgttgcttggcgtgctagccgccaccgcttggccgggccactgccgtcgtcgccttcccgcatgaagccgccgatgcctagctgagacgccgccgccgcaagctcctcacgataagccgccaccgcctggacaagagcccatcgtcctctcgtccccttgtcgagccgcagtcgcctggcctgcctcgacacgcgcggccttctgctcgtcaccataggtgggattggggaaggcaaggaccggcattgtttggttatggctcaccaggggtataaaggtccatcaacgaattaaaaatcattacttcttttttttctctacttcttcagctccataatcccaggttgactaacttctgttaaaaatagtggtaaacgtctacttcatttccaaaaatcaggggcaaaaataaaaacattaaaaaataggggcaaaattgatattggatatcaaaataggggtaagaatgaaattatccctttggttaaaatactattgacgtcagctccattgtttgtttgttgacttattagtcgtagccaaaatttaagttttaaaacttaattttagagttgattttgaagcttttttcatcgtagtttatttttgaacgctagcttttaattgcgaagaacacaaatgcaaaagtttttacccataaattatctttagttgcttcattcacatccccacagcttatcagccatagagcaaacgatgtatgcagtcacttttaactttgtatagacgtttaatgtttatgtaaaccttcaatagcatttaaaattttaaatacatgttcaatactcatttgataatttgaactaaaaaaagtagaaataaaccgtcaaactgttttgtgacgtaaatcaagagaccatatttcacatcatgtcccataaaaataattcacaccatgaatgtaaattaattttgccaggatcacggtccaatcacccaatcacaaataacctacgaaatttatagagcaatattttttactgggtcggctaaaatgttattaagattagaggggaaaagagaagatggcttttctggtttcccaaatctctcacatgagcaaagataatgattggtgacatagacgatatggaaggagcgaaacaataaggtttttagggcccctttgaatcgcaggattgagaaaacataggaataggaaaaacgtaggattttgataggaatgtaagtgtaaaacagaggattgcaaaacgcaggaaaaacacaggaatgaccgtttgattgaatcataggaaaaacacaggaattggatgagagagatatactcaaaggaaagttagcaagaggttgaagctcttgctaaatttcctccaaaatctctataggattgtccattacataggaatttcaaaggattggataggatacaatcatttgtttcaaagggcttcataggaaattttcctaaaattcctatatttttcctccaaatcaaaggggcccttaatggccaatgcaagaccatacaggaaatagcgaagctagcggcatcggggggccacgctctcaagggagacaggagcacccgcccatctaggtggagcatttggtcgtcaaattgttccgcgagctatcaatgtattgtttccccgcccccattttattctttcctttctctctgtaataacttttttttaatcttaatacaaaagatacacattttgcgtatcctttaaaaaaaaaagagagagacgaacggaaggaagatagcatttccggccggtttccccaatctctcaaatcatgcagcagcaattcgctatacaacgatgaacacattgttcagagagggggcgtacctctgcaagagcaaaagggcaagaaaagtttggctcgccgtctgcttggttctgcgccgagcacgtcggccgtgcgtcgacggcggcggcggcggcccccggcggaggggtgggtggcacggggatggcgccggggctagcgaagggaacgggcggccgccatgcccaccctgggaagcgaagctccttgtcaaccgctgaaacgacggcctgacggtcgctaataccggggtggatcgccagcaaatctgcaggagagaatagctaaaattagccttcctttcaccgctatctcccttcagattccacgccggcttagctaccaaactgatctgcaatgccagtggcagcttgccattgccaagcaaaaagaaaacaaaaaataaaaataaaagttgtacaattgcattgtcaagagagaagcaattccagaaccagttgtcccaagagtatctctactttatgttcttctctttttctgagccaaatacacaaaggtgttttcaagccaaaggaatgtggcaaagctggaagttcattcattcaatacaacaaaccccaaagagttttacatgataggaccatgtcacccagtgatgatcagtagagctactggaaattaaacaaacacaatgactaacatcacatttctttcaagaaaaaaaagagtgagagaaggaatcacagcacagaatgaagaatgaataatgaagaagaagaatcactaaagaatgatcagaaaatcaaacagaaaaagattcactagacacattgctaccaacaaccttcaaggtagaaactattgaacctatttttgtctcagtggcatgttgttatttctgtgccatcaggtgatctggattgcttcctcctttagcttgtcctcgggggataacctcgtccccgaggaggagttcctgatctcctcaatcctccttaccacttcctccatccgaggccgctggtcgggaacaattgcaacgcatgccatggcgagctggagcatctgaaccatttcatcctcgctgttcggatgcctcaacaggtcggcatcgaaaacctcggaggtccattcttctcgaaccacggattgcacccatcttgggaggtgttcgatggaatcctcacggcctggggatctaagaggagcttttcctgttagcatctcaaggagtagcacaccgtagctgtagacatcggatttctgcgtttgccttttggtctcaaggacctccggtgcacggtatccaatgagccgtgctgggatatgagggatggccatgagctgcgcaaggccaaattcggagatacaagcactgagtccctgcgagagaagaatattacttgacttgatgtttccatggatgaactttccacccccctcagcatgaagatgagcaatcccacgtgcagcttccagagatatctttactctcgttgcccaatccaatgtagttcttccagcagttctattccctgaatatttaccataaacagtaggtcagatcatgtgcgctttcatagcaatacatgtacacataaaaggcaagttattcatgaattcatacttccagacaatacgtttgcaaatatgttgtgcagcctgtactactttcatgtatttttcttcacaggatatcaaccaaggaccaagatgcagtatacctccagaatgcatacgtcttctagtcagtttttttttagaaaataaatttcctagccatcaaatttagaaaaataattggtcggtttgcaataatagcttgttcgaaactacatgattttgtacatccataaaatctaaaagtgtatcaggtagactcactatgacatgcttgtaaagacaacataagaaaaggaaaaggttgttagacatagttcaatacaaaaaaggataaaattttggtccttgaggaggtaacaggaggtaccccattcattttctagtgtcaggaagtaaaaactttatactacaaaaatagaggactgcaaaataactcatcaaaaaagagtgagcattctatatttgcttgcacgcctatatgtagttaaaaccagctaataaattcactttgcacaaacaaaacaggttctgtcaggcaatgaaaggcttaatgatttgaagtaatagcataccatgcaaagcagcacaaaggctaccaggtgtcatatagtcatacaccaaaagcttctcgtccttggagtaatagtaagcacgcaattgaacagcattttggtgctggccaactctgccgattatctccatttgctgttcaaattccctctttcctgcgaccacttccttcagtcttttaactaccacggttgtgccatcctcaagaacagctttataggtagtcccataacttccttttccaaggacttcagctgaggccctcaatagatcctccaggtcaaaattatacgaacagccattaaagaaaatcaatttattcctctctgcttcttgaataccactactgctgtactcctgctttgatttttcagctcttccacctgcagcagcctttcctttggatgaaaatgaagctatgccaggctcgccatctttctttcttttgaagatgcatatcaagagcacaacaatcaaaatcagaagtaataaccctcctccagcagctattgcaattatgacaccaaggctaagccttttccagaagcttttcttggtatttgggggcaatggcgacatcggagaaggagaaggtgctgttcctggacatggttccagtggaagtccacagagaaaagcattcccgaagaatgaactggctgggaatttctgcagggaaggcggtatgggcccactcaggttattgttgcttaaatttaaatgtctcaaattggggaggtgaaggtcagggatgggtccagaaagagagttattctggaggagcaatgcagtaagttgagtgatattttgcactttcaatgggatttctccatcgaaagagttgtacgacaggtctaggaatgttaggttggaagatagtgaagttggtataattccggacaagttgttgtgctgaaggtaaagagaatgcagggaaggaatggatgctacatcaggggggaggctaatggtgagacgattggatctaaggctcaacacctgtagcgcgtcaagcttgccaagtgtgtctgaggggatgggaccaaagagccctactgcaggtagacgcaattcacgaacacgcctcccatctggtgtgcatgtaatcccaacccacgatgtgcagacttgagtcgtgagagtccagttgagttttcgaccatggggcactgatgcagcaaatgcaagaagggcctgcctgtctgagtttaggtcagcacatctggcacaagggatgtgcagaaacaaaaacgaagcagaaagaaaggctatgagcacaaggtgctgcattgttaggattaacttgaccaataatgaggaccagaattataatccaaaggtccacgtcagtgcttcattcctgccacattaaaaggatcatagtcaatagcaagtaagattgttcatagcatcaggagtgagagacatagaaatacatgaagcgttaaatattaaacacatgttatttgcaaagtgggaaaactagtaaaaacataaggtattttgaatacaaaacatgaagccatgaagaatttaaactttctagtggacatgtatcttctttttaactaagaacctacctgaaaagatacatccttgcaacgatagcttttctgtttgtcattgtaacgatttgtaatggacccaaacacacatatgtacgaactaccttaaggagcagtggagtttgatgcactaaatttgcattcgtccatttacaatttaccagaagcatttcaatttttttactattcatatcaagggtggcttaagagcattgatccattgagtatcagattcctggtcctgctaaggaatacaaacaaatatgctgccagaatggcatccattgcagggccaacatgatcagagagagattgaagaatttgcatgcgagggaagactgaagagtctacataccctaagctatctctcagcataatcaggagcccacttggcaactttgaatcacaactgattgttattattgacacctaaagctggtgtaagctcataatgcacattattggaataaagcatagagtgataaattgaagagaagatgacaaagtactggtcctctcttttatatgtaaaaggggaccaccaaattctcaactgctacacagcaaacccccctcccaaatggaacaccaaaacagaataaccctccttgttttttctctagtcttgtccaaaagatccacacccaaactaatattgccggtttatctcgagcttttctgaaatggagcggttgggaccatgtgccatataaaacgaaacatgtatctctttgataaagtaccccatccacgttaaccttttcacaaaggatagctccattaattctcttaacaaaatagccgcggcacctaaacagtgcacttaatcgtaaccagaaaggacacaaggatagtgacaatgaacaagacaccgttccaatcggacatggcatagcacattatattggtgctctctcttgcaaagatgttacttgcacaaaagcaacatgcaaagcacctaacgtaggctcagtcactactactatatctcatttcagctcgttctttttttctaaaatctagaggaccaagtgctttgggtaaaggcaggagcacgaaaccaaaagtccagcacataaagcaggtggtctcaagatgcaagaaaccagaggggagtagaaaagatgagggttttggaggcaggattggggatctgctcgctgatgggggagatcatgggcagcactgcacactctggcacagtgctagggccaaagacatctcacattcacaccataggacaaatgtgcaaagcaaaagctaccactgtctcacactacgcaacagtagaagtgtaccacagtactgctcctctgcttgacatgttgtaaagatttttcatgtgcagtaaatccaacttgggaattgcactagtaaaatttttcattgtattgagttagtagtactgtttaaaatatattctacatttctaagttactacagttcagcaatggtcagtggaatgagttggtaactagatggaagccaacaataccattagttaatcatggaatcacactagaaatagagagagtgccatggtcaggtagattcaaagtgcaaagtccttaaacactaagaaaaggactacgcccatataatctccttttcctttttttttctaaaagaaaaaaagaagaagaagagagcacgcgtcaaacaaccaaccagcctatcacacgaaagagaaagcagggaacagtttgttacaacttagaacagaaatcagatgaacaatctacattatatactcaaccaaaatttcctccctaaaaagaaaaatcagttttccttttcattttttttacagtataagcaggaactgggaatcactgaattatgccatatcatacctcgcgaaattccaccggagttgcggccacagctgaattccgcagcagccatgccatgctcggtctccaaaaggctcaacaaacgcagaaaaaaaaagaaagaaaataaatccgacctttccggccacacggatcaagaaaccgcccgccgccgcgccgccgccgctcgcctctccggtgcggaaaccccttccagtcgccgccggcttaactagggcgagagccactcaacacagcgtcagaaccacccccaccaagaactgctccaagaaacaacgcccgccccgccgtggccgatccgccgcgcccggcattcccttccccggcccccgcgcgtcgaccctcccgcagcccgccggccggtcacctccctctcgctcgctgcgccgcctcctcccagtctctgtgcagcgcgtgcgcgggcgcgagtggacgaagtggcggacgtgtgcactgttcgcgcgggcggtgcgggtgcgcgaggcgagcgagcgagcgagttttcgctgcgcatttaagacaagtgaagcgtgtgtgcgcgtggtaacgattagcgttggggggtttggaggaagggagagctgtggcaaaatggcggatttgcccctagacgtggcgaggccagagaggatcagaatcgtctgcagtcgactgcactacgcctttgttattaatttatgagtttagagattatcggatccacatgttagcgataaaggtatggaacatcggatcttgcaattagctgcagaggatggtagagagtggagaggaagaggacctatatgttcgtaataaaggcacggtatatcgaactgtgcagtcagctgcagaggatggtggagagtggagagggaaaggaggaggcaaaggcgcaaagcaaccgtatcgcgcgaggaagatgacgacgctaggataggcttgggctgggttgctgacgctgacgtgcgggcccgggaataggtaggaggaggaacacgcctacctggactggaactgaaaggaaaagtctgatgaatcttcccccggtgtcatacgcatcttgtgtgtgtgtgtgtgatgctcgtggtggttgtacttgagcctggagatcattgattttcttaatgagtactccctccgttaaaaaaaaaaagacaaacccggtttccatgtccaacgtttgaccgtccgtcttatatttgaaaaaattatgaaaaaaattaaaaatacaagtcatgcataaaatattaataatgttttatcatctaacaacaataaaaatacgaattataaaaaaatttcatataagacgaaaagctaaagttagacacggaaacccagggtttgcttttttttttgactgagggagtacgtaacagtagtacagtacacataagaaatgcaaggagtgctggagtggtattattttgagggcttaatgacgttgttactgtttaggctatgtttggtacaatgaggctatgtacaatgaggctatgtttagttccacaaaagttggaagtttatgtgtgtagaaaagttttgatgtgatggaaaagttaaaaatttgaagaaaaaattgggaactaaactcggccaagttgggagctaatatctagcgcacgcaaaaaaaattaacacatactccctccatttcaaaatataaggcacaaccacccttagcttaaagaccaataaataattaatatcacatcattgtcatgaattatcccaactagtacagtacatgcaaccaatagaattaaagatcctgtgagtgtatgatttaaaataatactccctccatcccataatataagagattttgagtttttgcttgcactgtttgaccactcgtcttatttaaaaaatttgtgcaaatataaaaaa

SEQ ID NO: 67096 - DNA, 858 bp, Oryza sativa
tccttcaggttctcttccgtcacgtcggacggcgcccattggccttcgaagctttctttctcttccgtcatcgattttccccgaatgcactgatttgattcgagggatggcttgggaaaggtgaggaattgaggcggtggatcacgggaaggattttgattactttttgaaggtggatttgagtggaatggtgaacccttatttgccggcgcagctctgtactgtagcaaggagtggggaaaatggcgagagttccggcggggaagacgaagcgtcgtttggatctcgggttttcttgttaagggtatcggaggtgcgaatgggcctaggcctgaacagtacctcagcccaatacttttaacagcgtggcccattgtgttccttagggacttaggcattctttgcttcggcaatttatgtacacaatagtgttgcccaatgctgataaaatcctttttacgcggtcatataattctttggaattattgcgatgcaaattaaaaggtgcctgacagaaaggcgttatgctgttttgtacgcttttttaggctacaaaagctgtctgggttaacttggaatgacttgtttttatcatagtcatttccttggtatgatatatacctatttccattgtggtaaatagtcatagcctaggctattagacttatttgttaccataatttttataatatttggtgggtaatctttagagtttttattcggatgcctgtcaagtgtgttcattcgtgaacctttttagagtgtaaaccactcgggttctttttattatgactaaaaagcagtcggctagaatgcctctttaggcgtcgcgtatgcttttgtcatgtgatgcgcgat

SEQ ID NO: 67097 - DNA, 6743 bp, Oryza sativa
ttgattctttattatttaatacgagtgaattgtggattcatgatcttacagttcatgtttataacaaaaagatgaccaatggaaggaatcccttgcataattatcataaccactttgctattgcaatagtgaggtatgatcctacactgcatgtttctactgaagcacatttacatataagaactatttattccagaatgacttagtacaaaaacacaattaggagaatgagacaatgagttaaactcgtaccgcaaatctgagaagcaagcacgatttcccaacaccagaatcaccaatgaggagaagtttgaaaaggtagtcgctgaaattgaccaaaagaaaaaactagtgttacagtagcagtacatagagaaaatgaaataacaattacatgcatacaactgctaccttcttcatttcaacacagtgttttatcacatgtagtaatgcactcctacagtagtgggaattatttacaataaaatgttatctttccatatcccaaaagtcaacttcccttataggtaactatcaaatcatggcatgaataaatgtcaatagagaccattgtattatttaggactcccttatatatgcaggtaaaagtaactgaataatgatgcatatacatctgctccaaaagtatgttgatatccaaacgggaccaatatgcctagtattagtacttgtggaagatatccaaattcaaaactatggcaatgtttttacacataactacagagcagacggacatgagctgatatgatacattggcacgcacataaggcaacattataaactaaatttcctggtagaataaaatccaattcccattccccaaatatgtatgagacatcagcaaatcatggtgtgatgagcgattgccgaattcccccttttgccattgacgtgataatgaggagatcatcgtcaacaaatataacatcccgcgcgtcgtcaaacccacgtgtgaagaagacgaaaaacgtagccaccaagttgagatccggatcgaaaccatgcgaagggatcccgctcagatccgggcaacctaaccaaacgagcagcacggcgaaaccgggggcggagatcacgaaccataggaaggaaggaaggaggaggtgatgaatgggagtgcttactactcgggattcatggcggagggagtgaccgccgtggatcggagcgccgccgctgcttcgacccacggatctggagacgagagagaaggagacggggggtggggaggtgtcgtaaaagtaggaaggattttgcaggggggcaggatgatgataaatataccgtccgccgcgccgactcggaactcggaagcgggcggcgtttgcttcggctcaactgctccacggacgcgtttgcctcgtggattttattttggatttgctacacatctaccagctgtgtaaaaacaaaaaatatgtactttctccatgcttaaaaaatttaatttaggtggtgtttttttctcttagagataaaaattaagtgttttaatgcaaaacgaggtaatattaacgtataattaattaagttttaattattacaaacttgaaacatagattaatttgatagaattctaagcgccaaacatgcatcagcccaggcccaccccaccccacgttccgtcatttcactcctaccgttgtcggagtaaacgatttactcctatcgcgcgccccaaccacccaactttattcgagtaaacgatttacttcgataataaaaacaactccactgcttccgatcccaccccacgtcccgcatcgtgctcccaccattatcggagtaaatgattaactgcgataaaaacaatttctctgcttccggtatatattatatttttcccgtacccaaccaaccactctcgcccctacttcatttttttccttttttttgggatctggatcgatccaccatcccaccccacagatcggcgacacaccatggaggaggaggatgacaccgtggtggttgatggcagtggccggcgacggttgaggcgaaggcacgcttcgggcctcgctgccggacgctaggtatcaccttaaccagcaaagaggtgttcacctgggccaatagcaacaaccagcggctgctccacatcggcgacattgatagaacaagcaaggaaatgacactctgatttgcatatgcatactctccttcaacttcacgcatgaagccctaattttttttgcaaatcaaattaacgtgcaatcttcaatattacctgatctcaattgatgggctgcacaggtcctacatttgcacatcgtgctccatgtggctggctgcagaggatagggtggagtccgccggtgatggaagttgtttgctatttttcttttgctcgtcatctgtattgacatgaacgagaatgtttttgcattttttcgtgcttgctagatgatgaatggctgctactgcgcaacgtcgagctcatctctataccacaccgctacatccttccatgattccatcgtcgactactgctcgccacccggttgccctctccactaccagtcacaagacatagaccgtgctcttcatccttatagcaagatccagcaaagccaccagatggatttttggctgaatcatttttttttctagtttgattcagctgtgagtaattttgtgagtaattttatcgcttgtgtgtgattgagccagtaatttttttcatttatacgattattttgtgatacagatcaacaatactcttagttttagatttttactcttatactgtatattgaacatatcagtaaaaatattactacactgtggctatgagatcatggctatatcgagaggaatgtggtaattgttttactcgcatagtcgcataccaggaaatctcggtttttactcttatattgtgtattgaacacatcagtaaatatattactatagggtggctacgagatcatgggctatatcgaaaggaaggtagtaattgttttactcacagaccatgaaatctaaacaatatttataatattggtaaaagaattactagcgttgtaagctggtagtaattcttttacgaccatctaggtattgcgtatggaggcattcatgcgagtaaatttgttacttttaaatgagcggatgtgggaggctcggagtaaatgaaaaactccacggagtaaatggagtaaatttgttacttttgaaacgtgcggagatactagaaaaacggaaaactcggaaagaaaaactagacagtaaatagtttactaaaacgcgaaaatagaaaaactacaaataaggaacgaaaaaaaaaatctagatggttaatattttactgggcccatggatgaagcacggatgagatggaaaagagaaaaaagaaacacggaaagtggagtggtaaagaaacgaaaaaaaacaaaccgaggaaatgtgggatgcggaggaaaagtggtgtggtaaaaaacaggaaaaccagaaggagagggcgttgtgcagtgctcaaactaatattccgcgctgtagagcaactttcatatagaaagttttcgtatgaaacgcaccgtttagcagtttgaaaaacgtaccacgagtattgaaatgtgtatctagaagggatgtgacacttgtctaattcgttgtatgacctctcctgggttaagtttttttttaaggacgggagagtacatcagtacaatattgctgcaaacaagaggggtcattaggttgcatgcaaatgtgtatagagtaggagtagcgtgaggaaacaacaaccagcgaataggaggcatgtaggaagccgcagaaaaggcgaagtatgatccattttccatcataacatcgtaatttagagcatatacacatttttttttgttcataggacaaaatttcagaaatcagggcatggcaatatcagaaaatgagttactccaacgattgatgcttatctattccttttgtttgatctcttgtatggattagtatttaattttttaagagttacttactccctccgtttcacaatgtaagtcattctaacatttcccacattcatattgatgttaatgaatctagatagatatcaatatgaatatgggaaatgctagaatgacttacattgtgaaacggaggaagtaccagattagacattttatatatatatccagatttgtagtattataaaatgtttaatccaatactatatttttacattttggaagtgagggagtaaatcatttctttcatgtccctggccgacctgatcagaatcgatcagatgcatgcatcacatgagagatctcagtcaccctctcactcaaacaagatttcttcaagctttgtaacctgatcagattacatcataggagtaccctacataaatattgaatcatgagagagagagagagataggcaatgagtacccagtttcagatcagaactgaaattccaaatgacagaaattagtcactgtttcaggaagtctgcgtatattccaagggttgctgccccttttgcatgttcagcagcagtttgtcatttgacaatatgctttgctgattcgatgcattgccctctccagtaacaggagaggaaactgaacatacaaatatctagcttagctagctagctacactcgtatgggcaatggatgccaattgcatatgcctctctgcagcagctgcaacgaaagcaaaactgttcttctcatcctgtacatctccctgatcatgcagcctgcagctacgtacgtgtttgtcgctgaccaagtatttatcgctgcatcatctgacgaagctccatttctgaattctgatttgttctccttgtgtcatgtgccctctggcgatgagccgacctgccctcccttccagacaattggagcaatcaccatccatactgaaagtgcaggtgcaacggcagttttgtcagtaatatacagtagctagtgcagatgtagctcgtgcaattgcgcggctagatattgttatactatctccgttttaaaatgtaagtatttctagcctgtttagtaaagattaaggtttgtggcggaaaaaagatttattttcacttgtatcattgattaagttttgaattggttaggctctcttcccaaaattctgattgtttcaaaatgcttggatttctgtgtgtacacacaatcagggtactataaatacttatatattatggtatataagttttgaaaactaaccatttttatattttggaatgaaaggagtacatggtttggttcacttactatacacgatcgccgcgagccattcgttgacaacccggacccaggtgctcgcccacccgacatcgatcgtccacctgacgcaatcaatcaaccggatcataacaaattgtaatcagttaccggattatggttacttgatctccttgaatggattatcaagttattaagctaaagaccagtggaagttgttatggctgggattattacttctccatggtttgattggcgttccagccgacgaagagcatagcgaagtacatggcgcccatggcgaacacgaagtggaagaagccgaacccgtacgggatgtcgtcgtcctcgggctgctcgctctcggccttcttgaactgcagattctcgagcaatttcagcatcaatggcgatatgatcataaccctgatcactgatgagttcagttaagtgacagacctggaggcacttggaatcgatccccgtagcgaatgtcgccgtgacgatgacgatcaccgcgatcacgaagctctgcagatgttggacatttcattcttcagatttatacagcagcagttaagcagatgatgacattgttcgattttgttaaatttcatttctgaacagttgattggatgattaccgcgatgttaacccaatctgcactcgttgcaacctcggctttcttgttgcaaatctctgtgtgaggctcactgttcatggcccaaaaaaaaaacaaaagaaccaaagttgtgttataaaatggattcgattccatggatgatcagatcacaaattcagaactgagatccgaatgaatctttcaaagaaaataatcacctcctgatcgctgtccagcagaggaacacgatgtagacccccatcagcccaggcgccaggtagccagccttcacctgaaacccaaaaccaatccaagaacagagcaaatgcagatttcagattcagagattcagacacgagaacacttgttccaatcgagatcgatcgatccggatagaagtaagcaaattagtcgcacaagaccttggagctgagcgagacgccggtcatgatctggacgaggacgagggtgacggtgatgaagaggatgttgagcttgcaggacggccgcggcgcgtaccacacgtacatgagcaccacgcccaggatggagcccacgtacgccgcgatcgacaccacctgcacctgcatatggctgcaccaccaccacctcaacccatgtcagacgtacgccgccattgcaggtgagctgtactcggtatttgatgtgacatatcatagtacttccttcgtatttgggcaccttttttttaaggaaaattaaactcggtaacttttgattaataattatactaaccatatatatatatgctaagtattatgcatattatatcattacattcatattttaaaatactttcatgtgatgctaatttcatatttattggaaatatatagcatggaataaactaacgatcaaaatatatcattg

SEQ ID NO: 67098 - DNA, 64846 bp, Oryza sativa
  unsure (1)..(64846): unsure at all n locations
aaaggagtaggcaccagctagtgtgcctctaacatatgcctaagaggaagaaaagagaaccagcggcaaattactagcctcactaaattcgtttatattgaaaatacacttgtgtaattgtacgccgatttgaactttgctggatagggtcatgtagccacaacttcactgctataccatcaagaatactttagatttataaattattttgttcttctagctgatgtatatttttattctctttttgtacgtgtatgtgcggtcatatggaatgtcaattgcagttttgagagcaagtttaatagtatagcctactactaactccaattaatctatagccaattcatacaataattacttactatactattagtatatgatcccacctgtcatacacatattgcgtcttagagtccgtattgcagctggctacagatttatagcccgctgcttttctctctcatcttttatctcattaaaatatgtttataactggctaatagtctgccattgtactgctctcattgagcaacaaatttcagttgttaatttggtctattgctgttcttggttgaaagtcacaaggtcattgatgtgtgcttacggctgaacatgtctgattgatttggacggaactgtgatttttccccgcttttcaagcaattgggatttgtgacgaggaattcttttctcttgattttgctaatgaaagaccaagcttgtctgcagtgaaaagtaaaggagaaacgtacacaacggatgattttgatcttgcattctggtacagatgtacacagttttgacccaaaactggtctaagtcattagtggagagcttaattatcctttgattatagagggtgcaagaggactagaggagcaaaaccatgggcagagacaggaacagagcagctagggttgtgtaaccttactcccaaggcctgaaaacccaaatatattacactgtaaagtttcagaatagaaaatattggcaaaatgatgtaaattatagcatcttagtttttcttttacaaaacaagaaattgtatactacagtagcccagccatcatgtaaggtaagtcttgctccccgctatgcacaacaaaatttcgccacccgatcatactttcagaaggataactttataggtttttaatacgatggaaaatgttcctctttgatcatttgaaacatagttacggaccttataggccgctatgaaattcttaggattttcttcccacaattatacgacagatgcacacacactactataaacatagtatcacgctcacccacaccccaacaaatatgtttcctaacacacatttagacaaacagaaaccaacggcaaattactttgagtctctatttatcctcactttctttttgtgttttttatggtgtatccaattggtcattcgtgtattttttccatatgttttgcaatatagatattatcaaattgaaaatactagttttttttttgtttttgtgttttatcattcatatgcttttaaatgtccaaatgagctatatatatgtttgcctacgtacgtgcatgctatgtacttgtatgtgtatgatacacgctacgtggtagatcgcgctacttactccctccatttcataaaaaaacaatgattagatatgatatattctagtacaataaatatggatatagatattctctatcctctccagattaattgtactaaaatgtgtcacatcgaattctagattcgtttttttaatgatacggagggagtatatcaaatgcatgggaatgtgggaaaattttattcaatagttgatctaacgctctgtagctcattctctaacagaaggtagatggaatgacacacaggtaaacgaaagtttgtatcatgtataccatgatacatgtaactcaaaacttttttgtggcacacgcgtaacctccaactttcttaatggcataggggtaaaagactccctaaatcatgttttaatttctctgggatccaatgcataaacgtacgcttttttttaacataatacatacattctttgactttgaaatcggaatgaaagatggaaacgattgggttatctaggctgactggatggatattgttattatatatttcctccatccaaaagtttgaagcatattttttttgctttttttcaaattacatatttgtagtctttatttgataaataaaattgttgaccaaaaaccaaacaatcatcttaatatttattggttacatgttcttttgttttgtacatggtgaactagttaattttttttcttgatgtcagtgacaaaataaatatatcaaaggcttttggatggttggaatttgtctgggtacaactttatactagttttataagaaattcttgtcaaaatctagtcaaataatgtaataaatataagtgatctctccatcccaaaatataaggtctttatattttggaacagagggagtagtatcaattcaagactaggattggagtgcatagataaccaaccgttttaaaccatcgttcttaggcctggtttagtttcctaattttttttttctaaaaacatcacatcgaatctttgtagacatacgtggagtattaaatatagattaaaaaaactaattgcatagttaggggggaaatcacgaaacgaatcttttgagcctaattagttaatgattagccataagtgctacattatccaacatgtgctaatgataaattaattagactcaaaagattcgtctcgtggtttccaggtgagttatgaaattagtttttttattcgtgtccaaaaactcttttgccaatatccggtcaaacatatgatgtgacatccaaatttttttttctcaaactaaacatgcccttagcctcgtaagagaagagaagagaagaacatctctgcagtggattattatccatttgtcctcttgttgaatcaatgtttttaattttcaaatcataacgagtgaccctatctgcagacaagcaaaactggtgtgcatgcagctgcagcagtagtttctcccagatggccatatgtacctttcgtgtgcactaattgttggcttcgtgacaattgacgaacataatggcaaacgtactaattaagttagtagtactatactcaaacctccatttgctgctaacccaactaaccaaacatgcatccactgttgaatacgattgcttgatgtgcaatgttggctcgatcgatcgatcaattgctggggttcgattcgattggtcttggcacgcttgcgagagactttaaaaggttggtcgttttctaaacatgtacaagcaccggccataaattttagagagatattttacaactgcatatgcttgtacgacagaaggatccacatccattaatcccttgcaagccaagacaagaaaaacaaggagtgatgaattgaatcgagatcggtcgatggatcgtctccacgagttctacaggctctagcttaagctacgtgattaagtacagtacttacgtgttgttcgtgccaaaggaatataggccttagttgggaaaaaattttgagtttggttgtcacatcggacatacggacacatatttgaatactaaatgtaatctaataataaaacaaattacaaatttcaccagaaaactgtaaaacaaatttattaagcttaattaatctgtcagttgcaaatatttactgtagcaccacgttgtcaaatcatgacgcaattagaattaaaagatttgtctcgcaatttacacgcaaactttataattattttttaaaaaaattatccacatttaatactctatatatatatctctaaacattcgacgtgatagatgaaaagtttttgttttggaaactacacaaggccataattgacttacgtactgctagctggattcgctgttgatacgtccagtaggcacgtatatacacacttggacggtgacggttgagtcagcacttggcaattatagcaagttgcaatccgtacgtacgcagcgacgtgtaggatgagatcccgatccagtggtgcagagcttaatcaaatttacggcgacaataatacagctggtacgcgatgaacatgtcgtcaacatgaatgatttcgatcgacggagcggtagctgtgctagctgtgtgatcgatcggtggcggaagttcgttgcagatcagtagatgacgacgacgacgacgactagtagctacagcttcccagttgcatgcaaaaaagagagaaatccgtgcctactagttagctagcgagcgagctcctctggaagaataatcaccaccagtacgttgctggtgccagaaaataaccactacgccgcgtgacgacgaaggagatagataggatcggtggtgtaatctggcaggttgggcaacgtgaaggacgttccttcaccgacttgacatgcccaatttgtgtcgagatgcagctaagctagctagcatgttggcaagtgtaaccgccggtgcatacgctggtgtggtggataaaccatctttaatcggtcggccgaaattcacaatagtcccggtcccactaaaaatcgggattaaagatgatctttagtcccggttggtggctacagtgggcatatttgatctttagtcccggttggcaaccaaccgggactaaagatgatgtttagtcccggttttaaacctgccaggccttgttaggccccccgggatctttactcccggttggtgttatcaaccgggactaaagatcctaactttactcccggttggtgttatcaaccgggactaaagatctagaagatttagtaccggttggtattaccaaccgggactaaaattcaacgcttaatatataatccttcttccctatcctctcctccacaaccgcctcgcacttatcatctcagatcgatctccctctcctccctctcagatcgatctccctctcctccctctcagatcgatctccctctcctcctccccctcccattcctcctcccatccccggccctgtcctccccgtcctcccttcccatccgctcagatcgatctccctctcctcatcccctcctcccctcctccctctcagatcgatctccctcctcctccccctccacctcctccccttcccctcccatccccggccctcttctctccctttcccttcccacgcagcaggcggccggctgggccgcgcacgggcccagtggcgagcggcggtaggcggcagacgctgccggcatctttttttttttacaatttgtgattcactaagatgtataattttataatttgttgcatgatctgagatgtataatctgtgatgtatttggtttgtgtgtaatttttttaagatttgtgatgtatttgatttgtgtgtataagtaacttaagatttgtgatgtgaatgttttgggatgttactttgatttgaggtttgatttggggatatgtatcccacttgatttgggagaaaatacagggattaaactctagctaaaaaacaatgaaaaaaagagacctaatgggactgacgctaccctctctttagttccagttggtaacaccaaccgggagtaaaggggggttaccaaccgagagtataaatggtttcttcaccagtgatatgtgcgtggccggctgggccagctccgttaggcaaacgcatcttgggggtgtttagagtatgtttagttagtgaaatgaaattttattttagtgttatatcagaacgtttgatcggatgtcaaaaggagtttttggacacgaatgaaaaaactaatttcataactcgttatctggaaaccgcaagacgaatctttgagcctaattaatacatcattagtacatgtaggcacatgtaggttactgtaacacttatagctaatcatagactaattaggctcagaagattcgtgtcgcgatttacatgtgaactgtgcaattagtttctttttatctatatttaatactccatacatatgtttgaagattcaatgtgatgtttttgggaaaagatttttggaactaaacagcccattagatcccaccctaaaattttacaccctgtcacattgaatgtttaaacacctgcttgaagtattaaatataggctaaaaaaataattaactgcacatattgcgactaatttgcgtgacgaatcttttaaacttaattgctccatgatttgacaatatggtgctactgtaaacatttgttaatgacagattaattaagcttaataaattcatcctgcggtttactgacggattttataattagttttttattagtgccaaaacacctaatacgacacactatataatatccaatataaaacgtcaaaaatttaaacctgtgaatctaaacacccccttcgttttcgcagcctgcgtactctccggactccggccggctgcgcctgccgcctcgtggtggtggtggtgggcgcgtgctttgtagttgcgcgcgcgcgccggagagaaaaacgtacagcggcgaaggagacccccatcgatggagtcgcgccattaatttgtcctacaccgccaagttgcatggagtaatccaagataagatgggttgcttgctataggctaaagtcacaaggaacatccgcgaaacgaaaagaaacaaaagagagaaaaaaaagaagaagatcgatcaccttggcgtcggcgcttgcgttgcccacggacgctcctatactgacatgtgggtcccaactctaccgcgagcatctttggcttggttacatgtgttgacacggcgtgtgtaccacgtcgactgaaatgaccggaatgcccatccaagccacgtccggctcacgtggaccacgccccctggttacaccgaccagatttattaacgtggtagtctaccacgataaataagtaatttcatccttgtcgccgcgccttcatcatgtcccgtgtgctaccctaatctacgcgaaaaataaaccgtttaatatttccataacctgctcttttttccacaacgatccagtaagtttagaaacggactttttcgcccatctcgctgtgacaccaccaaacaaagtcgtcagtaccagtaacactattactccatggaatacaatacagtactccatagttctatggtactctctccgtcagtggcggatccagaaatcggtccgttagtatcatgatatatctatcggtgttatagtatactaattatacttagatcatgatattataatatatggataagcagttttgctataggttttaccgaaagtcgtcggtgtcgcctgacaccgattcttatactgtagctctgcccctgctctccgtcccataatataaagaattttgagtttttgtttgtattgtttgactacttgtcttattaaaaaaattgtgcaattataaaaaataaaaagttgtgtttaaagtactttggagaataaagtaagtaaaaaaataaataataattaaaaaaattgaataagagtaagacctcgaaatccattatgttataggacggagggagtacttctactttgccataattaccactacggacctggacccacgtcttgccgaggcaactgattaacgagaaagacagggggcaaagcgataaactccggtaccccacgccgtgccaaatccgtgcactcgtcgcatttgcacccgtaatgacggaaacaccctctctaacctgagacgtggcaccgtagtgacaggaggggcaaaacgggcattttcatccactcgaggtcaggcgccgcggaggcgcggaatttaacgcggcggggccccacctccggtcgtatacgcagccggtggggcccacaaggagtaggcctcgcgcagcgcgacgtctcggtcgcaacgagggcgacacgtgggctttggatgggccgcatcggctcggagtcgggctccgatgtccgatccggctcggggataggcatggacacctactactacgccgcatccgatctggatccgatcccgtgccgtgcctgccgcaccgctacccaagccacccgcatcgagaggtttttacccctgtgccactatcggtttcttcgtctcacctcacgtgctctggcccacaaaagtagtcccactatttgacacgtaaaactttttctatataaggggtgattagattcagaaagttttggtgtactatatctagtatgatgtcgtaagggtgttttgcaataaaaaactaattacataattagttagtaaatcgcgagataaatttattaagcctaattaatccgtcattagcaaatgtttactttaacaccacattatcaaatcatgaagcaattaggcttaaaaaatcgtctcgcaaattagtcgcaatttgtataattagttatttttagcctatatttaatatttcatgcaggtgttcaaacgtttgatatgacatggagtaaaatttttggttgggatcaaagcagggcctgactctacaactatgatactatcttcgtttttaatagatgacgccattaatttttaacaaacttttgatcatttgttttattcaatttcttttacaaatatagaatttaagttattcttgaataaaattgataataaatcaatttgtaataaaataaaatataattattttttctttaatatgataaatcaaatttatcggaaggaagtattattataaatctccttgctcagctagtatctggttggttctgttcaatccgttgagctgataattttactgttcttttagatgaggtgggatcgagttgtgatgagattcaaccgatagagggccttgcttgtgcaactcttttcgatcacgatcaagaatgagttggcagccattcttttctcaatggttggacgtctaacaacctctaaatttctccctaattttgtcaatctaagatatatcaacacggacgaacagtgttctgcacccgtaacttccaccgctagtccgctaaagtgtacatacctagctatagccttccaagaaagaatcctggtgctatgcatgcaatttagctagcctaattaaagttgcatgtacaagcaacgaagcaagggacaaatttagatgtggccaacaaaacggtgactaagccacgcgtgtctgctgtgagaattactacaggcacgcgctatttcattgtccaccagcagcttccaaacaatattctactacagtaccacgtaacgatccttgcgtttcacgtagcatctaataattggatgaaaaataaaaatatccaaaaaaaaaacagctcaattcacacacacacacacaagcgaccttcatgaaagcccccattattttcctagatgttgtacttctactgtctacgtatgaaaatattactgtttacatcagaatctagcaccttaatttccagaaaacagtatttctggaacttccgtcgttcatatcgaaacttcttattggatagttcgttaagagatcgcatctccccacgtcgcccttgtgcaggcgacacggggggcgaaacgcccagcgccgccgcctcccccctggccgccgccagagctcaccaccggaaagccagctggtgagcgaggagggcgacgacggggccttctccgacggcggcacatccttttaggcgcgggggaggcggcgagcgccgacggcgaggagtggcagcaacgtgccctcccggcaaggcggcggtagatccgccactgcagtcgccggatctggcccgccacaggctggatttggtcgaagcgggtggcgacgccatggcgtgtagccggcattggggcgctgcagtgtgtgtcggtgggcgaggccggcgcgcgcgggtggcggaggctggcacgcgtcgccctttcgatggtccggtgggacggtcgtcgtcagggcgcgttggtgactctgcgcctctctagactaccgtggcgactctggcgcctctccaggtgtccatcccctcccccaacccacctctgctgccacctcccttcctctcctcctcccaccccttccttttcctcccttcctctttttcccacctagttgtctagttgctctgctgctctactcgccccagctcttcgctgcgttggtggtaaagttggaggtggttgtcttagttgccagggacggtctcttgcaaagcccgatggttcttggtggagatgtggcctccgccacaaagctcttcttggatcttgtcggaaacatggaagactccgatgtctctgttgccctgtcttcaactttcagttcctcctccagcaggccagacctcctcgccttccttgatgctccacccttctgttggccggtctgcttccaaaccttggtcgtggagtctatcggtggatgaggagacgtgttcgtccgtgaagttggtccaacttgttcgtggtcagggctttttggtctcacccgtgcttcaagtgccttgtgtgctagtgaacatgtcatagggccgagtttggagcggtgtgctttgtcctctgtagtgctagagttttagtgcttaggcggagtcggagctactgcatcgggtctaaccgatgagctgggcaacgataactctcggcacttttgctctggtttcttggaggttctgcacctttcgagggagtctcaggcgaaagccctacctagtattccaggatcggcgacatcgacacctgtgggtgccgtgtcctccttggaggtgtcgctttgtttgactctcttccccttcaggttaaaacccaatccagttttggatgggcgatggcagcggcttctatcgttgcttccctccttggaggcttcgctttgaaggtctagctcttacctcggtctcttatgtggctcgtagttgttttatcacatgctttttcgctttgtcttctatgtgggtttttgccggtttccccgtagtaaacagtgcagttgtatggtttttgggcctggttttccttataaacagggtcaattctcttatgcttataaattccgatagatctcctaccgtcgtttcttaaaaaaaaacttcttattggaattatttgataaacaaaacaaccctaaccagaatttccgagttatggattggaattctttttcaggactggggtttttagaaagatttaggtcgattttgaaacagatttgaacccgattttaaaggaaaaggaagagaaataatatattagttttattgatgggctattgtttcaatcggcattggcttaattagaaggtgtggtcttgtcttaatagatcttatagttaaattaaaacatcgtccaattgacaaaatcaatttattagttttaccttttcttttttctccttggccctttaccctttgaatctcgttctctcttttatttctactacctaggtgtgaagatcagagatactgtatacgcgcatggatagcatatccaactaaagataggaggtgggctatatatgtatattatgtaaatatagactagacttgtttatccaggcatattccataagtcttagtagtgtacaattatgtaaatatatgaggaaaccgagtcatgtacgattgggatccttccccttataaggtgggcaaagagccccctcagggcataaacacattaagatcttcagatcaatacaacctcttttagatacaatacctgaaacaggagtagagcattacttctcgtcgagagagtctaaacatatctaaatctttatccttttactcatccactttaatctcgtgcgctaccctattttttcttgccggtttctagaattggcactaggtttcttttgtttctactacctaggtttcatcggccgatcgagagcacgtgccatgacgaggtccctttatactaacaccggaagttccgatttattgacgggatgttcagtatccccatagcggagcatcttcagaccgttgtgggttgcaaacagaatgatcggtgtgtgttgtagagggcagtggtgttcctacggtattgtagccggggtcacaagaccccggatattccattctttagctgtttaagcttataataattacagtatattattaattgcaaattagagtattatatgtattaggacatgtataggattctggtgatttttttatgggttcgccattggtagagggacacgtttttgtcaataattacattactgatgtaacattatttaagaagatagaaatgatgaaacagtgactcatacatcaccttgtagcctactctatcctttattagaagttgcggacgagaaactgacaagcacattatcacatccgggaatcgagaagatgggcattttcatattttattttagaacagagaagatgcatggacatgcatggcctttttctccttgcaccggatccgtggatgatgtttacatttacctgcagatcgaatagttttcgagaaaaaaaatacctgcagaacccaatcagttcttatctatcggaacggtatcgctggttcactcctgttcctggctaagaactgccaagcgaatccaagttgccagagacgcaacaagtagccgccggaaaccatgaatacacagatagcgattgtgtgaggccaaaccgaaataacgtgtcacccaaaaagaacaaaaagagaaagaaagagagaacaactaggagtactctttccatttagtaccccaatttgaacgggtgttattacgtttgcgcgtgtgatatgtcacatacagagacgcaccttttattctcattttaattaattaggttgggttcctttgagggttcaaaacccttccctctcgacacataaaacggaatggttcattaatataattttttaaaaaataatgtttatttttttaaaaaaacacacacctaatttgaaaaatgtgcacataaaaaacaagaaaatagaagttacgaaagaggagaaaaacacacccttaagatttatatacgaactgaccatgacccacctggttaggttcttcatacgaaattgaaatgatagtagggagtgttgtctttccctacgtttgatttataatacggtagagatattttctttccctatgttgttcatgtccctcgtggggaacaatttaaggcgtagggtacagtagtgttggatttaagttataggtttggcatggataattatgtttacgggttattatcattgatatgcaatgtgttgattgatagcgagatacttagagatgctcatcaggtaagagatgtatgtgtgtttccataaaggtgtgaaagaaataatttagattacgcgacgctcagccagtaaggtctctgttggtaaaacttatccgaaatcaagtttggtgacataggtgctcacatttactatagcttttttgactggaattaatctagtgacacgatgctcgaatttttgatgacaacgagacgcttatggtgaattcgacaaagttgatccagtctttaattgtagtagtaggaatatagtgtgccgatatgtgtatatgagcgactaatgtattttttttaaagaaaataatttagattatggcattcgaagttgcaaacacggcgaaccaacgtgccgggcaaactatacgtgaagcaaagcgagcgatcggtcgatgcgtgcgtccacgctcgcgactcggactcgatccaccggctgcctgcctgcctgccttccttgatgccttccaacctgtggatctcggcatatgcaggcgacttgacttgtactccgttagcttagctagcatatctctagacccatcgacggatcgcgatgagtgatggattgcacgcaccgcacagcacacgggaaagcgacctccaccgtgtacgcacccatttgcatcaatcgaatatatcgtcatgcgtgtagccgcagggtcactagggtgtacgtgttcatgtgtttgacctggcctagctatccagtttcccaccataacctggtacacaacccacggcaatacggcgtttcaggatcgtgcacacacgactttgttccataggtacgagggaaaacgctcaaagaattctatatgtgttaaggctattccaatcagatgagttatcgtcagaaaagttaactgacgagtttgtctactgattgttatttttacctaatactatgttgttattgtatatgcaaggactaataaataggatatagtagattgacagaggactagtgtctagatagcgaattaaagataacgaacgctaagttccaatagcgaaattaaaaaataaccatacatttagattgtgtatcaatattaacatcaagtttcacttaaaatatagaagaaggcacaagatgcaaagttttcatattatatgtgaataatatcatttaagcattatagcgatccaacaaagttaatagtggattgctatagcggtcacgaaatgctataacaggctactataatggttgcggagcgctgcagtacctgctaagtttcaacacgctatcttcagtccgctgccttctagcagtaacggtagatgtccgctacactgttacaacggtcgctactaatactatttattaccttgcatatatgaggtggttaatgatctacacagttgctttggatgaatttattcaacttatgcaaggacgaatttaacgtggttgtcaaaattctttcctcgatccgccgctggtgcaattcttggatggaacacgtaattgtccaacgaaatttcttaggtgcaaaagatcaaggtagtacaagtgcatcatgttcgtttgcaagggagcaaccaccagtcagggtgctttgttgttctctcgttctggcttgcggtcaatacaagtgatgctacaagtctctggttgtggttggatctgtgacaacgtgtttagaactaatcaatttgcaaatggcctgcgtttagttgcctgtctctattaacaagttaccacctgagcaactaatttaattaagtctacaaaaagttgttaacttcaacctttttctacacaatcgatacaatactaagtagctagggaacaaaccaaaatggcagaacttgatgacaaaagagttaaaatatactagtgtttggcacaaatatgtgctcggtcatgtttggcacaaattcaaaaattaacgaatgacacttctatctcaaaataaaaactaaaatcttttatattttaagacggtataatatctattgtatcgttatatcagttgattcctacatcttccaaacaaaccatatatgtacaaattggattatcgaggcataactcatcgataacacatcaccgtcgttattactttgagactactttacatatgaaaaatataattggaggtaccgattgtcttaactcatgttcatactttgaactgcaaatataatgaataccttttttcatagtgaaatttaattcgatctttactttaaaaaagttattacaactaactattatagagttcaaaaaaatacaaacaactattatagagtttgtaaaacgaatatctattaattacttcctccgtaccaaaatataagtatttttagctatgaatctggataacatcatagtagttgttcagatttatagccaaaagttattacattgggatgaaggtagtagattactaagaatacgatcttaaaagatatactagcttgctttttatgtacgatctttaagtatatgactggcagagtactggtagcatccatgactatataagcatggataattaaaaaaacacaaatacacaaaaaaaatgaaactaaaaaggggttatactatttttcaaactctagaggctataatatacaagacaagatcctggtgagaggctgctagctgcaaccctatttacgactaatcatcagacaaaccacaacttggtgatggttacgtgggtgtgcattttccataaaactagtgggcaaaatgcagtctcgcgcacagttggccttgccaatttgtaaaagcgccgagaacccaccgttgaaaaatccaagtcaaaaaatagaaaaaaagcaaaaccaccagccgtagttgagccggctccaagcgagccgtccactcgcgattggtcggaaaagaagatcgctatcggctcatcttgggtcggctcggctcgcggacgccaaacccgcggacttgaagcgcagcggatagcggacttaagaatcgaaatttaaatcgggaaattaaatagaaactggaaaaaggcgacgcgcccgtgacggatggccccagaatcccgatctccacgctcccgccactttttgcgctttagcccctgccaagatttcttatcttatcaatcctctgaataaaagtatttgaaaaagtacccactgttctggtgcttgaatgtgcggtgtatttgcgtttaagaccccaagattttcatgttttgagaattgatccgacagttggggtcacatgcttggcgctttggctggttgggttgggagcgtggtttttgcccggataaagggtagagtggttggttgggtacttgggttgggttgggtggtccattctgtacggtgcgccgggtcgtctccgtttttctgcctaagccattttggacaacaaagaaaccgtgcttgaatactgttttcttctttcttttttgtgagggatgctttttaagtttttgggtgttggtcagatcttcacactgttccatgatagctgccggcactaacccttcactgtcgattaatatatatggtcgattctatagttgtagtatccatttggaatcctaattttgtcattatcactccaaaacaattaattaagttttttttgttctaaaggtattcctttcaccatactgtactattgtaaaaccatataaatgtgcacagcagtgacacacacagaacaaaaagaagaaatatcaagatccgcgtgggtaaaatatagccattcttttttcccctcttaactaaaaagagacccgttaaaacagcaccgattagcaattacccctcccacgaggcagagacggatgactttacagcgaatcaaaatccaaaccggtggcagaaaaatatcactccctttggaaggcgtctccgttccaacccccgtctagaacgcacggcacgtcaaggcaaaggcacgaccacatccatagaaacctgacttgccggctgcttgctggtcttccacatgccacacgcacccctccccgaccaaaaccaaataaagaaaacgtctctccgctcacgagagccagccgtgccaaccaagccctcaccgcaccgcgccgcgccgctcccacgcacgcacgccacacatgtttttgcgcaaaaacccccccgcgagtgcgcacccggcacccgcgtccaacgctatatattacgcggcccccaactcggcgtcgcaccgcaaagcaacccccccttgctttttgtactcttccatctcacaatctctctatctctctctctcttccttacgcggcaaaacacaccgtcgtccatggacagttctaataacaacaacaacaacaagagggcgcgcgacgccgaggatgaggccgacgaggccaagaggctgcgggcggaggacctgctcgacatgctcgacgatgataccgacgccgggggcgccgccggcgacctggcgtccgtcatgcggagcttcgaggaggagattgttgctggggatgtcgccggggacgttgcccccacgacgcagcccgagctcgggttccttctcgaggcctccgacgacgagctcggcctgccgcccgccaccgcgtcctcgtcggaggaggaggccggggctggggagcccgaggatgccatcgggttcggcggacagatctgggggttcgaggacgagattggcggaggcggctacgctggcttcgccctcacctcgccggaggcggtcgccgccgccgccgccgcggcggagtgggacgacgacggcttcgacgccggcttgttcggcttcggcgacgaggtctcggcgcttcgccacgagaccatgccggccgtctgatgggcctgggccgaagtggattagtttttttttattttcctcgttttttttaaatttggctaaccttagctctacccttgtttaaccttggatgtaaagtttctagtagaaggttaaaaaaacagaggggaggaaacttggaaaaaagtttcatggatggagaggagaaaaaaaaaacagatgtaggcatggttaaaagaaaaaatctgatgacaatgcctcacgaacaaaaatgagaagaatggcttcatgccttcataccagtactacgaccttacaaatattttatttcaagcaaacgaaagatttaatttaatcagctgccacgataaattacatggagcagttcaaacttcaaaaggatattgtgaacggaagagaaaataatttcatggtggatgaactgtcgacgttgacctgcacacatgacaaaccgagatggaacaaaagatctgaaatgaactgtacagcactaaaatggacggaaaattcgaaatccgaagcttccagtcctccttggagtgcatgaaaaaggtgaagctgggaaattgtgaacgtttaattgaaaaggagcggataattgaggccggcatggttgacctagaaatgaaatctttatgcaatttcgtggagcgagataaagcccacaggaaaagatggtgagccaacgtctttcacgtcggtttcaggtttgccgtcggcttgaggtaaatgggaacgctggagaagagttcacgaaactcccgtggaatcatcctttctttactactcctaatctttaataaacaaaataaaaaacaatatcttgtgggtgcatatgatatcaaagtctaggtcgtatgtgcgcaaaccaaatcttgttctgaaaaactccctactagtactacttgacattgattaacacttgcgtttttaagttaggcggcaattcacatgacataacgaaaatcgagtgttcttctttttttttttttcgttccctctccatttgtgtcttccatgtttggttgaagatttccagtgcctgtctagtgctatcattgacgctaggggccaaaccacaaaaatacttttcctgcaactgcaagtataatatttacgggtcatcagtaacttattcgcaatcaaaccttctgtaattctctggcaatatttattttgggagcaggaaagttggattgggagatggaaagctgatagggccatttaccaggaaaatttaattgctgtgatcgcatcgcacacgtcgtgcttgccccggattgcaaagtagtcctaccacaaaaggttgtgttcaaaccacgcaagctaaagccacccacggcgttgtgcttgtttaggaataatcggtgcttgatttctctctctctctctcgggacgtcgttttctcgtatgagtaaggccggtttcagatgtgcgttgccggtgggttttctcatttcgtttgtagcgtgtgatatctcgcctgctctcatgtggttcgcggcgcgccgatcaaaaccattactccccggcaccaactgcacccgacccatccaaactcatcatgtacactgtatagatcgatggacaccaatcttggctgtttcctcgtcatcccccctcacgaaacacataaactcatcgatccggtacagtaccccatatctatagtagtccagaagcaacaaactgcaccgcgttttttctcggtcaagtgcggtacggtttttctcttggcgttttgcgtggtatgcaatagggagagggggtatagtacgtacgagtaatgcacggtcggttggggaggtggttggatcgcgagaggacggcatgcgagatcggttaccgcacacggccacatggtgggcagcggcggtggcgaccgaccgctgccacggcggtttgcaacgcaagcaaacagtacgtgacgggaggtcgagaggaggcggcaataatggcggaggaggaattgaaaaggtggaggtggagtggtggcagaggctgcatctgatggccattgcatgcgaatgtgtgtgtggatatctttattaccggtacagcgtctaaactggccgccggcccatgcagcgtgcgacgagctgcagatcacgcacatggactggtgccggtgccggtggttggatcggggatctcatctaaataaccgactttgtgttcaactcattgcaaccgctggtggtggtctggtctttgatgtgagctctccccctttctttctttacttgttcaaacgatcaaaggtgggtggtttatcagagagccatgaaccggttcaggatgtggtgagaaaacgatggtctgaagtgggtgattctgtggctgatgctgcccatattataataatatcgagctgtaactgcaaacggtgcgacctgttgcaatgcagtgacgttgaatagtttttcctttggttctgatgggctggtgcgtgacggtgaaatttcgggagcatatcactctcactgaactacccccggtctactctactgaaacatagtccagaaaagacatacgcttggtgggcctaaggcccaatgtatcaaggaataagttcatctgaggtcccttaacttgtcaacgagtccgattttcgtctttcaaccagaaaaccagatacaacaggtccctcaactatcaaaaccagtgcagatgagatccctcgacggttttgagagtggttttggctgacgtggcgcctacgtggcaaatttgacttggtcttcatctgatgtggcattaacgtggcgcatctgtggcaatttgatccgaaaaaataataaacttcgtgggacccacatgtcagcctcacacataaattaataaaaaaatggtgggggcccacgtgggccccacatgtcattctcagcatctccctctcttcacctagagcccctcttcttcttcctctctctcccttctcccatccccgaggtggcgggcggtgtccgggtgagggatgacagctcgcggcagccgggcgaggagggaggtggcacgtggcggccgggcgaggagaggcaacgcgcggcggaccggcgaggagggaggcggcgcggctaggaggggggcggcgcttggcggcctggagaggagaggcgacgcgcggcggccgggggaggagggaggcggcgctcggcggccgggcgacgaagggcagctccgacccggatgtgaccatcgaggacgtcggcggaggtggccgggcgaggagggaggtggcgcgtacggctactaagcgaggaggggcggcgccgtccggctgggcatcgcgggcggagcggccgacggagtgtagctgtcgcactcgccggcaacctccgctgcctgcggcctgtcgtcgctccgcccgcccctcagccccgccgccgctccgtccgccggcatgctcctgccgccgctcccgcgaggacgaggaagagcgaagaggaagagaaacgagagccgagaaggacttgtggggcccacgtgggccctaccattcttttattgatttatgtgagactgacatgtgggtcccacgaagtttattatttttccggatcaaattgccacgtatggcgccacgtcaatgccacatcaaaagaagactaagtcaaattttgccacgtaggggccacgtcagctaaaaccaccctcaaaaccgccgagggacttcatctgcactggttttgcactggttttgatagttgagggacccgttgtatctggtttccggttgaagcacgaaaatcgtattcgttgacaagttaagggacctcatatgtacttattccatgtatcaatgactggtaagggcagctcggttcccttagcccaacacggcgagcgaatatggtgaaatcatgcggcctgttagcccaccgtgcggatctggactgtgatgggccaaacaaatatccggccaacctttttctctcgaaacatgttcatgccattcgcatgaattgttcatagccatttacgagcacacgcaaaaacgagtagtacctcacaaaaagaagcagtgcgctaacaaactgacatttaccgcgactgcaaaggtaaaacagcacacgaacctttttgtaacggtaaatccccaccggcacgcatgcgcgctacgtataccctgcagttaacctttggcccgcaccgtccactgcattttttactcgtttcacccgcctttctactcctactcggcgtgcaacgcagcggtgcaactgctgcacgctgaccggtccgctgtttgtgttcgcttggtcaccgcaggggatctccactccacgcaccgcacgactccacgacaaagttgggaatccatttggctgcataaaatatttcgcaccttccttcacaaaaataaaatatttcgtactgtaccaccatatgagaaagcgagagtccgtccaagtgggtggcgactcggccgcgcgtcacgtggcgcgcatgccgccccgtacgtgcgactcatcggatccgctcgtggtcgtgccacgccgacgccgatgcttttcttcgccgccgaaacaaaaaccggcatggtctactctactatactgtctactactactcgaccatgcatactgctgcagctgatgatactgtatattatcccgtctgaaaagagagagaggaaaatgaaaaactaaaacggcgcacgcagctcgcacgtgctgggccatgagggaaggctgctgcgtgcacagtgcaaacagcttgcacgcctcgaaaagggagaaaagaaaagaggagaagaagagaaaaagggacactaccggtactagcgagaaagaaagaaagattagtcaaattgcgcacaccaaccgacaagggcttccatctgggacccacccacccaaccggaccggctcgcttcactccctgggcctcgtgagtgagcacctttgggtctgggtctgcgtggcggccgcctacgcgcaccacatcgagtccacacatgacacacctcacgcgggcgggcgtgccagctgcaaaggcgagccgaggcccatctcctgcgacaaatgtccacgttggtctcgccacgatgagaaattccttttgctttttcctgccgaactaattccttcccgaatattatctccctctttatttttttctcctccaacgtgtaaatatactcgctatattccaggtatagcatattagggtttaaatgtttgtacaagattagtgctcgtgctcctataaggagcgaatattttgttcgagtcactgcattttgagtaaagaattttttttccatcttatgcatattgagtaaaaaaaaatacctttacatagaataatttccaaggtttcctaattactccctccatctacttttgatagtcatatttctaaatctgaaaaaattatttttgatagacatatttcaatccaacaaattattatcttaatggctttcttgaatttaatgcgtgactctttattcttccacacaagattgactatatgggcatcgagaaatgtaaatattaataaatcgcttgtttatgaggaatgattagtagcatgtttagatggatgataagtagaatcacttatcgttggtctgtgtgccaaaataaaatatgactatcaaaagtagattgaggggtactacataacaagtgcagaagttactgttagtatacacttttttttacattggtaaccaaccttaaataatcaaaagaaactttttttttcggttttcaatatagatcgaatgtacaaatctttgactttttctgcgaagaatcctgtttacggcgcataataagatcgaagaatcacgcctaactgcatgcagatacagtgccgagaacagaatcagatctgcggattaacggaagacttgttttagcttccgtctttttatctggccatatgaaacagtctctcctaaaaatagaatcactgtatagtaaacaaatcttgggattgtcagcaagtgccaagtccacgtagaggaaaatcttccaaaatatatcgtgggtcatcagatgagagattctcgcacaaaacatgcttacgtgtcaaacgaggcacgctacgaaaaaagaggaagctgaccaatcgacggcccctccgtggccacatgtttttgcccgcttttccaaaaaaaattccgttccgttttacggtgcccgtttaccttggccctcaagttagctggaaacacaaaatccttccaattctgtcgtggggcctctcacgataatttcagcattaagtactttatttattctaaaaatatctatcgccatttccatgtgtcagaaattagttctgagttaaggacgtcttgattgggagattagccttggccgcgtggaatctcaaccatagaatcccaatccccttcttttccgttgccctatcactagatctggtcactatgcagaagtgtaaggggcccacatgtcatggagacgatgatgtacaggccaggcgtgtaggtgaagcatttatcatttgctagccgcctcatctcgcccattcgcttccccgtcataaagcccccccaaaaccctccccacctctgccatttggtgcttatccccatgagtggtggggacacatcgcccgggccccacatgtcagctaaaacccccgcatgcttccggacggtagcaccggtaccgagatttttactccgcgaggtgaccgctctgtcactgcgcgtgggcccggacgtagtagtggcccacccgtcactgtgttcgtagcaggcgactgtgcagaaatctggtgcgtgaagccgcagaatatcatccggaggcagagaggccactcccgcgtgacatgagggaccatatggtggggtgggcccacgcgtcagtgtgatggggtgggggataggcgcgtgagggagaggaatgggtggaggagtgggaggggattaaatatcggcggaggagacgagcccaaccccttttgctcctctcgccgttttggtcggggttttagcgagcgcgtgggaggccggaggcgacgacgacgaccgcgccgccgtcggagaagaaggccgcggaagcaccagtaccagcacccgtatatgtcttctagccccttctccgatctggtggtagtcgtgctcctcgtctgcgccgtcgtcgccgcagccgtcctcctccccctcgtctgcgcccgccgatctatgcaccagaggctccacggctggaacaagtccacgtcgatgctcaggtgcgtccgggtgccccttccccaccgtgaaatttttcatctttggcgaggtttacgccgatctggagtggatttgaccgggtttcgcggccggttcgtccagatctggagggttcttggtgggtttttgtggggtttttgattgatgggtttgtttctcgtctgtgattttgcagggacgggttcggggtcaagtattccgggttcctccacataaggccgtgtggtttctgtcgaggagattgacggattcgatcgattcgtgttcgtctccgtcaaatttttgcacaagagaaaaaaaaagtttcccccttttagagtttttccccttcagttttgtcagttttggtgaggaattttagagttcttttccggcaagagttagaagaagagagaaatggccccttccaagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtgcgcctccggaagtggggcaagtgggcggcggagatccgcaaccccttcaccggccatagggagtggcttggcacctttgacactgctgatgcggcctccgccgcctaccagtctgcctcccgcaacttcgccgaagagaagcgccgccgtggtgtggcctcctctgcctcacctgctagttcggcgacccctactccgactgcgtcctcgtcgtcctcgacttctgccgcgccattcgcccacccttcgccgtcgtctgtgctcgaagccaccaagccagctccaaagccagagtcgccgccgctgccggagcaagctgcaactcccctcctggtggaggctaccaacgagaccgccgagctgccggatgacccagagttctacaaggatatactgcgcggtctacagctgccggacattgacccgatggatttccgagctgggctggatgctctggatatctccgatgtgccggcttacatgaatggcgaacaagacgtactcttcactgaggacatgctgcttggagacttcgctgaagaagatgacctcgacctcgacgacatcggtgatgacttctgcgaggatttcccagagatacccagcggctacgacttcggccgtggtgatatgttccggcaggtggatttctgcgtgtgaattaagagcttgctaaagttattcatgttggtgtgatgggcctgtgagtgtgggtgcttgggaggagatttcttgggttttttccccgagcaaaatcaatctgctcgtgcccttgagatttcagttccgcccataagaactccaacgcacatttagcattcggagagtaattttgttaggttaaaagtatggtaagttataggtggtatgttatgtttttctttttcttttctcaatgttatctggtacctaagtttgtcaagaaaatcatagtggacaagtcaagtatttggggctgtcgtctctgttatggaaagaaaaataagttttgattacattacatatcttttgctctcgagatctggtcatgtcgtcgcattgcaactcgtctcgtctgtatgcattttactctgctggtttaatgttgagattgtgtagttaatgagctgttaccctgagattcctgcactgaggatgtgcagctaattttatgagtttgactaatgaggctagatattttacctatgctgtgatcgtgcagctggttgttttggacgctggtgggcagatcgtgcggtttttttttacaggtgctggtatacaagatgcggctagatccgatacgcatgcgtacaagctgctagacaaagtccgggttcagtgttagctgtgagcagtgatgcgttttgtttatgtggagagagcttggtcgttgcacggtggtgcgtactaaaagtattttcagaggttgtgacctgttagagagggactgagcgagtatactagtattagtacagtagtagtgagctgagccgcctgagatttttattgcgagacttgagcatattggagaatggagagagtatcaagcaagttggccataggcatcgaccgagtgagtgagagagtgctcactcctttcttcgtttataggtgcacttttgtgaaggcggcgtgggggagagtaggccgcgacaggtggttcgctcgccctgtgccaaacaaaactgagccccacgtgacaaggtacagcaaatgcgtacccagctcacggctgggagcagtagcatttggtgtgagtcacggaggtgtgggcgtgagtcacctcgcagtcgcaggccagccgctgcttgtctcgttttggcgcggcgcgcggcgacgcgagacggctggccggctggggccatggtttttcccccgcgggggcgtgtggtgctgtgtggtgtggcgccgcgcgcgcgggtggtgataaggttcccgatgagaccgcggctcaccagggcaaatcccgcgcgtggtcacgccccgcgcgcgtccgcgcgtcctatccccggccgcgaaacggcgtcgtgtagtcgtgtacgtagacatgacgcggcgcgggataacccgacggggaggcgatatacgggcgataccgatacggatggcgtggctatcctattctaggaccggccgcgctggtacgccacgacgtcgacgcctttggcatggcaccccgcgttttgttcgcttcctccctctctcgctcacatgccgtccatgccgtttctgttgtgattttcccacaagcttaacctttttccgaaagaccatttcccagagcttaacttgttttaatttgcgaaaggactcgcacgcatcggcacacttgggacggggtacggcacagctggaagccacgctgcgaaggtggagtgaggtgagtgaatgcgttagctggtaggggacggggacgtggctgggttgggtcaggtgggtggaggatgaatcgaagtcggatgtcagcttggcgtggccgtgcaaggtcgagatatcgcgcgcttgttgctccacggttgttgacatgtggcgcggcgccgatcgaattgccggctcgcgcacggctttgttgcctctgctttttccaccttttgccgcgcacgtcatagcgtgtggctgtgttgtctcgttcgacgtcatggcggctgctgctgctcatctcttgcgcccggtgcacgcatcgaatcattgcgctaagttggtttaggctacctgtggcagtactaggtttggctaataatccacgtgtgtaggtaggttagttacggacttacggtggtgcaaaagtaaaactgttggcagtcacacttgatatgatcgctaaccatagtcttttcggagaaaaatggttcagataggtggttcgatttctgccatagactactcgtcaacaaagtccacgcaacaagaagaatggccacgagccaggtgaaggcaataatgatgattattaagaccgcacctaatagtactaggatttttggcacctaacagcactaggatatttggaaaggaacagtcctaaccccaaaagaattggaacccccaacttcacttccatgttgacatcttcactccctccgggaatacgagtgaccgagtgacgtgtcatttttctttctggaacgttctgtgcggaatccagcagacatccaagcttaagaacttggcgtgttcctacttcgtctttacggagatacagtgtatccatgcgatttttgccgaatcttgttacgaagtactaacagttttcgtcttctcgtttgtacgctatctggccgtcgagtgactcgccaccactcgacgatgtgtgtggatcgaaacggtcgtctttgccgcatgccgaaacagttggtggcggcatgcggcgcatcgcctatcaaatcgcaatgttgcgtgttggaagaggagttattgccggctccatcgtccgtatcgttcgttcgttcgttgaatcttccttcaatcccccggtgcggcgctgctatttgccgatcgcgacgcgggcgccgcgccgcacggccgaactcgacggagacgacacggtggcgcgcttgatggcgcgtgcagctgccacgcagatcgctcgcgcttcacgttagctcatcacaggcatcgcacgatgggcgcttgttaatgcggccttgaattggccctagccctgtttggtctgcatcagatccggatctacactaatcctgctcgagttttgacaggatctatgcttcgtgttgccgatcaggtagacagtccccatcgcgagcgacatcccgagtcaaatcggtgatggaaccagggggagaaaatcgcacaaagtcgtggcttagtccaacttcttccaattatccactcttttcctggaacatatcgcttgcgtcgatggaaaaatataatccatttgattagtcggccgaaacctgtgatataggagtatactactgctactatccctctggctattgccgcttacggcgaagacaaaacatcaaaatcgcaaacgtgtccatatactactactgctggtgacaagtccgtcctcctgcgagaagatccaaagctgccggtaaaaggaatcgcggtacatcgcacagttgtagtactgctcgttgctacagctccaagcaagttgagacaagattcagttttaatttttattttttttctccttcaacgacagcgtctgaccgaccagctgccggtcgacatggtgagctccgcccccgatttctcaacgttttcctgacgagatttgccgtgtggtaccgtggtgcccgcaagcagggccagtggtgtggtcgctgtcacgtggtgttgtgcgcgagatgaggtgagtgtgagggctcgagggagacacagagcaccagcctctgaccctgctgatgatctggggtcaaaacgactccggaggctgcagccaagttggacgaacgagggagtgtattattggcgtattttactgtcgtggaatcaatcattcgtgacctggtgtggagcactctcactcgatcccttggcttggctatcacctggctcatctttgccgttgatatttttgacctgtgcaactcatggattgtcagtcgtagtaggtagtagccggttgctttgctttcactctagagagctgagcagtgcgtggatcactgtactgaatcgcttttagtagaaagatccaagcactaatgctgtcactaaagtgttgtttacaatttcctgcggcttcgagagatgtcaagccagctcgctactttggtagtatcgcttggagcaatgttcctctttctgtcactctaatcaaactccactgttgcgcatatcttcttgtacggagcctgtttaggatatgcagaaaattgaatgtttcatcataaatagcattcactccgttctagtaactttttttcctctcacgtttgttcccaaacaaattcatttttaccaattattgtatcgagtttgtgaaagtacaaataaatgtatcagaaatagataaattaatggataattgtatcgggatttaactgaagcgggatattatggtcctttcgattttatatcgatatgtagggtgagtggaatataacttgttttaggacgaaggcattactagtaataaaatagagtcgagtttatttcaatatattgaggaaaaaataatcatatgtactaaagtgaaaatcctaaaaagagaaaaggggacagcctcaatgtttttttccccgaacatgttgaactaattttgagtaaattataccgttggcggagctacaaggtaggtgtagcctgttacatgaacatgtaaaaacctcagaccaatacaccaaaacggcaaaccgcatcaattcttgctgcgtcgagtacattgagtaggatatcacgtagtcgtaggcacacacatgaggaggatgttatgcggatatgtatgtgatcagtccactagagactaaggtacacttgattatttaggttgtgtttttaagtcaatgttcctaatttcacttgtttctttttcacgtgtatgttttccaaaccgttaaatgatatttttttagaaaattattataggaaaattgcttttaaaaagttatatcaaactatttttaagcttttatacttaattaaccgcacactaatgtgattgttataaaagtacgtcgatataatggaacgacaattaactttttcgatcgcttcagtcattggtcacctaagacacgctaaatgacgacataagaacacatgatatttgttaaagagatttagcctaagcctacatgcatcccagggctctaattatgggcaacaccaagacgctacgagtctatggcctcaccgccatagtcttcctgcgtgtctatgatacattatagtcgccatcttttatattgtggtgccctcctctctttaagagaataccgggttataaagtccgactttaacttcacccctaccaaatattacaactccaagtccaactttaactaaatagtactagtatatttgacatttattctaacaattctcaaccccttctcccgaacacaactagagtgactttcgtcccaccttaaatgaagcttactcgcattatatggtactcataaactgaaaatagaatctccctgtataaatcacattgggaaatcaccctcatcttattgccatattatgcgctagtcgagatgaggacgctcttggcgtcgttgacatccattgctaagtcccacgctataacctctatcacttgaacactaaaaactccactcctcgtctcctcctaactcgaatgacttccatcttataaaccgttattgaaatttaaaatttaaaattatttttttcagcattttttgtttttaaaattacatttgaaattgttaatgacacacatataaaaaattcaaccatccgtgtattaagaaaacacatactctattcgtttttcatattataagtcgtttgacgtttttcctagtcaaacctttttaagtttggccaagtttatagaaatatagtactagtattttcaacataaaacaaacatattatcaaaatatattcaatgttaaattcaatgaaaataatttaatattttaaatgttgcataaaatttctataatcttgatcaaaattaataaaaaaatcgactaaaaaaattcagatgacttataataagtacaatattgcagtataggcccatactggcctggccggagaacacagcagtatttagcccaaaacgaagatgcattggtccacctggcccaagctcagtctaatccacgagcaaacatagacacaatttcaccatttctaatcggacggcgcgcaagtccgtgcactcgtggcagttgcaagatcgccgtccgttgattcacatatagaaaaggcgaggaaaaaactcgagaggaaaaagaaaaagaaagagcccgaaaagaaaaaaaaagggaaaaaaaaactcggagcgatgcactcttgggtgcagcggctgttgacgacggcgacgacggcggcgctcctcctcctcgccgcctgctgcgccgcctccgcgctcgacgccttccacgtcccctccgtccaggcgcaagcccatgtacgaatccgtctgttcttcttcttctttttgctccctttgcactatcacgcctggaatcatccgcgactcggaaccctcgaaattggggatcttctctgcattgcgcagcatgttgatatggctgagatagttctgaaatgtttaggtatttgttctagccggttatcgtagtctatctagcaacgcgaaattgtacagttcactggaagatctttatagggttagggtttagggttctgtgatgtctgggaggtcattggtgtggcaaaataggtggtattttgggggttataggatctttgatgattcttgtttacaaatggagatgctattactggtaggttgttgtcattttcggctagatcatgtacatatagaatgtagacactgatttgtctggctgaaatgtagaattttggaaggttgggtgccaaattctgattctttcaacaatggtaaaattgtgaatctatcagagtatcagttatctctgcaagcagtgctcggttatcatctctttgttggtcttgttgcctattgatattagcatcaatgtgcttatgtaatttttttttcttgtaggttacaaagataaaccgattccacaagcagctcaatggcaacgacaaggtctgtgccttaaggcccttaacctttcgtgcttgcgtgtgtgtgctgccagaggcctaaacgtatttagtttcattatgcgataatttcaaattatccaaatcacagtttcagagtagtgtcttctaaatagagcaagatttcaatatgtgctattctgttataatcttctacgctgtataattatgtcatagtacgtttttttaccttttctcatcaagtagcctgggttctgccattgtgtattttcgccttttcagtttagattcaatacatttcattatgtgctatggagagtttgcttggtctgaagttccgatgttatgaattaacagtcaaaggcttgccttcgctttcttttaatgcaaatctgctttgatatctgtaatcaagaaatacattttagtaaaaaacctttcttgtgcaaaggcttcaaatgttactatcttatactgaatgcaaaatagagtagacatgttccaacttccaaccacctgcagaacaaaatctgtcaacttccaatagcatgatattcataaatatacaacaatgatttttccaaagtaatattatctcactttcatatctagaacagagtcttgtaaatccgcttatgatataatatgtttctctcctcaactactaatatgcacatctgtttgaattacttgatgatttgctgttgcaatatttcctttgtgaaattctgcgaatatatcgatctcataaatatactgtgttacttcctttgcaactacaatgaaaactttgtaaatttgtgtgacaggtgacactgaccttcaacttgtccgcaaatttggagtcactattcacttggagcacaaaacaggtgatattttgatttcactagaatatgcagctcatgtttcaaatgtggtatatcagaaaactgcgctcacgtttatccctgccagtccggcgaacaatattagctgaacatcgcaagtaacatgctcgggtagggattgagcaattcacataatgttactgagaaactggactgctgtcctcaatatagaagcattgaaaaacttgagcaatgagtgaccatcactatttgatactttaacattgtcatggttcatgattgcttatcctgtgaaaccagtaataaaaagatggtcaccgacgatctactgaatgttattgacttgctacatacatatttaatttggcagtccatacttcagttgtaggatttcccaatttttatcacatgattttgtaaagttttggtttacttcaatgttttcgtagccagttactaagttgttcctttgatacaggtgttcgtttttctgactgctgagtatgagaactcgaagaattcgcttaaccaggtaactagttcacattttaccttggccagcagattcttcctgccagtatctgtactattacgaacaagtagctggtcttcaatcagtgattacatgaaatctgtaatcatgcatggaatgtttagactactgtacatacctacccctttctttttagctttttcactggattatttgctccacgcttctacaaatacaattgcttagacctcttgttctaagctatctgttaaggttatttctcaaaatatttaatttccctataaccaagtagataatctgcggcaataattctgtgaataatttgttttgaacgctaccttatagaaactggctgaaatctgtagtaatgttctggtacatgtattcattgtgctggtatagtgcagtctttcctttaaccagcaagtaaacttttgatcaagttgttccaacaagttgctcattgctttgatactatgtagtcagatatacaattaagctggtcaatttatattctatattctagtggttgcggttgatcaatccatgctcatgttgaaattgtgatatttgacaggtttcattgtgggaccacatcatacccgacaaggacaaagcgaatttgcaagtggaggtgaagagcaagtatcctctgattgaccaggtaaagcgtcaatcgtgcttcaaaatcgagtgttagtttgcatgcattcttggaatttctcttgactagaatcatctgctctgctctcatcagggaagcagtttgcgcgggaagaaagttcagcttgttctacactggcatgtcatgcccaaggccggtgtaatgatccgggatcgaatggctctctcagagttcaacctgccagactcctatacatcttgagcagctctgctctatctgatcagttctgtagtagactcacacatgtagatctggtaacaatcctctaatgaacatgacgattaagcattgtgcatcctaggcaaaatgctctttccaatttggcatctgccatacgttaggataattgatggaaaaccgaagcagcatatgaaaagcacagaaacagcggctgcgtttattcttgccccagctcgattgagcacatagagatgcattacatgtgctggcagagtgactgtcagtgaagtactgacatcaaccagctacatcttcactcactgcgtagtacatatatctaagaaacaacggcttatttgttggcatgtaacttgggacggcatgcgtatgcacgaactcaagcaccatggccatgctctcacagcacattggagtttggattgagaggatttcagtgcttgcagggagggccgcacatgccgaggaaggtgtcggtgcacttgaacttcttcacagggtgagtcttgacgacggcgcagctcttgcagacggggtcgcacttcttgacgacgtcctcgcaggtgtagagccccgagaaggagaagttgcagttgctgcagcacttgagcttgccaccgttggtctcagtgttgcccttgctctctcccacagctgcaaccaattatccgtgcaaccattcagtgattaatcagacatttttttacactaatttggatagttaaaacggtgaaagttggttacgcagcagtagaaacttgggttgaattgttgggttctttccggctttgagcctatatccatttatgtggatgaatgatgcttgtgtatacaggctgttaggttggttggcatgatggagcccagccaatgcatgctttggatgtttttgtgcatgtcgagtgccagtgacagtgagcccagtgaatgagagtggccgaccccaagatggcaagatctacgagcctatcctctcgacggcgaccttgtagtttcattcattcggtatgccttagaaaaatctctaaagtatacgatgcataatcatcaatcaccgcaattccgaatcctgataacaacaacacagtacgggaatggaaaggcacactccatggttgttctttctaaaactgtaaagtagttgactggcttttgttggatccagttattagaaatctcgtgagagtgtaaatccagtttacagagcaggttaactagcattttcccgggccaaaacttaatttgacaattaagaaacacacgtaaccattctccttagccacagctgcaaaaatccccatgaccaggacggcctggagaaccaggatcaccatgagcgtgctgctcttcatggccacctgtaaattgttatcgtgctatagctatgcacaaagctttgcccttgctcggtctacttgcagagtgctttgagcggttgtggttgctgctggctaagcgcatctgaccagctctatttataggtgtccagatcggatttttttttctcttggaaattaacttcgtcaggtgcgtctttttttgaccctggtctgcgatctggaatgcacatgtcagcttggtgtttctcccaagcttactttctaaagtacaagaactgtagctattaggagacatcagtgcttaattaacctcacttaatttggcaattgcaaaacctatacctccttacaatgtataacccaacgtcacttctcagtatcagtaacatggagagaagcatcattccacagcataatctgatggtacacacagcacagtacagtcgagtgatctaccacggctaattaagcaactcttcctacatatcacgtggacgatgctcgccatttgcaacaacttgcaaacctgacggtgacctctcataattacaggaatggattcgatctattccccgagaacatgccccagcctcaacaaacaaatcacaccctccgtcctataaaattagtagagtcagattgataccaaaataaatctttccaaaatttagtaatatcaaaattttagtaaagtgacggtttgtcaaaattttggtagaatagactcaatgtaatattgccaaaattctatagatattatcaaatatttggcactaaaaactaaatgtagccacacgattatcatcttaatacaaataatttagatataaccgaaagaccaaacacttagttaagaagtgctaattacatgaaactataatattaatgagctaaaagcttagcttggctagactcattagactacgactttgagcttattttccaccccatcgttgagtgcacctcttatcacactcaaagaaataaatccaatcaacaaatctatggttttactatcctattaaaaagagcaattttaccatccaatatttggtatttcgaggtaccacattttacacataaaagtttggtatcttgagataccaaactttacactagaggtaccaaaatttacactagaaaatatgccgatgtaccaaatatttgtggtacactatgatttgtggcacctcttatgcactcaagcatacataatatttgtgcacactatgattcaaatctggtgggtctgtgggtggaattatgggatgcttccccgttcaaaggaatatttttgttatgaaaggtttaatcattaattgattacatgaaaaagattctctatgttatatagtactaggagtatatgtaatatgttcttctgacatgatgatgtgctaatcagtaaagtgtaataaaagaagttgatctttttaaacttgatggttattaaggtagacagattttccttgctgacagataatatagacaatatatatctattatcacaagataatattaacattgttctcatgtccctctcaagtccaggggaaacacaagtctcccaagtaacatgcaaacaccttctagcttcattatttttatttggtccttcactcagacaacggcttattgttcgagtatacagtatactagcatcgagatatgatatataatgcacactgtatatcacacagatcacagatatatgacagcaatggctcgcgttcatgcattattcaggtcatcatcgatcgatcgatcgatcagtgcttgcagggagggccgcacatgccgaggaaggtgtcggtgcacttgaacatcttcacagggtaggtcttgacgacggcgcatttcttgcagacagggtcgcatttcttgacgatgtcgtcgcaggtgtagagccccgagaaggagaagttgcagttgctgcagcacttgagctgccccgggttgatgtcgatcgccttgctctcacccacggctgcacacatgaaaattcgatcattcagatcaatcatagggactacattgtactgcatgacattatcatcagtaaacatctgagaagacagaaatggtcagtgtgagaacgcagttaagcagcctagctaagataggcgaatcatatatatccatcagcggcaagagattaatgtatacagtagtacagtaccattttcttttgcaacagcagcaaagattcccatgataagagcggcctggacagccaggatcaccaagagagtgctgctcttcatggtgatgttcttgcgttccaaagccttgagctatttcctctacttggtactagtagatggctttacgctttgtgtttgtggttatggccaaagcccaggagagcatctgtatatataggcgttcagatctgaacaacatattagcatgttgccaaatgccattctttcatgcttgatatcgaatatattttttggggatgcatgttaggcgtgcctttgactgacgcggctgctagagtgtgaggcgttgaacacattttgtattcttccatgtcacactcacgctcctatcgtcctcgtcagcggtccaaaatggacgaaattgacaccaccagcaccaacaaaaatcgttcagttgtacagtggtaagctttgcaaatctttaagggaattaataatgatttccccatctcatcacacaaacgaattacctgttttatattattatgtataaatagaactcatgggggttcaaaacactattttatcaactagtagtcctattttttttccttggactcgtctaggatgtaccctctccgtttttttaatagataacgccattgacttcttatcagactattcatcttattcaaaaattttatataaatacataagatttgaatcacgaataaaatactttaagtgataaaacaactcacaataaaatagattataattacgtaaattttttaaataagatgaatgattaaacgtgtgataaaatgtcaattgcgttatctattaaaaaacgaaggtaatatatagaaaagcagtatgctgcggcttaactagaaatggtaatactgattactagagtccctgcgtgtcagcatcccctgcttatcaggactaactgtactgtgtatcgaaatggacccagttttattacaggtatatcatgatcttctcatcacacttggatgacaaaatgattgtacgtgcaaacttggataaccgagcaagctgagctgtccgttgggagattaatcacgagctcattctcgaaaagcaattttttttcaaacgcgtaaaaaaattgtacgttaatatattagagaaaaatagtttttgttacacggtacaatcagttaaactggcgatagaggaaggaagaaaaagaaaaaaactgtagctatagaaaagaaaagctaccgcggcgactaaacacaactctgatcaacgggagagaaggtactctgtgcccttaaaaaacccaaaaacaataatgctagctgaagaccgcacatgatcctctgagataatagactccaaaaccaataatcggtattaggcaacacgacacctttcttgcatatcatgacattccgcccaagtctataagaaacgcagattaatttggctaatccgccatgcgcatgatcaattgatcagctctagcatctcaaagccaaacaagaggcgaggataagatcacaggtcgctatcgagcgttactctcactggcccagcgttaaaccaaaccctcttttgatgtttctggctccacgtaaatacgtcctggctgccaaacctcactaccaacctgtcattagcgaaatcagagcatctgatggtctgtttggtacaatttcaactcctaaatttagctctaggagttaggtctgaagtggagttgtggagctggcagcttcacaactctagtttattttgtgagagagctcttcccaacttcgcttccagttttagtggagctgaaactgtttggctgaactccagctccagaaggggtggaggtggaggtggagctgtgtcaaacaggaggttgtcagtatggcatcgtgtggattggatgttgaaggcggcaggcggctaattaagaagcattgaccattctgatgttgcgtggttcaacacaattctgcttctcaattagtaccatctggaaaacctgataaatgggcctccatggctttttaaggaataagtttacattgcgtccctcaactcatgtacctggttaaatcgtatccctcaaccgctctcgccgtcccaccgcttccaacgtcttgctgctctcaccgctctgccaagctcccgccgtctgccccgccgctctctccatctcgctcgccgtcgagtgaggagacgagtaactgacacgtgtgcccaaaatttctttttatttttatttaggtttgttttttactgccacgtaagcgccacgtcgatgtcacatgggatgaagaccagataaacccgccacgtaagtgccacgtgggaaaaaccgcctccgaaaccatcgagggagtcgatttgcaacggtttttgaagttaagggacaagttatatccggttttgcggttgaggggtgtgattcacccagacgcatgagtggagggaggtgaagtagacttattcctttccgctttttaatctctgtatctatctgggcctaattcttcaaatcttcatgatgatgggccaaaaatctatataggcccttcttttcggggccttttctccgtttcttttggacatccataattatcctgacgtacaaaatggtcctgtgttgactgacgattgggctagcaagagtcagtcacagtagcgtgtaacccgttacagaggtaactgttcaggactggtcatcggctcttttaaggtgatggtgccacctacagcaatgtatggtggttgatttattggtactcaaatctagtttctcttggacattgattccgcgaaccaaattcagtccacgttcgcacaatcgcactatagttaattactccctccattctaaaatataaccactctaacctaaacgctaagaaatactccctccatctatttttgatagacatatttccaaatctgaaaaaattatttttgataggcatagtttaatccaacaacatatcatcttaatgaccttctcggatttaatgcatgactcttcattcttacacacaagattggctacatagacattgagaaatgtaaatattaatgaatcgcttgtttacgaggaatgactagtagcatatttaaatggatgataaatataattacttatctttggtctgtgtgccaagatgaaatatgactatcaaaagtagatggagggagtaattattatcaccttatagtttgaattatcttaataaatactccatccgtcccacaatataagggattttgaatttctgtttgcaacgtttgaccactcgtcttatttaatttttttttgcaaatataaaaaatgaaaagttgtgcttaaagtactgtagataataaagtaaatcacaaataaaataaataataatttaaaaaaatttaaataagacgagtggtcaaacgttgcaaacagaaactcaaaatcccttatattatgggacagagggagtagaatacatgcaccctacaattatagatcttgatggtcaaggatttgaataataatattttagtgaaaaatatgtgctaggtaatgacatgcatgcatgtccgtcttatattattaaataactttaaaaaatagttactccctccggtttcattttaattgacgttttgaacaatgacacggtctacaaaatatacctttgaccttattttttattataatatacacaataaataaatgcatgtttacttttattatagtgttttgaaagacaaatatatatatgttgttatagtttctttaaactaaatatttttgaagttattgatggtcaaagttattaaagtttgacctcaaatttgtccaaaacgtcaattattatagaaccggaggagtatacgttattaaataactttaaaaaatattatggaatggaggaagcaacattgattacgagatgctttctaatggaaaattatgtaagagctgagttacaatcgtgaaacccatctaacacgttacacctagtcttccgtcacaagagctatccttggtttttctgatccactgcatgcgctagttttgcagctgctctcctttatatattcgtgtcatttagataccataccacatcctgctactcataatccatcttgttaagtgcttgtgttcagatcaatggctttcatagtttgggcactactactcttccttttacatcttcccacaatagcgaccggatccagtgcccactttggcggtaacaacactgttaggtgccatccaaaccaggctgcagcgctcctccagctaaagcaatctttcttctgggttaattctccggtcatccttccgacatggcaagatggaaccgattgttgtacctgggagggagttggctgcgatgcttcttctcatcttgtcacggtacttgatctcagtgggcggggcatgtacagtgatagttttgaacctgcactcttcagtctcacatccctacaacgcctagaccttagcatgaattccttgggtaccagcagtaccaccaaagatgctgaattcgataggctcacttcgctcacccacctcaacctctccaattcgggcttggatggtcagatacctatgggcatcaacaaactcattaaccttgtgtccttggacctttccaagcgctatgttaacgataacagtgatatctcttttaatgagagtgatgatgagattatctttacaggtgacagttataatcatctgcaggaatccaggttaatgtccctagtagaaaacctaagcaatttgaaagagctctacctcgaccatgtggatatgtctacaaatgtagatgactggtgcaaaacccttgctcaatcagttcctcgtcttcaggtacttagtttagatggttgctctctcaacactcctattcatcactcccttttgaggctccattctctcacagtgataaatcttcagtccaaccctggtatagctgtcaatctatttccagatttcttcatgggtttcgccaatttaactgtgctccgactttctcataataatctcgaagggtggtttcctgacaaattcttccaactgaaaaatctaagaatcctcgatttgtcctttaatatgaatctgttagggcatttgccaaaagttccaacctctttggagacattgagactagaggggaccaacttttcctatgctaaacgaatttcttctagcaatttcaatatgctgaaggagttgggtcttgaagggaaattaatttctaaggattttctcacgtcgtttggtttgatctggtctttatgccatctagaactccttaattcggaattgttaggagattcaggatccaatttgttgtcatggataggggcccacaagaacttgacatgcttgatactatctgagtttgacttctctagcacaaagccttcatccattagtaacttcaagaatttgagaagcttgtggttgtttggctgtaacctcactaggccaataatgtctgcaattggtgatctcgtggacttgcaaagcttggatatgtcaaactgcaatacatacagttcaatgccatcttcaataggcaatctcacaaatttaaaaagcttgtatatcaacagccctgggtttttagggccaatgccggctgcaattggcaacctcaaaagcttgaagagcatggtattctcaaattgtgaatttactgggccaatgccatccacaattggcaatctcactaagttgcagaccttggaaattgcagcttgtcggttttctggaccaataccttattcaattggacaacttaaggaattgagggcgttatttattgaagggtgcaatatgtctggtagaataccaaattcaattgtcaacatgagcaaactgatatatttggggcttccagcaaattatctgagcggcaaaattccagcacggcttttcactcttccagcactactcttcttggatctttttggtaatcatttttctggtcctatacaagagtttgatgctgtgccttcatatctgatgagtttgcagttgaccagcaacgaattgacaggagagtttcccaagtcattctttgaactcactagtttaattgctctagaaatcgacttgaacaacttggcaggctctgtggatctttcatcttttaaaaggttaaaaaagctccgtgatttgaatctttcacacaataacttgtctgtcattatggatgacgaaggcgataactcttcatctacgtatctctctgaacttaaagagctaggacttgcatgttgcaatataactaaatttccaagtattttgactcgtctgagtgacatgtcttatttggacctttcttgcaataaaatcagtgggaacataccaaagtggatatgggagaaatggagcagtagcgtcgtgcatttaaatctctcccacaacatgctcaccagtatggaagttgcttcatatcttctcccttttaataggcactttgaaactttggatcttagttccaatatgcttcaaggacagattcctataccaaacttatcagctgaattcttggattattcacataatgcattctcttctattctgccaaacttcactttatatcttagtaaaacctggtatctcagcatgtccaagaataatataagtggaaatataccacattctatttgcaattcaagcctgctggtacttaacctggcgcataacaactttagtgggccatttccgtcctgcctaatggaacaaacgtacttcagaaacatattaaatttgaggggaaatcactttgaagggatgttacctaccaatgttacaagatgtgctttccagacaatagatttaaatgggaataagattgaaggtcggcttccaagggcactaggtaactgcacatatttggaagtccttgacttgggaaataataaaattgccgacacttttccatcttggctaggaagtctttccaatcttcgtgtccttgtcttgagatcaaaccggttgtacggttctataggttatacgtttgaggacaaatctggagatcacttcccaaacttgcaaatcattgatttggcctcaaacaacttcactggcagtttgcatccgcaatggtttgaaaagtttatatctatgaagaagtacaataatacaggagaaactatcagccatcgtcatagcatatcagatggattttaccaagatactgtcacaatctcatgcaaagggttctctatgacttttgaaaggatcttaactaccttgacagcaatcgacttatctgataatgcattggaaggaagcattcctgagtcggtcggaaaacttgtttcactacatgtgctaaacctgtcacataatgccttcagtggaagaattccaccccagattggcggcataactgctctggagtcactggacctgtcttcgaattggatttcaggggagattcctcaagagcttactaacctgacatttctaaccgtcttgaacctgagcaataaccaattggagggaaagataccagagtcacgtcaatttgcaacatttgaaaacagttcatatgaaggcaacgcaggactttgtggagacccattgcctaaatgtgccagttggagtcctccaagtgctgaaccacatgtagagagctcctctgagcatgtcgatattgtgatgtttctctttgttggcgtgggctttggagttggatttgcagtaggtattctgatgaaaacgagttggattaacaggtggtttcactcggcggtcagccgccaacgaacttgacctgaatatatatgaggtgtagcagacggtttcactctctggtcaaacaacgacgaacctgacctgcatatacataaggtgcaatgcataaatgtgtagcttgatatctgtattttcattagttactacttataacacatggattcagttcttagtactaattacaccacctttagtagttggtatgcgtagtatgtctactcaggatgatacactctgctgtaagcttggaatcatttactggttttctctctttttcctcagctgtccagtgaaagaacgcctggcgcctgccaaattttatcaagtgcttactgactttctggactactaatatttacacagctagccagctagaggttgggtagtgagaatttttagaatataacactcaatacgcactgcttctaggatttatcacctaattcgtactactttcaaaatacaccactagaggcgaatttttttcgttccgtaacactccgtccacccaaagacgcctgtctgtttgcccgcacgaatctggccgctggcgagctcatcctcccccacgccggcgagctcgacctccccacgctagcgagctcctcctcccgcacgcatctggcgagctagctcgtgtcgtccccgagctcagccgccgccgccgccgcaccaggctgccgccaccgcgcccagagccggcgccggtccaacctccgccgccggagctcgacgccctccgccctccaccgctgctcccctctcctccggccctccaccgcgtgcgccgatggtggcgacggacgggcgacggcggggctgacgcgggcggcgacggaccggcgacgacggggctgacgcgggcgcgagcggtggcggattgacgacggcggcgccgggaggacggaggacgacgggccaactgacgctaggggacggagtgttacggaacgaagaaaattcgcactccagtggtgtattctgaaagtagtacgaattagatgacaaatcctgaaagcagtacgtattgggtgttatgttctgaaaattctcgttgggtagttggtcatcagatcaactgtgcttcaaaccacaggttgccaattctttacaatgacggcaattaacccatttgcaattggtgaagcttgagacattcggatcaattatatgaccaactaggattttgggcttctattcgttaacatgatgaacagacaagtcagtgaactaaccgattcaaccactgccgaccgtcactcatcaaagaataaattgatggcacttgcggcagccgatggccatggcgcgtgccgccgagctccgcgcggcgccgcacgggtggctcgcgcaacgcctggcttcagtagtagctgcgcatggaggcgtgcggcgcggccaggcaaggccgtggagctcgatgccacaagctatcgacgcatcagccgtccggccatcgtcggcgcagccaagatgctggctgcgcatggaaatctgcagggaatcaagctgcgggctgcctggttcccgagcagcgagctccgccattcggatgtgcagccggcggcgggttccccacaccgagatagcggcggcgtgatctgagcacgaccgcggcggcgattccatcggagcccattaagctcacttgggccggttcttcgcagcgaggcctggtactgtgggccctcaccaccaagtgggcctagctggtggaaattggtacgagagaatcgggccacctggtacctgggccgtaaataacttaatatgggccgaaccttactagaagggctttttaggcccattctgcctaaaattcctgttgctgcttgtaggcccacccacgaagactaacggaaacaggagagctaccaataatagcgacccgatctggatcgtccaagtccgatcaaaaatcagggttcggaggcccaggcacgttagatcggtggcatgtgaatatgtgatctgtgtgggtctcagaaatgcctcgctttgatcgcttcctctccggcactccacgagatcatagttattgctacgcgttatgacattaccatttaccaattgttgttgttattagtagtacactgtagtacacttggccaaaattggttacagttgacctaaaaaatgtaaaatctgcaatcgaactatccgtgcttagctacggtgtgtttggcacagctcttccatcttttctagagctgaagcctagacaactgtgcttaattaaacatgttcgtttagtatggtctgtccaataggtagaggtagggcatccggtgcgacatacaggatgcaaacaacaggatgaagaagaagagacagggaacagggagaaacacaggtgcaaatcgatctacaccacagtatcaaactgtggcaaatggacgtactatatatgccgtgaagaatgcgaaagtttttttttttacaaattcaacgaactatgcggtaaattaatgaaagtatgcccgtcgatttcgtggcaattttgctgtaggagaagaatgctgcgaagccaagcaagcgcaggcggaaagacggggacccttactcccccatgcaccccatcaaccccgcaaaatgatccatccttccatggctcctccaacgcacgtcccccacacacaattacacatgcatgcacttcccccctttcctctcctcgtcgctcacccatgccttgccaaacacaaaaccaatcatcaatgcaccaatagctagctagctagctaaattaaagggatcttttcaagaaagatcacttcattaaattgattgccatctgttcccctcacacaagctagatcgaggagcatcatcatcagcgtcaaactagcgaaaatttatcacaattcatagcccaattgactagtagtagtgaatttagaatcttagcaagcatgatgagtacatttgcttaatcgtttaattacttctatctaagctactaccacctaagctagcaattaagtccgaaacccctgttcttggtggtcttgttgccacagtcgcagagcaagtagctcagcatgttcaccatgctggtgccaatggatggcacgttgatcaccgggctaaccctaacgccatggccggagctgccatttctgctgcccccatagtagtaagctgctgctgtagcaccggctttcttgtgctgcggcggccggtggtgaccgccgcccgagacgacgccgccgaggccgccgccctgcgccgcggccgccgagccagccgatcggctccgcatgagcgggaacgacgggcagctgaagctccccgaccccgaccgcggcgccgccgtcgtggcggaattcacgctgcagctgcgcgtgaacggcgacgtccaagaacccggccgcctctggtaactcgtcggcttcacgccgccgccgcttgttgcctgctgctgcttgcacgggcttggcttgggatgaaccggcggcaacggcggcacgggcagcagcttcccgccggcgaagagtcgatcggccggcgcgacgtcggcggcggccgcattggcgaagtcgaactccggctcggggagccgccgccacgacgacatgacgacgacgagcgacgtgtccgaccgcgccgccggtgtcgccgctccggcggtcgccacgacgccgtcgtgagagaaggagatcctcgggccgatcagctccggtgctaattcctccattggcgccactgccacagctagtagtagtgtgagaccacaagcgagcgagagatcgagatcgaggcgaagcgggtttggagagaagaaatggataaatagagcggaggcctggaagggcaggggacccatgcatgtgtgtgtgcaaatttcgcagcggaattgtgggtgcggacgggaaaccgttttgatcctctatgtcagtcagatggttaagaaaaaatttaaaaagattaattagtatatgatataacactccataaacatgtaagtacagattcaacttctacatctcgtaaaaaaacaaattaaactgcacctaattaacatatattcacattcacagtcaaatttatctttttcgttgcgatacgtagaagttgaatttgaacttgtatgtttgctgagtgatatattacatgttaatatattttcttaaatttttttataatcatctaagtgacatggaaagagatatctcccgagagataaaaatccacttctggtgcggaccgcgattgattcgatcggtgtaacgcgcgcgggacgggtcccctggtcggtcacctacctacgtgaatgacatatgcctttgccgttttctcgtttatttggatgtgaaattttggcaatccagcttggcatttttggtggcgtgcagccttcatcctgcttagcctacgtacataggccgctgctctgctttctacccaaaaccgtcatgttaatcatttcgtatgttgtactgctgctcgtactactcagtttgcagcattgtccattttctaaaatccatgctagtcccatgcattcaaccatcattgaatcatgaggcgcaatgtacagaggcgacatcgatatatactgggatttagttaaatttagcatcggtgagaatgagatattcacaattagttagtacaacttacaacgaaggctagaaaatgcatgatcactgtgtcactgttgatgctgtaatgtaatgcatggcgagacatcgacagcaagacattgttaagctctttgttggaacagaatatgatgggggtggcctaactagtccctatctctcaatcagtgaaaccagcgcaaacacggggggatgggcaacccatgttggctccatttcatgcatatttcgatcaaatatcccaaaatcatgctctctagacagtaagacagaaacaaatatcagaaaaggtagcctctcgccctcctctctttccttttttctttctccattcaggcgccgcactgaagaaagaaacaagaaaaagcgaaaagatctttgaattcttctccattttgaccacacaggtgaatctagtctgggtctctggtaaaaagtcatgaactctatctatgacaaggtaactgtctccattctccaaccgtgtacacgtctgcatgatcgatcaggaaacagcgtgttggacaatacatcatatatagttgtataaaagtattaaagcaactgaacagtcaccttccttctgaacacacgcccaattattcttccgtgccttcgcttttgagagatgctggaccagagtagatcagaaatcattgtgcagtgccatgcatgcaaacgatttatttaacataattgccaaagagtttttttaattagcaaccatatgatcatatctcactgacacatctagttcaagtgacctgttaatcagtcacagctaacacaactctgacgcagtaatgcaacctctcttcacttctacttctaacaccagctccaaatgttgcttcaatatgagaaagaagtaaaaagtactactagtagggccatctttgtttgttagctggcattgctaattttggggttttattaggagagtagtgggctatgcccccttcccgctgtttggagtcgtagtatccgagtcttttttttttccttagtcttttgtttctctcctctattggcataagtcggtctggcttaatgtgttgtgtaacaaatattcttttcttctaatatattgacgtgcaatccttctgtgcgtgcgagaaaaaaaagtactactaataacaaaaacctgagctttagattaagctgatgttgaagaaactgaaacctaaggatggaggcggcaatggtcaaagtataggggagcatctgaaacagggtcgcccttgtattcagggaagccatatgaacgaatgtttggctgtgctgtgtatagtaacagttctttctgttcgtcctcagtgatcactgttcactcggctggcatcttctactggcttcaggctggtgttacagttgccctcgtgtttgcttgctctctgattagattagggggccaaccccctggatctatggtgtttcttgacgttttatagctcactacactgttgttacggcgagcttggcgctgtccagccgcctgtacctgttttttttagatgaagacggcactttattgattactgagcatcagacaggagcatctcacggatacagtccggagtctcattacggtaaacattacagacagagggctcagagcaacgagctaatgtgtgtgccgctacattagaacaacgactaacatggataaaggaaacactgataaactcaacaccaaacttcttgacgtcctcaaccaggcaaccgatcttggagcgatcctgcccagttgagtttagcttttggataacataaagacagtcggaagcaacaatcacgttatggaagccttcttctttggccagccacagcgcatgccggatagcacaagcctccgcctgtacctgttggtgtctcctctctactggaaaagaaaattggaaggaaaatggaagcagtgattctgggattctagtgcttgggccagctttgttggatactaacttcaatggatgcatccaatccggcctctacgggacactgcactttcacaaagttcagagtcttgggccgtctgcagtcgatggattcaggggttggattcaagagcagaacaaataaagaagaaatgttgtgaatgtttcaaattaacacattggtaaatgcaagagatgagtattatgatttaccagtgtaagttgttgctctggtcatgttgtactaatgcagtttagtaagaacaaagctaacataacaagtgccgttttgcgagctaacannnnnnnnnnnnnnnnnnnnnnnnnnnnnnnncgtttagtaagcgggaggtcttgagttcgactctcaacgaaagcatatttttattatgaaaagaatccataattctattcattttattttctgtttcttccagtttttttccattacgcaaatgttgtaaccctacttattttctagagtactatatttaatgcactgcagagctcctgctttccttaagaaagaccaagaataaggaggttcagaacagtagtattccatttccttatttttcaggccaaagcaaagaatccacgattcagatgaacatacaaggtctgaaacagtgtacagatgtccaccgcaattaagaggggagaatacatctccgacataacattcacacttcacataacaagaattcattaatctgtaagctgatattttcatcctgtggaactgaaaaatggcagctccatatcgtttagattctttacgaaaaaaaaggaaactgcatattgcaaccattctgaacacagaaaggctgaagttcatgaaactaatgctatcttgcagtgattctttctttcacttatatacaggcaccagagcgaccgtgtaacaacacacgatcgaaactgtacaagacagacagtaatcagtaattctgctacatttacaaccatctaatagcaacgcgtcgaacagaactcagcaaatcttctcccttacaagcagtgaagcagataacaccagcgcgtcaccgaagaggaaaaagtaattacagataaggaattgtgtcagctatcctttcctgaatcttgaatcattcagatcgctccctgtcactgaagaacacagacaacaagaacagcacatttcacatcagaactcacaaaaaccaacagattaaaccatgcatcagaaattcagaatcagtactgtttgaagattacctcctggttcgggtcgctgggcggagatggagactcggatccaaagatgtagaacagcgcgagcacggccatactgacggccagtgaaacgccaagaacggccagaacgctgtagattcttcgcctgtcgtcaggtagcggctcttcaggtggccccgaatcagagatggctatcgagcaagaaggctgatcgctcgtggtgcattcctctccctggccgccgccgacgacgtcagccgccgtgacttccctctcccactccgtgctcggtcccgacgggttgttgagctgagaggtgatgaacctgtcgagagcaatgccactccggcaagccttggcgcgggcggccgcctcgccttcctccgggatgaagcgctcagggcggggctgcttcttgctccgagaaggctcgcggtgcgaggactccgccgccgccgccgccgccgccgccgcgtccggagctggcgatcgaagtcgattgatcagaggaatcgaatggaaaccaagccaagaacagaagccgtttggaaaattggaattgtcatcttaccaggcagaggcggatcggcttccctgaggatggagcgcgtcgggctggattgcttcctgcttcgagacggccggatgcggaaggtggaggggggcatcgcgttcgccgccgtgtggccggacactggcaatctcgtcgtcagacgaatcgatcaagaagaaaaccaagaacaagaactcgtcggggttagtgatcttaccgaagcgagcctcgctctgcttctcggccgcctcaagatcctgctcgtttcctctgcctggcgaggcgccatggtcagcatcgggcactgcagaggcattctccggtgagcttttcacgagctctgacgacgacgtgctcagagcaggagtctcgggatcagccgacgggggagctcccgcggagacgaagcgcgtcgggccggcattcttcctgcttcgtgacaacatgccgcgataggtggagaccggcgtcgcgtttgcatccgtggctcggaacgctgaaaaagaatcatcgtcagacgaatcaagaagatagccaagaacaggggaacattcatccgggaagaagatggccaagaacaggggaacattcattcgggaagaagatgaccaagaacaggggagcggttcgggaatactcaccgaagcgagtcgccatcgggttcttgggcacctcatggagttcgttctcgccgccgtccgacgcggtcccatctccgccgccgcttcccaccgccgtgactccctccggctcgagcaacggttcctgcaccgacgaaccgccaagaaacagagaagttagagtcggtcgagcacccagcacccaatgcggctcatccctcatccactcacctcgagatcgtcgttcttggcaacctccgccgcgaccccatggccggcatcgtcaaccgccgatgagccctccggctccgtcgactcggcccctcgccccaggcccacggcatcgccgacctcgtcggagctaccctcccccggagcccctcctcctctgcgctcctcctcctcggagagatcaacaaccgcgtgcttgccttcctccatgaggatcgagttcttggcgcgggcgatcggatgaagccgcggcggaacccggaagcgaggagaggagaggagggagggaagaagagggggtttgaactttgcgagaaggggaaaaaaaaaacaagggtgaagtggcgtggcggtggtggattggtggagatgggcgcgacgcgagcggttataaacttgatggagaccagtaaacagttggttacctcgttagtcggttggttccgtagattcagcgtagacccagtccacaggatcgaccgcttcgagaatcttagaggcccagaatggacggctactgatcgcgtcggtccatggactgcgtctacaacaaaaacctcgaaaccggcgtggtagtcgtgttgcccaaatcgttgcgcgttgcgccaaccgcacacgacgtccgggcccacctggcagtgagacgggagtacaatgtatcttcgtcgtcggcggtcgagcgagacaagcaggagaatcaaccgtcccatcgcgaaagctgttctctttcctttcttttgcatggagagagagagagagagagagagtcactacggttttcggtggtgggtcccacatggcagccgtactacccctaccgctgaaaaaagactcgtccgccggaaacacgtgacagccgtacgcccaagaacattcaaaccatagagaaaagacggagacaccccccaaaaaaactgacatgtggggcctccatcctgtggggcccacatgccagttgctggatacggagttttttgtgcacgccgcactttccgttgcgatccgtgctctcctccctggacgcgatacgtaaacggacactggagtgtggggctcaacggctgtggcccacatgtcggttggttagttggtgggtggctcggacgttatggcgtcagtaacgtacgtgtgggctgttcgcgaggtcgggctcggagatggagatggatgctctttggtctcgggctacgccgcgcagccagtttccagtgtggtttccccattttgcccctcgtcatctcgcgcttccttgcgtacatggtcggcagtggtactttgcaacaatcatcacgaaatccataccacttttcgtaatcatatcacaatcctatttgtgttgtatccagcatgtttcatcaagcatgtattgctcggattgggatcctctgcattagagtatgaaatggagaggtgctacagtaaattaaattaggagaaatctgcaccttctattcataattctagggctataaccaacctctacggtattaacgtgatagtacaagctaaaaaataaaatattgatgctacaatacttgctgatctgaaccgtttcgtttttaatctaagtgctcaagtgctaccgagaaagactgtagcattagcaattcaaactgcaggggattcggatcatgctcggagagatattgccattgcacgtgtcaacaattgttcagtttttcatctcataataccaatcgactgtagtgacaattcagttagaccatgttcagttaatccccgtaaaggagggattggaagcaatttatttacacttattattgtgttaaattattttccatcaattccctccaatcctttttaatcttctccaaaccaataaggtcttatgtgattttgtaattaatctattggattgttttttatgattatttgctttatgtttctaaaaataggatttgtcaaaaaaaatcttaaattgcttagacaactgtcctaagttgtttgtaaagtttgtttcttttaagatattaatgtatcactacactcaagtagatattttatatcccgtgaataaaatatgttcgctgttttgtgaagcacaaaacaaacatggaaatacaccaagcatatacaaaggtatgtttaatcaaattctaaggctttgttattttgaagaggttaggatatcatcctcgtcgtacgtaaaacgaaacgatgaattaacacatgattaatgaagtgttaacttaaaaattgaaaacatgaattaatatgattttttacagtaacttttgcatattaacttttaaaaaactcgcatagtctagtattttggaaagcgtgtgtatggataacatgagaggtgaggctaggaatcttgaggaaagaacatataaataggagtagaggttaagggcagtcccaactcataatgtccataagtagtgtctatgatgttatgccaataagacatcacaatagaaactacacttcacaacccatggtttcataaagtgggccattaataaatacatcatctatcttctctaccaatcatatttattcttcatctattatgaagacattattctctcccaatgcaaaacttgatagtgtctattgcataggttctcgtgttaaagctgtgtcttgcatgagacccaatttcttcctctcttcactctctcttaattaatatagtgccacataagataaaagttctacatagcaatgtaattaatgccataaacaccatcctaggtagagggttgggactgcctaaaggccatgttattttctcctctttcccaactcaatttcctcgatttttacgcacacgctttttacactattaaatggtatatttttttaaaaaagttttctatatgaaaatttactttttttaaaaatatattaatatatttttcaagttttttactaatattcaattaatcttgctataactgccgtgtcgggagacaacgttgggaaaaaccatcattcgatcctactaatatcatcctaaaatagtgcttatccgtgctgtgcttaaccgcgaaatttagtcaattgttaaagaatggacctagaagacggcaggaaggtgttgcatgaaaatagaaaaccacacccccatgcagttccataattatccaaatttaccacccatcaacatcaagagaaaacacacttctctccttaaaaaaatcatccaacaacaaaaaagaaaagaaaaaaaaacttggcctcaacgcacacgcccccaatatttattcacaagcaacaccaactattccatctatttttcctttcccccacacttccattccatcgccccacccaagccccaaagccaaagccgccctcctctccacgtcccacgctcttcccctccccctcccccgctgtcgccgccaccggagtcggagtcggaggaggtctgggtgacggcggcctccacgcgcgcgttcgtcgtcgcggctttgcccgcggccgcggccatggtgatctccgccgagccgcacccgcctcctcccccggatcccgtcgcggatggcgccgcggcggtggaggcggcggcgtcgagcgctcgccaccaggccgcggtcctctcgtcgttcccgtcgctgaagacgtgggggagccaccgcgtcctgcggtgcgcccacgtcaaccgcgccggggacgccatcgcggccgccaggcgttccccggagcagctcgacggggtcaaggagcggctcctgctccacctccgcgaggtggatgggagcgacgtggtggccgacgcggaagttgcggcggcggtagccgccccggccccggcggcggctgcttcgcgcccgtggaagctgcgcagtcgacgtcgcccggcggtcgccccggcgtcgagcgcgtctccgccgccggagcggagggccgcgagggcccgcgcggaggccctcgacagggcgcggttctcggtgacgctgacgagcgaggagatcgaggaggacgtctacgctgtcaccggcgcgcgccctcgccgccggcctcggcggcgacctcgccccgtgcagaagcaactcgatgtgagttcatcctcctccatctcttcccttttccttacgcttcggcccccaccgttcatcctccagggacccatccgtaatttcgtaaaaattcacgtccccagctgctatttcccggtgcatggctgtccgagatcaccgtcgagtcctaccgggtgcccgacgatcggtgagctgagcagagcagatcagagcactgtgacatctactatcaggcaagaaatcccagaagctagtaattcatcgatcatcacaatcacaacaatctcctgttattaatcgatccttattaaccccatgttaaattcctcccttgttatggtgttgttgttacgagctagtagtagtaaatcgattggttgattgaacagagtgggagtagcggcaatattagcagtggtaattaattaaggagtagctgttcttgttagcagaaggacctcctaattatgaagtggtagcagtagtggtattgtcctccttgatggtacatttgttaacaacatctcaattgcaatgttaatgctaccttccttccatgcatccatcgttaaattcccttttgttttttttttcgattgcactgcttcatgctcaaggtggcaacgatattatgcaagttatttgactatgtagtactccaatcagtaagttttatagtatttaattaccaatgttatccttaatcatggtcgcataccggtaactgctgggtttgcggctgggccaacagcatcgcttgccgcaagcagagggagtgaggctgacgggtgggcccggcccgcactggagccgaacagttttgcaaaccctggcgcctgcttgccagtgagcacagggagagccttttcgtcgcctgtttttactttggctttttagtgcctcgtgggacccacctgtcagaggaactgaggatggttgacacgtatctaatcacgggtgggcccggtcgtggacgtggaccgggccaggtttgctcggccagtcggaccatggtgggcttggtccacgcacgttgctggaattagccggaagagggtttgctgctgctgcgccggttgttttcatgtgttaaacgagagctattgatacggaattacgggttgctagtgggagtggtattaaatttttggactgctaccttaccattttaggtcaattttggacggctcgatttgtggtgatgagtgagtaaataacagtgatgagactgtggacaagtagattattagatggatagatggcacggcacgccaatggtcctctcctctgcaggtcgagttgcagggcgatccttgtacagtagaggccatctgattggtagcggatggtccagatcgatcatacgtgcgaccttgacattgcacctaacattcatatgggattaacataatatcaacagggcgacatgcatggatgcaattgttgctcaaacatgtagcagcagtagttccttctttctgggatactttcaactctgacaaagtatggcaggtagtagtaatgatcgttcaactgacgatgaaatgatgagtcatcgagtccccatgtcgacagtcgacaaaaggaactgttttgctgaaagcatttttactgtaattgagagagtcctacaggtgtagtgctgttcttgttcaagaaatgggttgtgcttggcaaagcttcaggaactttcccaaacccagtgcattatgattcgggatagcagttgctgacttgcagtgcagctgttgcagttgcagccgtacttgggcagaagtctaccctgttccgtggttgctgagcaatgggggtgaggacaaaagcgagcttgtactactccagtactgaacagtgccaacgtagtccaaccgtaatgatctgcaaatgcacacctgcatctgagaccaaaacattcttaggttttgcgagtagaaaacggaggttatccacttcaattactattctgtaagaagttgtaattaaagtttttaatttaaacgtgcatgagaaagttgccgttatgtgtgctttgggtgagattctgaccaagacatcccgcgttgtaataaaattttgtaaagagaaacctagccttcagctggcacgtgctaaactccgtcgaattcgttcagtggcggtgcactgtcaacgcgttgacacaaaactaaattagtcttctcgtatttgattccagaaaggaaaaatacacaatgtcaacgagcatcatagctttctctcgccttggaactgtacgtatgtattcactccgtttctaaatattcaacgccgttgacttttttaaatatgtttgagtgttcgttttatttaaagaatttaagtaattattaatttttttctattatttgattcattgttaaatatacttatatgtatacatgtagttttatatattttacaaaagtttttgaataagacgaacggttaaacatgtgcttaaaaaatcaacaatgtcaaatatttagtaacggagggagagtatatgtgtatggcgcacaagaactcacgcaactgaatgtgcggatgtgtttgatgcttctgccttttctatggaatcatgcaacacacaacgtgctacacgaacgtacttattacatgctctttgtttcaaatgaaatcaacttttatgtgtctaactagcgcacgattatatgattaagtatgagttattagcacatgattaattaagtttttaattctactaaatttgaaagatataattatttgatattttgaagcttctatatataaaaaatatttttcatgaaatgcatcaattagaaaagaatgagaccatatgacatggatggagggttcgacttaccgtcgataaccgcgcttaccgcggggtacggtaatataaatacaacggtaaccttcttaaatttaaataaatttaaaaaataatttaaatttttgatagatttcatacggtttttcacggttaccgcaattaccgcgcagtaaccgtgcttaccgccggggtgctgtaaccccggccctggcggttttggaaagtagcttttcccgtgtataaatggtcacaactgacagtgttaagtaatactaacattacacgggaagttaattaagcaacatgaagctagagatgaatgttatcgcgaggaaagttgagtgaccattttgtgctgggcaatgcatgcgtccacagatctcgagccaggggaggtcgagctggacgctctgcggtgtcggcagctctcgtgctcctcggattgtgcaccgaggccacgctcgtcctcttcaagatcgatctactacaattatcaacacctgcaagctcagatgttttttcttcatggccaagatagacttggcggtaccgggatatgcaaggactgaagtcaatactactccctctccgtccctaatcagagagcgtgaagaaaaatcaccgaggcctggtttagtttttaactttttctttaaacctttaacttttctattacattaaaattttcctacacaaaaacttccaatttttcgtcacatcattaaaattttaatcaaacttctaattttgccgtgaactatacacaggccaataccaaaaagatcacgtcctaattaaccttattcattgtcctcaattataatggttgtactccctccattttataatataaggtataactttttttttagtattgtactatctccatctatttttgatagacatatttccaaatctgaaaaaattatttttagtaggcatatttcaatccaacaacatatccttttaatgactttatcagatttaatgcgtgactcttcattcttccacacaagattgactacttcggcatcaagaaatataaatattaatgaatcgcttatttacgaggaataactagtagcatatttaaatggatgataagtagaattacttatccttgatctgtgtgccaagataaaatatgattatcaaaaatagatagagggagtataatataaggcatgcgttcatatgcaattgactatgattttttctgcattcatgtagtatgcaattgactagaacttcatctccattaaattattattttttaaaatcttctactcttaaaatatatttattggtgatccaaattaggatatgttaataattatttcttggtttttgattaagggtggttatatgttaaattttggaatgcagagagcggttctctaaacgttactacctagcaattctccaagcgtcgttccgcatgcatgcaaatagccgagggacagacaacatcaacaaaatttcacatcctcagccctctaattagggggtgtttagttctatgggtataaagttttagcgtgtcattgggtattatatatgatgtcgcatagggtgttcaggcactaataaaaaaactaattacagaatcagtcagtaaaccgcgagacgaatttattaagcctaattaatccgtcattatcaaatactctctctatctacttttgatag

SEQ ID NO: 67099 - DNA, 4733 bp, Oryza sativa
agaggagagagaggtttagagagagaaaggagaggagaaaagggagagtgagaggcagctataagcctataaacacacacgcggaggggagctagctcagctggtggggcccacgggtgcaagcttttttctttctttttttccttttttttctttttctttttgggtgtgtgtgcgcgtagcgtggggaggatgtgtcagtgggtggggtagggggttgcagtgagagagaggagagggcggtgggtcccccgcgattttcgtctccccacacgctcccgggggttcgcgaccgacagttgctgcgggcgcgacgcgtgtgtggttttgagtgtccgtttgtccagttcaaactgatggtggtagagttaaaaaaaaaaactactgtggtaaaaaaaagtgaacggctagaaaagtgaaaaagggtgttttaacacagaatattccctgttgattgtaatttgtggggatggagggaaatggagaacttcataacagggagatgttggtggcaacaactttcgggggttaattccatccatgccatcgtattttttttcagttttgaaacatgtgattgcaattcgcatattcgtacaatttcaatagcagtaaaagattttttttctaaaatgtattagcatatatatttttcctttaaaattatactccaaatgtattagtatgttattgtgaatgtgcccgatataaggcggaatagaaccccaaaagaaatgtgtagcattataacctaaaaatttgcttagaaatttttactctaaacttaattacttttttttcccactaatgttgtatctagaggaatatcaaagatatggaagtgaatgtaaaacttgatagttagttcatcgaatatcataaagaaataaacagagggagttcggcattatctcaaataatcacggtgcccaggcaaaaaagaaaaaagaaaactcaccggtatgaaccacggagagcatctgaaatagagtaccgcaggctacctttgaagtaaagcaacacaaaatgagtagtacacaacaaaagttaaagtggaaaaaaatatggtctttagtagttaccaaaaagcttattataaaacataatagcttattaactaaaaataatttacgtgtaaaacttttatatatgtgttcttagcgacttaaaatcaaatcaatgctaaagaaactacgttaaatatcaactttataattaaattctaaaatttaaattatgggttttgttatttctattgcaaccgatcagactttttgagcctgttcagatgacaatattatcaaaattttaatatgatttcttatgtatttttaaatttaataacaaactaaacgcaaacatatttttaacaattttttaaaagaaaatagggttaaaaataacgtcaatctcaactgccccttattctaatacttcagtaacagtggatacagtctgtactaaaatggttgtgtactgtacactggactgtctgacataacgacactgttgctgctgctgtgctacattggtcaagaggagggaggggaattaagagaggtcacggggaatcataaactaagctactagtagtaataagatattgtatcacatgattaaactaacctatccctatatccattggatttgctcatgtgcatttgtttgacttgtacgtttgttctcttgtcttgaataaaaataactagaaatgaaaaaaatatagagagcatgggggagatggaagatggaacaagtgaaggtgtgctctaatattgatcattttaggcacctttagaacgcacggatatagaattttgatggtaaacaatggtttagaccctatttgagatagataaaaattaagattaggcaaaagaatgtgaaaccaaaaggccattatcgtatgcataattaagtattaattattataaatttgaaaataaaattatttgatattttagagtaatttgtgtatgaaacgtaccgtttaacagtttaaaaaatacgagtgctaagaaaatcaaggtagaatctacatcttaataaaaaagagaatgggaagttagtttggccagagaaacatgtttgatgagttatcaaaaccaaagtaaagaatataccttggtgggtgtttgtacagtgtaatatgtgaccaggaaaatagcaaatttactgcggataagcctcgagaaaaaaaacgaaatgtcaatttttactctctatgtcttaaaatataagtatttttagctattttactgaggtagtatgtttttacagagtaaaaagtaaatgtaggaaaataaaaattttaagtttaatttgtatatactccaactgataatccaacaatagctctgcttattattaattctccgtagtttggtaacgggcatcgacgcatcgtggcaattctggtgtcgggatagccctttgggtgtttgcgtcgttctcgctgggcccacaacgccgtgacggacagtgcaggggggcccacctacgcggtcggcgtcggatctttcctttcgtgcgctgcgactgcagtgcactgcgctgccactgtatgcgtggtgggccccacgagcggtttttccgctcgttggcttgactcggacaggcgacggtgcaaatgtaaaaatgttaattggaccggggaagtacttccctatgtaaaaaggggagagagatcctctgactttaagggcctgtttggtttccagggacttattttaagtccatgtcacattggatgtttagatactaatttggagtattaaacatacactaattacaaaacacattccatatccttggactaattcacgagacgaatcttttgagtctaattatatcatgattttgacgatgtgatgctacagtaaactttttataattatagattaattaggcttaaaaaattcgtctcgcggattagctctcatttatgaaattagtttttttattagtctatgtttaatactccaaattagcgtccaaacatccgatgtgacatgggctaaaaagttttagccccatctaaacaccccctaagtcagaggcacttggtggctgatatatgggcccatagataatgggtcccacatatcagtgtctatgtcacgctgtacagtaacgtcagagaaattgtttccatgaaaaggagttaattctcacgtaaaattttttaccttgttacatcgaatggtaagatacatatatagagtgctaaatatagacaggaaagagtaattacacagattgcgtgtaaattgtgagacgaatcttttaagactaattgctccatgatttgataatgtggtgctacagtaaccatttgctaatgatgtattaattaggattaataatttcgtctcgcagtttacaagcggaatatgtaatttattttgttattagtctatatttaatacttcaatgtgtctccgtatatccgatgtaacacgctaaacttttcacccctgaacaaaacggggctaaggatgggagtacgtatttactctgctttttgaaaaaaaaaatctatagagatgttgtttgaaagatttgaataaattcatttttaagttttataattattaatattttattaattatgtgctaatgaattttcctgttcacgtgcgttgaaaaattttctcttctacttaagggatagaactcagcctaagaagcacattcgagagaaggatgacatatcttatgataaaaaaaaaatcattgccgactattgcagatgcatatttacacacatgtaacacatataagctaccactataaacattttttaagaatagtacggtatttgttaagattgataaagttatcattgagagtcgcctatcactcaaagaaatagttgtagagaagctcatctcaaaaacttaaatctaagtggtcaggttccaccataaaagatctaaccagttgagcaatgcttattttacaaaaaaaaaattgaattatagtaatgtttaaaatttttttctaaaaaaaatttagttgcttactcctatatatcttgtcatgtccgtatattgagaagcaccaaattagttttatacttttaatagcttttacctatccacctaataataataatactctttattggtgaggggtagaattcttttccacctaacttttttctttgaaatggctacaatcaaagttttttttggacataatcaattgcgcaattatagggagcagtagttggtggtgattaaaatagccagttggatttgggatgtccaattaagctgctggtttcattggtctgttatagatagccgctccacgtgagctccagtggacgtaccgtatgctaaatcgtgctaatgcatggccaattgaccatattgattcgattcatcaattgactcatcactagtagtaatagcttaatctagatagagctaagagcaggtaaatagcaggctataagccagctgcaaacatatactaaggagataaatgaggagagagaagggcagcgagctacagatttatagccagctgtagcacggactccaagacacaatgtatgcatgacaggtgggaccagatattaatagtgtagtatgtaactattgtatgaataagctattagattggttatagatgaattggagatagtagttggctacactattgaacttgctctaattacgtcatctcatttaagcttgctaatgagtaggcttaattaattagct

SEQ ID NO: 67100 - DNA, 42979 bp, Oryza sativa
  unsure (1)..(42979): unsure at all n locations
attttaagatagtctagagcctcgtctttcgttttcaacaagtacacatagcaaaatctagtagcatcatcaatcaatgtcatgaaatatcgttttccaccattcgtcaacaccccattcatttcacaaagatctgaatgtaggagttctagtggtgccaagtttctctccttggcagccttgtgaggcttgcgaggttgcttcgattgcacacaactatggcacttagaacctttgacaatggaaaacttaggaattaaacacatgctggaaagccgagacattaagccaaaattaatatgacataaacgtgaatgccaaacattagcctcatcatccacactgccacaaatatggttcacagacttattgcagaaatcagaaagggaaaaacggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatatccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtattttcccttgctcttgttctgggccttgtgcacaacattggcactggactgcccaccatcgcccttagacgcggcatctttttcccgagctttctcctcaacatcaagagacgctatcaacccctcaacggagtattcctgtctcttgtgtttgagtgcagtaccgaaacttctccaagatgaaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgcagaacgtcgaaggcagaggttccggagacctgctctcccgatcgccggtgcacgccggcgagcgggatggagtagtctacgagcgacggcgcagtacagagtaggaggcaaaccctagattgattttttgcgtatgttgcgtgaagacggcaggtcggtttatatagagaagggtcgcttgatcagggcgcccgcacgatctctactgcgcgtaactgaaccggataagtcgcgcgtaacttatccggactccacgccgtttgcacgcaccggatctttcggaacgtttccaaaacaaaaacgaagcgcaagggtgaggagccaatttttcggaccattcgacgcatacgtcgtgcacgcgcgccgcctgcccggccaggcgaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaagttcctctcaaaaaaaaaatcatatattagtcaatcaaagggtgtgtttacttcacaccaaaattagaagtttggttaaaattgaaacgatgtgatagaaaaattgaaagtttgtgtgtgtaggaaagttttgatgtgatggaaaagttggaagtttgaataattatcttgaaactaaacacggcgaaagataaaaggctgttcttgactaaagtcctctatagaaaacatgattataaaaatataggaatatggagaaaaaagtaagaatataatatcatatttattttattcctttaggattttttaaaacacaagaaagttttaaaattgatgtttgattagaatacatgaattttaagacataggaagaagaaaccttgaagtgatgcttattttcctttaaaattactctgcaatttctcatttcatagaatttaaaaggaatggtaaaaaaaaatcaatcatctgtttcaactttccagagatccatataattgttttccataagcgctctagaatttctatgtgttttttttttcaaagggtgccctaaatgcctggaaaacaacacgtcctttaatttgcctaaagcgaaaaggcaaaaatggggagcagaaaaagaaatccttgattcgccgaaagctacaaaggggaaatagagaacagaaaagaaaaaaaaaagggagaaaggagggaaaatgaaaacgtttcggccacgcgtacgtaggtatacccaagagatatagccagtgagcctttagctggagtcctacacgtatgtatacatcgaatctccctttcacgcaccaattccttcggtctttcttgccgtcgctctcttctcagttcatacatgcatacacatacgcgtagctagctagttagacgtgctatatatatatatatatatatatatatatatatatatatatatatatatatatatactccctctgtactcgtaaatttagtatttaggacaatatttaagtcaaactttaggaatataaatcatgaataacccttaagctgttgaatttgaaaatgtaaaaattatatgaatatatttatcatgaaaatactttcgtaagagtatacatatattacttttcaataaatattttttatagaaacaagatgttaaagttatgttttggagaccgtgtcgctgtccaaaacgactttctttatgagtgcagggggagtatactcactttgatgatttgatgatcgcgtaactgcccacacaaactcacttcaattcaagctggtcttacagggcttatttgatttggagaaatttaaatccatatgaatgggaaccgtgaaagaatagcaatgtttgcatacatcaatccataaaaattttccaaaaggtttaggtggatgaaaaaattgctatatttttctctgtacaactggttggaaaggaaaattttctttggttttccagtgcttcaatccttttttaggtgaaaaatatggcgccgtaaatatagctactcccccgtttgtacagtaattacacatgtgtaatttagagacttacatatataattttagaacttatattataaatacaataaaattacatatgtaatttagggacttacaatgtaaatacatatcgactatttttttagtaaaaaatttgaaaaatatggcgtcataaatatagctcataccatccggtaaatcgaaaagcactcatatgaattaattattagaaattcaaatccttcggttttcctccaaaacgaactaagtcccttttttttccctacacgaattccctcgctagaaaagcttcttttgcagctgattggcttacctagaatagcaagcatatacggggcttggagcggatagaattggagcatacagatatatacaaaaacgcgtaacgcgtagtttgttgcactggcatcgtgcatatatatatatatatatatatatatatatatatatataacatttcataataacattttcagagacggagaacggcctactcgctttccctgtaaatccaagcagtcgagcacgcaagtgttttgtatctttgctatcgactttaatttgccgtgtgcgtgcgttcggtcctgttcgtttatactacaaagagtgaataaagttttgagtaaacttttgaaaactgtaactttagtcacaaaattatttgtttgctgcaacattagcgacatatgtttcagtttgctgcaacaatatcgtgggaaattatcacaaaactgtaacttttatatgttatatgctgctacagatgttaaactgctaaacgatgtgtttcgtgtgaagactttctatataaaagttgttctaaaatatcagattaatctatttttcaagtttgtaataattaaaactcaattaattacacgttattaccatctcgttttacatgaaacatttaattttcatcttcatttttcattttcagaagattaaaaacaccaccgaagtagataagatgagaactagacgaatggaaaagacgaagttgatttagggtgtgtttgaggagaaggggattggggagattgggaagatacgcaaaacgagttgggccattagcatatgattaattgagtattaactattttaaattgcaaaaatggattaatataattttttagagcaactttcctatagaaattttttgcaaaaaacgcaccgtttagtagtttggaaagcgtgcgcgcggaaaacgaggagctttctcacccaatgtcactggaaagaacacagccttagtcgcacgtaaagcgagaaatataactaatatataattatttaaatattaatcattaacagtttagaagttggatatatttattttaacttttaaaaatatttttgtgtaaacttttttataaaatatatcgtttactagtttagtttaaaaaacgtgctaatagaaattaagagttagctaatccaaaccgaagtctagatcgggcccgaagcagatggattgctttgctttgctactgcatgcccatccgattgcgtgtagaggagggcaagtagctgcagcgccagctaagctgtgcgtcgtcggagcagctccgaaaactgttggcaatttggcatgcatggcaagcagggagagaagaagaagaagacgacgagcttgcctagcgagtagcaacaaagcagagcgcgtgcagcaacttcctatccagctacaattgcagccttgcatttaagcaaagtaggagttagcaggccggtataccataccgctagtgctgtaggagtacatgcttctgtacactatagctagaagcaacagtagcagtgtagcacagtgctaactgctacccaactgaactaccgagcaccaggtttggtcagggttacgctgcctatatatataatgaaacaaaagccaatggacaaggccgtgctcagttccatttcaatttttttaagtgtacggatacacatttggagtattaaatataaactaataacaaaaataaattatagatttcatctgtaaactgcgatatgaatctattaagggcatctccaacagagggccaaataggttcctaaaaattattttttgggattttggttaaaactaggcctccaacagactgtcaatcacggtcctaaaatttaccccctcctaaaatcggtgccaatctcatcagaatttgggaagcggtacgccctcccaatcccaccaatcgcgccaattttttttactgtccgcgccattttttttccgcccgcctccttttccttcccgctccttcctcgcgtcgtttcctttctcgcgagaaacagcgctcacgccgccaggctagggttttgggagctcctcgcgctagctccgtcccgatccgccggccgcccgtcgggggactaccggcctgccagccgtccatccaggggcagcgtcgccggccgcccgtccaaggcaccaccacctcgctgtcgaccgtccatccaggttgtcccgacgacaacgtgtgctgttactgattcacttcgaggtattttcagagaaacaactttattcttttcaagcttgaagttcctgtactgatttccccacaccggcaatcccccacacagccatctagttcatagagatatctcccaattttttgatggagatgcaaagctcctcccttaaattgtttcccaaatcactgccacatacctcagttgcagcacttatcttctgaataatgcaatcaaaaactgttgtcctgtcctcttcaaatgatttccaatggatcaggcatcggtagatgaggtatgcggcaataggccttgcaatagagaaacccatatcttcagatatgcactttatcaacaactcatggatattcagaaaaatatagaaaaaaatgttgaggcacaacacctgaacgaattgtgatactgcttcaaaagaagttcagaattactaagcatcatacctgttgctgcttctcagcttcaggatcattcaggcgtcagttgagaattgttctcctagattgaacttaacttgtgttaaatcaggaactcattttacgaatatactgatcaaatataatttgaggattatactaacatggatgtcacaaaagttactggcctataccaattgttaattcaatagtgtttgcttgcgtttgtgttcagtcagatgcattcttcttcaggttgtatagcaccctaaattaactaaacaatgagcttctatatgtgcagggttttgtttgcttgcagcagtatttgatgaccttttcttagataatttaagtgtttgatgacctgaccagttagctgctcattggctagatattgctattagtttctagtattttctgaccttaactttttagccttttgtaatggattcagtgaacatatgtctgaattaaattgcagagtcccaagatgctagtacttctacaaacgtattagtagtactgttcttatttgatcactaaattaaacaaacatgtactatttgtaggtcctattgataatggaagaagaaggattctatactaatttgatgaatgagggcaacgattccttagattgggatagtttgagtagtatgcctgtggaggatgatatgagtaaccagcttgatgagaatggcatgagtagcgagcctgtcacgcagcagttcccaactgctgagaggactaccgtggctagaccaaatcaaaaaagatcgaagaattttagcgaacaagaagataagatacttgtgtcggcgtggttgcatgtaagtttggatccagtgctaggcacaaatcaaactcgtgctgcatattggactagaatatatgagcacttctacaaaacgagtaaatccacaccagatcgcagccaaaattcacttatgcatcgttggaaaactatacaagagaatgtcaacaagttttgtggacatctgagccagattgagggtagaaggcaaagcggggttagtatacacgacaaggtaatacatagttatgtagcttgtgtttttatgttactttataaataaaaatgtgatgtttgctaactacattcaccatacttgacttgtgcagattgctcaggcaattgctgtatttaaggagttggaaggaaagccctttcaattccttcactgttggtctctcttgcggtcacaatctaagtggcatgataagatgaagcaaataacatcccagaaaccctgtgccaccaacagacagaagccaagcacagatggttcagcaaaagctacacccacaaatgatgaaactaccaatcatgttggtgaagataatgaacctacagagaccgaagagccaaagagaccgatgggtaagaagagagctaaagagcagttgaggcgtggtgaaacatgcacagatgcttttgatcatttgtgggagaaaaaaaaagaagctgatgcagagaagaagaaggagagagatgagaggcaccaaaagtcatatgaactagataagcagaggcttgagttagataaaaaaaaggtcgcgaatgagacggatgagatacagttgaagaggatgttagaagaagagagaattatgaaaatggacatttcttccaagcctctctcacagcagcagttctacaagagtgtacaagatgagatcatcgctcgtcgcatgaacagttccggttgataggtttgtgtttcataacagtttacattcagttgagtgcctgtgttcatgcatatacttgttcttgtgtccatcttgttgaaatgctgcctttgcacagctgcactacaccatctgattcttaaatatgttgcatgatccactacaccgtctggcaattgtgtctattttgtgtctctaaattaggtgggtttactaagtctatgcaatgcaaactatttaaattcagaattgtctattcagtacttgggtaattccctcatcctgctgtcagtaatgcttctgtctttgttgctgttgacagagtcagaagcctcatatattttgaaatttgtactaatgatcggtcatcttgctgacaagctgatgcatatattgcaaattatatataagctgaactgtacctatgactaggttgacaagttaaaggaagtgcacttttattaattctcctgtactattcttaaaccgaacagtacaccatttattcaattcatgaaaaacaaattaagatgatttggcaaatcctcacatatgtatattatttattacatggaattcaaacatataaataaaacctcaatatttatccggataatgttgccacaagtgctccactaggtcttcacgtagctgatagtgagtttcgtcgtcccttatttttttgtgcatctggataaaatcatcaagatcaggtatttcatcgtgggacactctgacattttctcctccctctgggaaccgttcttcccaatcaacttctccctcatcttcaataatcatgttatgcatgataacacaagctttcatgatgtatcccagagtcttttcattccaatgtcgagctggccctcgaacaatggcaaatcgagcttgcagaaccccaaaagctcgttcgacgtccttccttactgcttcctgtgctttggcaaaatatttcctcttgttgccatgtggttctggtatggtcttcacaaatgtggcccaagaaggatatatgccatcagcaagataatatcccatcatataatcgtgtctatttatactatagttcacttcaggagccttgccttcagctagctttgcaaatagcggggatcgatgaagtacattgatatcgttatgagacccaggcataccaaaaaaagcgtgccaaatccagagatcctttgaagcaacggcttctaaaattattgtaggctcgtgcacgtgcccttggtacataccgtgcaattctgtagggcagttcttccacttccaatgcatgcaatctatggagcctaacataccggggaaacctctgtcctccccaagttcaagtaatcgagttgtatcgttctcattgggtgatcttaagtattcatgttcaaaaacttgtacaactgctttcacaaaccttctcaggctctctatagcggtactttctgcaataccgagatattcatccaaagcatctgctgctataccataagccaactgacgcattgctgcagtgaccttttgatgacaactgaacccaattaaaccagctgcatttctcttctgcacaaaatagtcatcgtgatcctctactgcattcattatgcgaagaaacagaggcctgctcattctattcctgcgaatcataactaatgagacatgcatatctatgcatataacaaaaataaattatataaaatttacttatacaaacctgcgcctgaataaaactgggccataggtaggattatcagaaaagtagtcttggtataatctcaagtgccgtgcttctctgttgcgatcaatcacttcatgtcccatgactgacccaccatgtcttggtgcattgacagagtgccaatagctatggacgatttgtgccgtggcaaaaaaaaaatcatcgtcatcgtcagacgatgattcatccacgagctgttgaaacgaggagcgaggtcgactcatcttggatcaaatcaactgccaaaccattattcatcacaataaattaagtttttccccttgcgacgttgtcagatcaaattaaaaaaaaatgtgattggccttccgtttttccaaatatttattcatcatatcaaattaagtttttttttccatcaagacattgtcagatcagaaacataaaaaaaggaaatagaacaaagtaaaaaacatggttgctagcaaaattttgctactcacgcactgcacaagagcttgtgcctgtcaccaatcgttgctgcttgctgcagctacctgattaagtgaggtgctaacgtcgccggccctgacagaggaagagctctgattgagtgaagtgctaacgccgccggcgctgacagaggaagagctctatgtgcgtctatagcactgtgtccttcgatcaatttcgtatatcgctgcgtctgatatataacctcgccaacggtatcagttgcgatctcgcgcgcgactaggatgagcagccatctccttccgtccgcgtgcgtcgcgtcgaccatgcccattcccctccgcatccgcacgccgcgatctcctcctcgcctctcacgcgcgacgcgatctccccctccgctctcgcatgtgattttaacgagcaggtagaaaattagttgggaagggcccactaatgatgatgtggaaaaattttaaaattttgggaaccaaattttagtcatctcttggagaagagggtgtattttaggctaaatatgtttttggctgtccccaatacaggatttttgggagtttaattttagtcatctattggagatgctctaagcctaagtaatccgtcattagcaaatgtttattgtagcaccacattgttaaatcatgaagcaattaggcttaaaagactcgtctcgtaaattagtcgcaatctgtgcaattagttattttgttagcatatatttaatactttatgtatgtgttcaaacgttcgatgtgataaggtgaaaaattttagcctaggatctcaacagggtctaaattttgttttgataggaaatgagctaattattattgctaaagatatatatgcccaattcaatcccaattcaatatcagtatttagttcacatcaaaattgaaagtttggttgaaattagaacgatatgacagaaaagttagaagtttatgtgtgtaggaaaattttgatgtgatgtaaaagttggaagtttgaagaaaaagtttaaaactaaactcagccatcatcaaccactcttccaagtaaagcctgaatttacctagggtgaattcttatgttccaccgggagttttgattatagcctcgtcggatatagaagaagacgaagacgaagtacacacgtgaaacgaaaaagaccattaatgtataattaattaagttttaattattataaacttaaaaggtagatttatttgactcatatgtaataaagtttttttttcaaaaacatgttaataaaaaccgagataaaatcttcatcttggtcgtaaacgaacaaaggcatatgtgtcacctttttagtctttcattactagcacggaattttcgtcacacatccccggtagtagaaacaaaacaagtgacgaaccggcagtacgcgtttactagcggcgagcggtggcacgccgcgcaacggcggcggcgacggcgacggctcaaccgacggacggacgcggacacgcgtcggccggcggcggcgcggcgcgcacatgcagatgcacacgcgttgcagaagtgcagaggagtactggtgccatgggcctacgtgtacatgacgcagctagcactagctcgtggcactgggaaattcactttatacactccaacactccctcttacacgagaccctattaaatctcaagcgtgcttcctctcacacgagatcctatcaaatctcaagcgtgaaatattggagtggactgcaattattttatttaatattggagtggactgcaattattttatttnnnnnnnnnnnnnnnnnnnnnnnnnnnnnnnnnnnnnnnnnntgataccatattaagctgcatgtaacaatcagttacacctaaaagcctaaactaataagaaaagacgggtaattcactctatacgcttcaacaaggagggcaaatcagtcatgctccctcttgacttacgaagaaagtcgtttagaagaatatttaaatcaaatcttaaaaatataaatcataaataactatcaagttgttgagtttaaaaatataaaaattatataaatatatttgtcttgaaaaatactttcataaaagtatacatatatcactttttaataaatatttttataaaaacaagaagtcaaagttatgttttagagaccgcgtctctgttctaaacgacttcctttataagtatggagggagtatccatttcacatatacttatggtcttgtttacatcccaacaaattttagccaaaaacatcacatcaaatatttagccacatgtataggacattaaatataaaaaaacaattacacagtttgcatgtaaattgcgagacgaatcttttgagcctaattacgccattatttgacaatgtggtgctacagtaaacatttgctaatggcggattaattaggcttaatagattcgtttcgcaatttacagttggaatctgtaatttgttttgttattgtgtacgattaatacttcaaatatatatccgtatactaaaaaacattacacccaaagaactaaacacaccctaacataacaacttcatctgtactaaaataaatttatttttcaaccattacacatactttattcgtctcaaaataaactaacctgataggaaacgtgattcatcgtattttttgacgaagggagtataacaatataaaaaacaaaaactaaaatactcctacttaatcacatcccaatataattattttcacaacttttaatatagttatttcttattactcttacaaacttcgatatattgattactcaacaattaatttattttgggataaatgggtggagtaaaaatgaacgcagagtactgcatttgttgctgtggattaatcgccgcgacagccagccatggctatgcccgtacccacatccccctgggagaaataagttgagcgctttgataaactttgattgttgttactcgaacaagacaaggcactgcagtttcagaggatccgcgcgccagtggccatcgccgaatgtgggcgatgtgttgatggccaccagttgtgcgatgatgtgtgtactagtgtcaagtgtttgtgtgtgtggatcacgggacgagacgatgtgtgcagttgccgagcaggggaagggcaaaagcaggcaaggattgaacatggctccagcagtccagctccagatgaaaagagcaccgcgctagtttcccaagtgatctatagctagcaggtgcgacatgtggtaggctggacatggtagacgaccgaccatgaaccaatatacacgtcgactttcgaaacgctaaagttttttttcttttttctttttgcctacaaaactacttaccttggacttgtacaagcactagtactatattattagtgtgtaaattagtggtcaaggttatatttaggagacagtaacaatctagcagagtggtagtacctgggctgcacggagtagcagcagtagttcaacttcaaagcaggcacgggccccgcggcgaaagacccgcagtaattgccggccgcagagtaatgccatttaggccttgtttaggccccatttgatttaaagtaaattcatagaaattttagggcacctttgaatcacaggaatgaaaaaatggaggaataggaaaaatataggattctgacaggaatacaaatataaaacagatgattgcaaaacacaggaaaaatataggaatgatcgtttgattgagccgcaggaaaaacacaggaatttaaggagagataaagactcaaaagattcttaacatgaggtagaacctcatgctaaatttcctccaaaacctgcatgggaagaggcattccatagaaatttcatgggattatataggattcattcctttgattcaaagggctatatagaaaaaatttctataggaataaaatcctttaaaattcttatgaatttcctttgaatcagagggagatgattttatttctacaggaatttttcctatatagccatttaaatcaaaggaatggatcttatagaatcatatgaaattcctatggaatacctaatgccatacaagttttgaagaaattctaacatgaggtagaacctcatggaaactttcctttgagtctttatctcttctctaattcctgtgtttttcctgcggtccaatcaaacggctattcctgtgtttttcctatgttttgcatcctctgttttacacttacgtttctatcaaaatcctacgttttttctattcctacgttttctcattaatgcgattcaaaggggcccttagttcgcgaaaagaaaattttagcgtgtcacatcagacgtttgaccggatatcaaaaggggttttcggacacgaatgaaaaacctaatttcataactcgcctaaaaaccgcgagataaatttattaagcctaattaatctatcattagcacatatgatttactgtagcacttatgactaatcatggactaattagacttaaaagattcgcctcacgattttcatgcaaactagacaattagtttttcattttatctatatttagtgcttcatgtatgtgtctaaaaaattcgatatgacgtttttaaaaaaaaaaattaggaactaaacaaggccttgctcgagcaagggtcgtcgagtcgcgttacaatctgaatatcttatgcccgctgcttttctcgatcggtatggtgtgctcgtacttcgtaagtgcaggaacgcttagatctgttactcgcttgggactttatatatactggaaaccagacgtagattttgcagtaataacaagtatagttcctccagaatatggtttctttaccgggtgggaggtaataagatatggatgttacctgcacacatcacggaatgtgggaaattgcgaggttttgaaatgcaaatcgagctaactggatcactttgttttggtctcctctctgcaccttttcaccatctcctgatgaggtactgtattttcgctgaacaaccgtatctttctttcaacgagcatatatctgacgagaagcaggttcagaaattcagcagtgtaaatataggtagaaactagagatggagatgaagacctcaggaacccaaacacgttcacgcaacaaatcgataaaataacaaacttcaaaatctatcgttggtgccagctgcgtatgatcgtagcattgaagattgatgccaaaataaggtaaatctgtcgccaaaacaaagcagtgcaggacagcaactgctttcggcaagagtaagtacatcaaacttaaaaattcatattcaatgaggtagggaagtgcaaggaaggctccaatgctgcttgcaccgggtgaatgtttatcaaacgaaacatgtccattgaaaacatgacaacataaacttttgtagattcagaaaaaagggaatacctaaagagcaattgaaacagtttactatctgtgtaggattacagtttaagttcatgcggttgtgcagataatcttttaaggtcgcctaaagataagcagctttccctgattggcaattaatttctgcctaaaataaacaatctcagctcgtagatgtttatccggaaaggtgacatattatcatatccttattatccacaactgagaagattccattagtcattttctattactagtgtaaagcattagctgaatgtccatgcacggaatgcttgatacatggaagcatgaagccaaaagctcaattattagaagcaacaaaaagtaggccaagccaggaggtcaagggaaatggattaattttaggaaggaatccaacctaacctggcaaggtgccccatcgtgccagctatttgcgaagccagaccagcaccaatgcaatgtactttggttgtatgcctcttcagtctattcacaaccaactgcactgtgctttggatatatacggggcttgtgtgccacctgaccaagggccaattagttaaattataacacaaatagcatatcaaatgtttgatgcatgttttagacaagtgtatcatagtatcatatcacaagcatgcacagcgacaggtgaatgctgatatattactccttggttgaggagtatgcttaattgcatatagcatcttcaaaatcattatggcatggtaatatcaaattttcaacattacaaattattaatattgttttgagaaactcatttgatataaatatgatagcaaataactatagaattattatattacgtttatagcattataatctatcaatctaagaagtccaagttggagaaatttgaccgcactttctaaagcgaaatatatttctaatggaaggggtaccactttagctcttggtgttctttgtcgaattcttccaaattagttagtacttaaaggagcataaacacaattcatacaaatggaaataaatataggatgatgatttatttcaaaaatgacaatataacgaacgaattaaggaagtattggcacagcctgaatataccactatgaagtgaggcatctcttcccttttggttggcgatcctagtgcaagcccattgagtttatataaataaggcggtccataggagtaataattgaatatacatttaacaaaatgttatataaataaggtggtccatatgagtatttgaatatgtaacaaaatttacgatgagatagagcaggaatacaaaatcatttgtgtaatgtactaagaacatgttgaaatcgtgaaatgcagcaccacatgcgtataatgtcaaatcattatcacacttccaacattaaaccaatggaaaagggcaaataaaacatggaacatgcaaggtatctggcaggaggaaacaagatatcacaagaaaacagtgcagatcatgctatgttcaggtgactacgaagtagaacagcaaacctgtcagaaagcaataaagtcctgccaggtattttgtgttttcaccatgtttcccagaaataaaatgactgagcaaacagttccagtattgccataaatggtactccctccgggttgataatacttgtcgttttggacaagggcacggtctccaaaaaacaactttgaccattattttctattataatatgtataaagtgttaacaaatatataaattttattaaagtacttttcaagactaatctatacatgtagttaccatatttgaaagataaatattttaaaaatgattcataatcaaagattctaaagtttgacctcacccttgtctaaaacgacaagtattatcagcccagagggagtaacttaacaaccattgtgtgtgtgtgtgtgtgtgtgtgtgtgtgagagagagagagagagagagttaccagttgacaacgtggatcccagaatctgatcttccaggaatcaaacagttttgcttccagcatatcaagatgtgtgcaccgaaaatgtcggtttacctaaaggcacatgagggctgaggcacaaagtaggtaattctactgtacttataagaatatttgctggataaagagttaatgacacattttatttagtttagttgataacaagcacataatatgatgtgtgaataattcagcacaagcacgtataggaaaaatattttctgtcatgttgaacctcaaaaaattatctgtacacatatttgaccctgatcctcaacttccaaaactcaaaatataggaatagctaatgaattggaagtttccactgcaacaaataagcaaatagaaataatactaataatgttgcaaaggaagacagtataaaaaatgaagttatcattgatgactaaacaggaagcaatgaaagcagatgatttcctttcctatcaatctcccaagcacattcacgttgatgcaccaccttttcttctcctagtcgtcctctttgcagtatattgagacccagcagcaactttgctggtattctgattatcattcacaggctgctcgtctggagcctgactgacctctggagatgcatttgtgtttggaagagtttttgctttctgtgatctgcttgtactaatctgccttcttaggcgcaatatctcaccctttgctaacgccaactcctcttcaagatgtctagccctcatttcaaaactctccttctcagtctgaagcctagagataagattctgagcatcctcagtgttttcatgagcttcagttgtgatcttctgttgctcagcaagagcctttgataacatttttttctctgcttcaagagtgtccttcctagaattagtttcctctagctcctttgatagtgataatgcactcctgttcatctcgtctagtgactttgttgcttcatccaggtctgcttcaagagcttttcgtgcttcagaatccatctgtagttgtttcaccaaagcctcaagctccctattcaaagtagtgacagttttcctttcatcaacaagctcctgtgacgtggattccaacttcttgaacacatcgagcaattctttcttcaggttgtcacgagcttccacaatggatgcaagctcattagaagtggcttcaagttcttcctgtcccttgtgaaccatctccttaacagagacaagttcgtctgacagagctttagatactgattctacctctcctagtttgttagtaaggccctcttgcatttcattgaactcatcctggagtttagaaatttgcagcaccaggtcctggttcattctatttgcttcatcaagttccactgaaagtttggatacctcacttctggaatctgtcagtgcctcctctgtggattgaagtgattctcttaaacttttaactgcagcaacttcattctctagcattgcttttgttgcatccaattccttgttcagcgcagcgatgttctcacggtctttgctagaatcacttaatgcatcagagagttttccatcaagctgtttgatcatattatctttttctaatagtagctcagagttgcggctctctcttgcttcagaagaagccttcaggtctgtataatcttttgttaactcacttagcttttcctcagcttcattctttgcagagttcagtgcttgaagttcctcattcagtaaatcaattgaagatatcttagaagaaagatcatttctagttctatgaacctcttcctccagttgctgtattttagcttctgcaagttctagactctctttagtttggtcagagaaagagcacagattacggtagtctgcttcctttgacgaaagtaatgaactgagttccctgatgcgtatacccttattatcaatttcttggctaagcaaacttactttttcctgcaaaatgttgacatcacccaacttttccttcagtttggcttcaagaacatctttgtcatccccagcttgtgcaagactgctctctagtcgacgtatttcttccctaagctcctcagccagtgtcttctcccttctgaattcttcacttagcgaagttaccgtcttttttgttgaagacaactgatctaaaagagaggcttcctgctcctgaaacttcattgcttgcttcttttgtgctgtttgttgatccagcaatcttttctcgtagttttccctcatcaatgagattgctgcctcattttcagccagtttgctctccatctgaacaagttagcaaaatggatatgtcagctaatgtcctatattagcacatcattttttaaaaaggttttcaagtatgagaggtacataaaatagttttggtagcctcttgcatataaatctgagttatattgtgctgtgagaacttaagcaacgcttgttttcctaaggggaaacatcatgacggaaaatgagttaaaactttttaagctcttcatgagttctatactttgttagttatcaggttataaacttgagggtgcacagattttctagataaaagaaaataaacaaaacacacaagcatatgtatgcaatcacggaatgtacaactctttaatgtgtatgcatgcaaagatggttacttcgtggaaatttgactatgcaaggatgtcatgggacacttcaaaagtagtaaaatagaaacagtagtaatggacactaattacaggtttgcagatgttttacagatgagacgacggattccagggccttcttttcctgttgagaagtgccatacagtccagcaagaacaccggaggcagcaactgcaattgcattcaaaagaccagaaagtggattcccaggagtttgttcttgcgtgacgggcagggatgattctggttgcaaagcttcaggtagaggagattcagcctgagtttccccaggctgaggttcatcaggcttttgaatatcctttgtctctacagagaaaaacaatataaactatttattccaagtttgtacaggatatttccaaattagtcctaatatgcaagcgccaacatgagatgacaggaaggcagcaccaacaaaatcaatccaaacaatatcacatgcccaggtcccaataccagtttacaaaagaaccatatagtaaatccaacacattccagtggttaagataggtcaaaagaactttgcaggtacacctcaaagtatttatgccagaaaacaaaaataatgcagcacatggtagtagaccacgacagggttcgctaacataatcatagaccccgtatttagtatgagctacttgtatgagggggaaattctgaccatcgacaatagcctcattaggtctacatatgacagtattacgtccaatcttgaaagttttgtagcaagtctgagcttgatgatctatccttgggaaatcaacccgctttcttctaataaatccttggggaaatgacatgccataaactgcgggaaaatgaagaaaaaatgacatatggtcacatgccataatcagactcaaaattcactgggataagttgtgaataatgagcatgcatgactccagtttgagactttgtcatcagaatgtgaaattattttttattaaaacaacacacttccatgcaaataccagccaaattcagcttataaatttatcaaaacttcccttatccctagttccaaaatgcatagggaatccgcgtggtgtactcaggatgcctaacacatggaatggcaatcataaatcatccactgcacctcacatagtggatttgttccatttcaaaactggtcaacagaatgaaaatgaatttgtttgcacaaaacctatacaaaaggggtacaaagggtaagatgatatactgtaagtgtacagtttacttagatgagccatctacagccaagaccaccttcatgtaaaaatatcttactgcataaagcatttacaaactctttctaccttttgcaccagtacaaacgatcactgtgacattctaggtccattcttccatctgatagttccactctagtgctaattgaggtattaacatgtagaagtccatatagaatcacattcaacatgtgtatgtttgcagaaatagtctctgcttgtgggaattgtgctattccaacctcctaattcctttccatccatgcgtatccctgctcaaggaaagcgattgcgcttgtcccatgcatacataattgcttagcagcatttgttagcagatacattgtaaactcttccaccattagcctgaacagaaagttcagatttctcatgtggagctaaaacgtccatataatgcaacgctgtacgttagcagtaatctccatgactgaatccacaaaacaatctatacaattggacattacagaaaatttaaagcccaaccataaatgattcaaatcgcacacagatttcatatggtactccacaatgccagaccgaatagtatccaggctgggagaaacacaaaacgagaacggaattcaaccaactcctggaaaggagaatggcactcacccgttgcgagatccccgctgttaggcgtggccaccgcggccgccgccgcggcttccctggcgcggaggagcgggagcgccgagacgccgaggagcacgccccgccgcgccagcacgtacgcccccgccgccgccgccgagtgggatgggccggcatcaccggacgacgacgacgacgacgccgagctcgacgcgacgatggccgcgcctctccgcgcgcggcctcctcggcggcaccggaacgcgagcggccgcggcgccggcgacggcgcgaggaggaggtaccccatcccgtcccccacgacgcgacaaccccaaaaccctagccccccctcctcgcggtggcgctcgccttcgagctcggaagcggaagcccgcagtgaaaatggcggaggtgaggtgaggattaggcgatggcgaaggcggaggcggagacggcgtcaccgcgtcacgacgggtccgagctggcgagagaaaaagggcaaaacctttttcatgtacccacgaaatgacccttttaccccccgaccctttcaatccagcactgaactccgcgagcacctcggtgagggtaatttggggcattcccccacgcgggtggtgggacccactggcagcgggagtgcgggtccagtgagtgagggtctttctgttttgggatttcggaggaacggaggaagcgagctgatccggagcgagagatgaggattgcgccacgtgttagtgtgggcccagcccagcaaggacaccgtcatcgcccaattagcggtccgcacgtggcccagtacaaatggtccgcgagtaagccacaatctgtgccggcccgatatagatgggccacacgtaaccgcaatctgcgccggcccaatttatatgggcctcacggattccgcaactccgttccgtcccgttaataatgggcctaatacatgtgggctaacacttgggatcgctgtttactaaagatttttttttcaagtacgtctagcattactcaactcccatgctttctgtctaaataaaatgaaaaagacttcggttctcatcgttaatggcatatttacgaatgaaaagtaatttgtgaataaaacttttatatacgtgttcttagcgatctaaaagcaaatgctggaaaataaactttgaagaaaaacccttaaaatcaactgcaaatttaatattgaaaattcagattttggctgataagcataagcataagcgaaaagatgaggctgttccatcctttctcgatggaattcgagcccttctcaaattagtttgtgttttcttgtagttggcaaatgtctgaattctgccatcgcaaagaaaaaaaaaagactgaattccgattcatttcgaaacttgttgcgtgcaaaatgacaataagtttttgcagaaccatacagatggatccaacggcctctgccaaccaaaataaaacgatgcaaacattgcagtgaagtgtccataaaagttgagcaatgtatggccggctctgaattcaatacaagcagtcccaaatgcaacaactgttctgctctgcaacgcttgttttcctgaccaacagagccccatttgtagaaacaggtggtattacagcaaaatctgaatctgctgcaaatcatctgaatctgatctgattatctgaccatagatttcagccacaaaaaaaaaaaactttctttaattctgcaccctctacatcattggcctctgacggtccaagatgagatccagcattcaaaaccatcattaacaacatgacatttagtagcaaatcatccagataagtagtattcataagacggggactataaaccatcataacaacttgacattagtagcagatcagccagttaagtatcttgatgagtctggaattattttcactttcacatgcaaatgctctgcatagtttctacttgggcatgatggtcagtttgccctgtctccttgaatctgcttgatgagaccccaaaatgaactctacgcagtactactactacttcagctttcttgattaagcccactatggttaggaccagctatattctctgataggccaaggcaaaagatgccttgaattcctaaagtgcaacgagcaaatcaggtcagttagatcatcatcatcattatcaccattcatcatgtcatttcatcagggtaaaagaagaatggaaatgacctaaagcagctcaatgtcattatctcacagcagaagtagtgtagcaatattgcagacattgtcactgctgccaaagagcaagaaatgaagaagaaagaaaaggaagaaaaaaaatggatgtgggcactggccagcagccttaggatcaaaactacacgactaaaatcactaaaggcaggcaggcgacctctcttttctctaaaaagcccagatctctgcaagtttccaggtccagtaaaagaaaaaagctcatcgtctccagtgataatgacccaccaagaacattggcttcttcttcttcttcagtttgctgaatcaaaaacaacagactgatgatagatagcaatgtgagctggtgattcgatcatcttgatctatcccctggtagaagaccagggggaaaaaaatttggacaacttgcggaggcgaggacaggttcaatcggtcggtccaggccacgggaagggtcaggtcatgtcgcgacgaacatgccggccatgaagatgtcctcgtggagggaggagcaggatgagggcggggaggagacgatggtggtgttgttctcggcttcctcttcgatcgggatttgttggtcccggcaattggcgctgcagaatgctttctcaccactgcaagagcaaaatcagaattgttcagtgtgcctttcttactgatgacgcagccggcaagatcatgtacaaaagataataataatgcatccagatgaatcaacaccaaagaaatatgttcagtttacttttgatacttttttattagcaaccaatttccaaccaaatcaattgaacctagcaatatataataaaccaataattcagcatgctgttcacatgtccagttcgatttactacatcatactgaaatcccaaaacatttatgatgaacaatgcagcaatttgttcgatgatttaagtaattccagatcagagttcgctccgcagaaaaatgtcttgaacctgaaacatgaaatgttcctccaaacaatgcataaagaagaaaaagaagaagattgcaactacataccggtaaatgtaaatgtcatttccctccagcttcttcttgcaagtgaagcaggagctcaagaagtcgccgccgccggaggccggggcggcgccggcgtcgcacttcaccacccagtaggactcggtgggtgcttccgtcacatccatggcggcggcggaggcggaggcgtccatcgtctggggctccaagatgcagtcccaatatgtgggtcgtcttgggattagggccgcgagcgatgatgcaggtgtagtcctccgactgctcgatctcgctcgccgagaccgagccgatgaaccgccggacgccgccgatcgacgccggcagagagcccggcccagggatcttgccgccgccgagattcgaaggatgcggctgcttggcattggggcttgagctgccacctggattcgaagtgcgcctccagagacacagacattcagatnncccctcgtagatagaacactgccggccacgagcacaggaccatacccgcccgtgcaggcggaagagcaggtggacgggtgggcccgcccagcgagcgccaaggaccatacgtccttggtcgagggctacctcccggagctgcggacgaagtagcctcgctcgccgcaaagtaccttagggctagacgaaggtcgaacagacattgcagtcgggcctcgacagcgcgaggtctgaaggagagaaggcaagttgcttgggcaggcggtcagtacgtacggtcggcaggcaggcagaagggcgaagggctcgaccagggctcagagcgatccccaccacggctctctcgcgcgacccgcgcgcgacccggacgcagtgagctgccttgggagatccacgcgcgcgacgtcggtgcttccatcgacgccggcatccaccgcccatcccccctgccccgcgncttcgcggcctagcccaacaaacaacctcggcacggcgaacagcgccgcgccgccgccgccaccacctcgaaccctccccgcctccccgccgccgccgccggcgtccgtgtccgacaccaccatcctccgcagcatcgccgccaatccaaatccaaatccaaatcccacctgcaaaatcgccacgaaacttaacagactcaccagaaatgaagaaaaaaaaagatcacgacactttcacccccacacccctcgcttcttccaaacaacttctagtaacaaacaacaacaatttatgaaaagaaaaaaataacaagaacagcaagaacaccacctcacctttcctcctcctcctcctcctcctcctccaccggcctctcacactctcgatctcacgagaggagagaagcggaaggagacggtggggaacaaagtttcagtgaaatcacacactgtactactactgacgcgagctcatcggtagcaccatctctctctcctctcctctcctctcctctcacgctcttgtgcacttgtgcgcgtcctttgcatgcatcaaaatcagagacgcagcagcgagagggaggggagggggttggcttctgaaatactcgtacacacacgcaccagtacaccacctcctctctcctctccttctgcttcagcttcagctcggctcgaacccattcatggatgtcagagaaagggaggcaggcagctgctgctgctgcaaccctgcggctgtgctgcctgtactactctactccctccgtttttaattattattatgggtttttatccaaagtttaacctttattttattttattttattatgattagtaatttttattttgttatatagtaaaatataaatttgtattttatgcatgacttattttattttaatattttatatatttttgaaaaagaatggtgaaacgttagataaaaaagcagtcaaaacgttttataacctgatacgaggagcggtagtactatgtactatacactgcaccgtgtactctacgcgtataggagtaaatatacggacctacgcgtgggccgtaggttgcctgcttggcatgtcacttcagcctgtgatgctacagaagtaaacagtggtagagtatttttgtacacgatgctgcttccggtttcgtgtaggggtaggcgttctcagatcccaccagagcatctagaaaaatgcacgagatttttaccaaaattgttactaccgctataaacgtggtagattctcaagaatacggctgcctttgattggagaggtaaaaagaaaattactactccatccgtttcagaaggtaaatcatcctaacatttttcatatttatattgatattaataaatttagatatagaaaatgctaaaataatttacattgtgaaacagaggaagtagatacacaaaataaggtgagttattattatataattaatcaagtattaattattttacatttgtaaaaataggttaatatggtttttgaaccaatttttctgtatttttttaaaaaaaaacatatattttagtagcttcaaaagtatacacgtgaaaaacgagggaaatcttatctccatcagcatcttcgaactcagcctacaacggatatattattgaaacattattgaaacggattatttaccccatcaagaggagtacgtttttctaaaaggttttcttttactgtttactttgatcatttgttttagctgtttgttatatttactttataatatatttagctgtttgttatatttacttataatatatttaattttataatcaagttgataatttgcggcagtaattcacctaatttcttaatatttagaaccaatgttgcattttattcacttggattttgaatctatttccttcatctcaaacatagtctaatcctagttatgaatagacatatacatgtccaaattcacagttaagattaggtattttattggacgataggtgtatgcggtattttgctttagtagcttgcaattggagtaggttgagacgttggatgaatctggacggttttcagcaagccataaaatcacaccagagaaacagagaactgcttcagttttaagtggaaaatgacaagagcaaaacagtagcacggccatgcatgcatgcagtcatcagttagttcagtgattacacatctttgcaacctcattcaaactcattaattggcataattactgccttagcactgttgcacatgaccggttccaccaatctaaactcaacaacaaatttgggaccaaaagatagtaaaatactcccgaaaattaattccgcatcaagattcaatcaatcatcattatcatcctacctaatactaccaccaccacataatgacataaatcaccccctccctgtgaatgatcatcacttgagaagttcagatttctcgttggatcactgcattaggtatgcaatgtactgtatgcaccacaatcattggacttttaggagagttttcccttttctcttcttttcttggtgctgttctgaaaaaagaaaagagaaaacctccccagcgtgtaagccttttccttttcttctctaatttccaagctgtttctgaattattaccactgtttgtaaaggcataaagtgatttggcaaaccatacactctcctggcaattcatcttttcttctctcttctctctctatatatgtctctctctctgttcatcttgtgaacttgctttctttaaagcagagtggctttagcatttaggccattcacaatgcatctacatggcatttggcctcaactgtccagctaagcagatggtatacgtggagaagaaaagaaggtggagcacatgtattcaccagctccgcgcgtcctcatttggctccgagagccttgtcagaaaaacagctttttttaatcgcacttgcacatgagaaagcgggacacagagagagaagggggagaagctaacccaaaaaagtaaatttttgtggtggggcccgcatgagaaacagtttggtggggtccacctaaagacacgcgcccacgccgcattgtggagagaggagcttcacgctgtttcttcgtacgtggctgtttaggttcctcagaaaaacacgacgcagtgctaatgcccttaggggagtagagagagagtggcttttctaatgacagtactacaaacatgctactcatcctttgttttcactgtttactgactgacatcaatctagtggtactatgatactataccacatcatcattgtgtatgtaggagtagggtccttagctacttgtgcaacttccataagtttacacttgacaaagttggcttgtgtcccccttcatacaaaaccgggttcaaactcttttctctcaactctccaaggaccacactgcctatatgaattctttctatgcatcggctcagaaacattgtcgagctataggtgaaaagatactatccaactacaacagtagtagtagatactatcagtatagtattaagggcctattcactttgatgacatttttaaccttaccaaattttagtaaagttatcaaaaaagtaactacatttagtttgctaccaaattttggtaactatataagaaatcctgccaaaattttggcaagactatgtcaaaattgctaaaatttgataaggttttttttggcatcaaagtgaacgggccgtaagaatctcaatgtgtgtacaacatttcaatgtgtgtgtgcagtcaaatctcacaatgtcaagtggctagtacatgtatgaaagggccggtttgatttggtttgtagtgtagccaaactcaacatgcaacaaatagaaatgacattaacatcgttatcctactataaaatttcgtaactccggaaacttacactctcaaaaactacaccaattttggtaaaactttaaaccaaagggtacctacttattaaaatacgccaacatttcgcattgttgctatgattgattttagtgccaaaaaaactaagatttgatatatgaaaatgctgaaaactatttataataatactcataaatatgtactacatctatctcaaaataaatacagcgttggtatgcgtatccaacatttgaccgtccatcttatttggaaattttatgatttttttcaaaaaaaattagtcacacataaagtaatatttatgtgttatcatctaataacaataaaaatattaatcataaaattttttaaataagatgatcaaacattggatatgaatagtataaaactgtacttattttgaaaccgagcgagtaagaaattcaattgctgaatgtgtgtagatacggtgttgacatcttggcatgcaaaaaaagatcaaagaaatgtagcactaatacctctaggatgagatggaatcgaggtgaaatcccatgtagtagatgaaacaaatcctgagcatgatgattttgttagttttgtttttaggcgtggatttgcagtgggggcagtggttgcaaaacccgacaaatcgcgcaaattttcagtagatgctctgcaaagtcccatgacgaaactctgaacccttgcccgatatccgatgctaattggacggttaactctgttgcctctcctgattctctacgccgccaccatctttttgacgcaaaattttacatcagcatgtaattttttttaagaataaaaatcacaccgccacccatctgaatgtattttttattttaaaaaacaaacggagagagaaaaatcacatgtttgaaatcaactattactgcatactcatcagtcgtataaaaaacgaatctaaaatcagatgcgacacattactataaatctagacatacgaagtttgtatatctagattcataatactaaaatgtgtcacatccgatactaggttggttttttatgggacggagggagtatactgttagtcgaggtgttcagcgatttttttttgtcaaacagtacgaattgagcgatagccattttcttgggcggctgaccttaggctttcgttcaaaatttaaactttcgctttcacagcatgatatgatgaaacaaatttcatttttgcaataggtggttgcatcatatatataataatcgttggaggaaaatcttgtacagcatgagtgcaactttagatcatatttcacggagtttctttcatatttcatgaaaattctgtaggtttaataatgcatcttggtgttgggtgaaaaatttcaatatatcctagtgtaaaactaaaagtacgatgcatctacctaggtttgatgcatgcaatggtgaagggaaagagtaacgtcacatggatatgccaccataccctacaaaaggcacgatgattttgggagattttcatgtcggtgaggcacagttgcctgcactctttgagcatgatattatgagagcaaaatagcgacaacatcggcaacaaaaaaagaagaagaagagggaagtcaccgaggtggtccggacctggggtggcgattcgatatgagagcgaagacgacgacaagtgaaagggatggaactaaggggatcaaaagtaatattttttttcctccggctataggtgcatcattagcatggtattaataatttgtgaggggtttgaatttcattcttcataaaactcacatcaaactcattctatgaaccgaacaaaaattagtaatggttgaaatgcatttcgagcccattctagctatttgcattgataaggaaactgacttcaatagtggcttcaatctacatgtcacatcatctcgcgaatatatatatatatatatatatatatatatatatatatatatatatatatatatatatatatatcttataaaggctagtttacattataatatgtttttttatcttagcattgtaaacatgagtatgctctcagtagccggttttgtccaatggccaataaatacaaacagtttgttcactttgttacctatatcttataatttaggacagatgaagtaatggtttaagtatgttgtcttattaaaatttgataatattgaaatttagtaatgcaaactgtaatgatcaaaattttgctggcatatgtccagaccgaagcatacgtacccacaaccgcacaacgtatcccgtgcgctgtggggcccaaagagcagcgagtgatgaccgtttttttataaattggctctttaaaaaacttattctgaaaatagcccctggcaaaaactagaccgtcataacgtctcagcgctgataacgttatcggcgctgagaagttatacctcagcgtcaacctcaatgaatgctgagcgaatgtctcatttatacaataagtttttagcaatgtctaattttaaaataagttttatggaagggtcaatttatcaaaatttcgggagtgatggaggtacgacgtactccaacagtagtagtcgtccacttttacggggacagcgatggccccgatttgacaaagccgaccgaccccaccacctcaatggtggggcccgctacgctggattctgattttttccctcctttctttctactacagtactcattttctcaggtttttaccctccgtgtaaatgtacccaatgtgtaatactactccacaccgtaattttcatatgccctcttttgttggtaataatgtcatctgtgctaacgggtgataatctcagcgtctcggccggcaagaattttgcgcagatttttctctatgtgcaagaatttttaacgtttctcgtcaaaatcaattctataaatatttgacattatcaacatttagtaaggtcaatgtttttttaactggttagaaaaataaataaaataaataaaaataatattttattgatagaacttatatacctgcaaatcaagaggggagaatataacacgatgaaaaaactcctaaaatcatttcttctaaaattaagttagaaaatccgaattttaattgcagcttataagtcagaaaaatagaagatgatttttcaacaatatttaggagttgtttcgtttaataccttatcatttttttttgtatagttacgcaagttgaatgtttcgggattcggaatttttggtaaacgcttatcaaatgctaaaattctgtaatgtttgttttagcaacaaattaaacaaagcccttactaaaagaatatgttggaatgagtagctccgcgataacgattgctggccatcaatatatcgtcgtttccaaatgttcgatgttggctactagttcaattttgagctaaccaagaattaaaaagagagagagagagcaaattttttttttctgtacgtaaatttatcagatgctaatactccatcgtaaaaggattatgaagttgaaatatatcccaaatgcatcggcacttcgaacttcttgctatctttactatgcctttctttcttctaattatcatatcggattaatacgtgtcttttctctaagatcattttaaagctgctccaatattatgagaactttacagaaaaaaaatgagccatttgagaagtttcaaggaaatcaaagtgtactaattaaaaagagaataggagaaagagagaaaaaaaaaggcagaactgagcgagacgcggtgtgtgctcggagtgcgcagtcgagggccctttttgtcgtcttccggagactctctttccacgcgcacgcatctcgaggcagtggtaaaacatctgacggcctagcaggaagatccgcctgccatcgtacggcccgagggagtcgagtgggagagtgggagagggagccccaccgcacgtgctgccgacacgtgacaagcaagcgtttcactcccttttcctttctttttttttccttttcgctttttttttcatatagtagtactacaaacaaatggagtggagtactcctgattgccgacatgggtagagcacccataaaattcactaaggactcatttaaaatgcatgatgaaaagtatatataggattttcataaaaattttagtgtaaaagtaaagattataatacacagtaaaaatacagaaacgatcgtttaattgaataaaaaaaccgtaagaattgaatgagacagactttctgcgatgttagatctcatattaaaaatcctctaaaccttgtattgattgaggcgttaattaggaatttcatatgattcaatagttttcaatcctaagcttcaaacggctatatgtacataaaaaaatcctacgaaattagaggattttcgttcaaactcctatttggttttctaaaatatgaaactaatagctcgaattcaacttttttgtcattattcttcttaatatatttagggtgtgttcggtggttcctttttccctcttctaccctattgttttccacgcgcactttttggaaatgttaaacggtgtgtatttttttaaaagatatatagaaaaagttattttttaaaaaacatgttaatctctttttaaattattttagctgatacttaattaattatgtgctaaatgatccatctcgtttttcatgcagagaatgggttgaattaggccctgtttagatcctccaatatggcaaatattttgccattttgtagcactttttgccattttggatttaaacactagtagcaaaagttggcaatttgacatttgacatttgctagtccatagtagcaaattgtgccaaaaattgctttgggaccactccctctctctttctctctctcactctagtgctagaatggcaaaactttaacatgcatctaaacaccaactactacttttgcaatgccaaaacttttgctaccaaaacttttgccatttgccatttgccattccaaatagatctaaacatgcccttactatgttctaactaagccttttatctaaaaaaatatgatcgaattttcctgtaaaacaaagtatacgatcggacttcttctcactctatgcagaaaaaaaataccgaattaaatgtaggcatatactatatctttttcggatttatttcattccatatatctttttaggagtagaaattatgaaaggcacatgacttgtactagctcatactatccctcgctcttttgtctgcatttgccatctgaattctcaaatactatactccagttgccagttgccagttgccacgcgaatctcaaattaaaaaatgacttttgacgctgtaatgatagcacattagcagcagtaagatgttgtgttagatcatgtacacacttttcccatcaggtgatgcagatgaaccaaacaccccaaggaaacaacaaccactttaattaaccaaggataaagctaaagatctttcacgtgccatgccatcgtactaatattaatcctagattgtcgtatacagaatcaccctaatggcactacaaaaccctttgaaaaaaaatccagtttatcctactaaactattgggttagtaccatttacaacccctaactaatgattttgaccatggcatacataccaacgtactaataactttgttttagctaaaataatcaaagtaccctaaattaatttggactttaaagaagttactaagtggagaccactaagcgtggtcaaagttacatgctttggcaccatatgcataaaaggagattaggagaaacaaacccaaattaactaaaaccaagtggtaatatatgtatttagaatttgggtatacgatgctcaatacagatctcttgtttgtggtatgcatgtatggacaggtcgccagaatgtagaactactactttgtgggaccatcagggtataaactaagtcaatccacaggtttcagtattgcaacaggttcatgtcatgccctctctctgatgtagcacagtctgcacaatgcagggtagtaggagtagtaaattttagtaattttagttactgcatcagcgtgcacatgatgccttccctgaacaagtgcagggatgcaattctgattttctgtccctatgagtttgttaaaaaaaaatactatctctgtcctaaaatatacttctatataaaaataaattttatttgtacaaatatatccgttcagatgcgttcggctatactggctacaaatactatgacaagacaatattgttgcttttcttttttttttaataaaaaagagtaatgtgatgtactgatgcgataaggattttgtatctccaactctctaactaggctttactgcacgctacgggtatgaagcaccatttttcgaacggtcagatcattgccgatggtttatataaaaaataagtgcctcattttaaggaaagaacccttttcccgttcgtgaaaaattttaaggaaagaacatgatcaaaccaaacggcctgttcggttgccttatacaacgcagcttgttgctgtagcaagtgaaatgggtgcaggttgcaggagagcgttgtacataacagccaaccgtacccaaattgtgtcccattatggttttttcagtttttcctaattaattatgtattgttggatacaaaatacctcgtctgacagcaaaatagtggcgaatgtcgatacgtgtttttcttgtcaagcatgatcaaaaggattttatcattgcaaaatcattttgacaagagaaatgaaaaatggttttaattgaaggatttatttttttataatgaaatgaaattatcgtcactatcttttcttgtttttcagccgaagagtaatttactcgtagtatttttactattttctactcgtggtaaatgggtgggcccgcaatcccagagacgcacttcacgagaaactaaaaattcctccagattgtgggccacatctgcagaggtttattgcggctattattttaccccgtggggggtggttgcactgcactgcattacattatgcacagtgacaccaggagcacagatatatttaatgattaattcattgatttacttattattccccagaaacatatagcagtaataaattccaaatatttgcatcatcctcaagaattttttttttattttttttctcatgggaatcagacaagcaagctctctgcttttattccccaatccacacgtcactgtgcaaggttccaagtaaacaatggcgatggtatctgcaggtgggccctctgaactgatagtgtgatgtctgtgtgcacacatacttttgtccctgaaccaggagtggtttgcatgcaaccaccggtacggttgtaatgaaacggttaattagtgtgcttgattatatatattttactattctgatttgatgtgtgtgtgcctgttgatttgacttgcaacatgcaaatttttgttctccgcatgcttaattaggtgtcacagttttattttattgttcattttggaagattttagaagggcatattctttggagtttggaattatttgagatatattaggtgtgcacaggaaattcatgtggcacgcggaggttgtggattcgaaactttgtctttattaaatcaaaggtacttacttatcattgtctataatactattattattacaccttcaagaaaaagaataattgcattaaagattctttacatcccaatatatcatcaggtcttgaaatttatgtttggtgcaagagtaattatatttgattaattgaatcaggaaagaacaccaaatccactccggatttaatctgtctgcgaccatgcatggtccatgcatatgcattatttgtgtcttgctgaatgggtgaagacaatgcagccaaaaacccaattagattcgtttcaactttcaactggagtaagcatatatggtccacgtttcactcatggaaatgggccaggttttatagcccccaataattgttagaattggagcttggtatatagacaaaaaaaatattttggcagttcataaacataagtatatttattaaatatatatttactacatataagacattagcatattgtgagccgaagtactattgtggtatttttagcactcgtttagatcactgataatccaaacattaccaaataattggcaatggcaggatttgacatgccatttttttacaaagaaaggttatttgatttgttgccaaaattttggtaatgcgtagaatttgtttgtttttctgccgatatttttggtagcaatcttcacatgcccgttcagtgctcaatgttggcgacacttaggaatagagtggaatcaaaatttggagttctttcagatgatcactctagcaagactcaagtttgcttggaggggctttctggaggttttcttcttagcagcatggcacatttggaaacaacgaaatagtttaatcttccagaatattcagccctccttccaagcttggagatcactttttgtgaaagaagttcttctgcatatgtgcagaatgaaggaccccttaaaacaaattgtttctgattggttacaaactttatagtttttatttggtttctttcctccttaattttgtaaatattttttgagttctataaaattacactgctgggtaaagccctggcaatatttctggtaaaaaaaatatttttggtagcaaaccgaatgaacaccctagcttattggcattgccaaaatttttctttttagcataattaagaagggagatagaccaagcccttcattccaatattcagctaaaaagacccatggtgatatccaaaactacaatcaagaaagaaagcagattgagtatagtggaaataggcgaacgagcctctaactgagtttgattaggtggctctaataacactcctcaggtattggttcgactgcgagtttcaggcacacactaaagcacagttctaaggctaaatcccctcgtctatcacacgctaaagcacaattctaaggcttagctcaagtcgttggtcgttttcacacgggttacgctgctgctgtgtaagcaaaatacctagggttatcttaccccgcaggtcaaatagtgaaaatagatttttttttgtcccaattttaaaatatcacaatctggccattccaatttagccccattacttgtgttgaaattgatcatcaatattgattggctggtcaaaatggtgggcatgcatgcttgcctgcccactcaattagtagtagtagtagtacccctttactaggtgctttcaaaggctgtgtttgcctttaattagtttgtgggatcagggagacagtctttctagctactctactctaaccatatcattccatcctatcattcatctccagcagatcatggtagctatagtaggatatatatccatgcatggctctatgattggatgaagatatctaataatgtggggtatctaattaattaattaacctagtttgaaataattaatcacgggagatcgcaacagctccataatcaaactcccatgtttcattttgttcatccgtgtgtttcagttcagtgtacagtacagttggagctagctaactagcttcagagcaagtttaataatatagccaactataagcttatagcttatgttagagttcacatgtatagtaaatgagttataatgttatatctttttttctccttctctctatctctcacttatgcatttaatgtatttatcttgaagtgtgtgaatagctagctcttgcatgagagtcaaccctttttatttttcaaattctttttcatccacataagcttatagttggcttatagcctactattatatacttgctctcactgtgacagtgactgacagtgtttaatttgtattttccgtcgcttgattgattcaacatttaaattatattgcagtgcgttgggcttatctattgtagcggagactggagatataagatattcgttgctagtaaaaaaaatgaaagaagagaaatttgaaggccacgtgggctttgtcctttgaggagtctaccgtattgttggtacagcccaattaaagcccagatggatcacgtacgagcacagccatgggcctagattcgtcacgtgtgttatgtgggctagatatgggccgtccatctgtttaaacccgaaggctcaatatttaagttagcaaatactccgcctgtttcaagctatagttgtttctagcttcaaattttatcccaagatatagctcccattcctcctccttttttttcaaccaattaaaacaatttctctacgtatcaaaaacttcaataataattatattttaaaatggaaggagtagttaagtcaaaacataaaaaaaaaacacttgacggcatattggacggtatatgaaatatatagttaatgtactccctatgacttataatataacaatctagtattggatggggcacatcctagtactacgatatgtctcatccgatactatgttactatatgagacagaaggagtagatcatactttcttcgtcctaaaaaaacttaaccttataataattggttgtagctcaagcaaagaccaggatgttttatttcattatcttaaaaaaaaacttaacctaggacatccccttctaatacaacgaatctggataagaagggagtaaatgtcacgtgaggcaatggaaaagtccatgtagttttttctcgcatgcccggacatgtgattcccacttcacaacccccgtggctcgtacttgcgtgaactcaattacgcctttcttcacgccaatgtccagcgtgagctctatctagatttcttatccgaagtattttgaagtaagtgaaaatcatagttgttaaaactggatcataccagcggttcaatctgaaaaaaaatagaaccagatcctctgatgaaccagaatcagaagctccgtcaattcatccattggttcaagtttaaataactacggtgaaaacaaagtgagccatgtgcgtaggagagcttcgcacgggaggaaagactgacgcgtggtaagaaattatgggtacctccatcaatggtaccttttcttgatgtgataccttgggctagttgcagctcacaattagtttcaatttctcaatgtagtcaatttttctgtaattccaaaggtgggcataaatgaaacatgaaatacaaaatacaaatacggtaagaaattaagtggcggaagacgaaactagtgaccctaataaccaaactagagtgagacatatcatccttattagctactgttcgattaattattgatccaaagctgaaaccaagagactaatccagcatgcatgcgctcccttcgtttggccacgctcaaatgaaacgacctaggaccccactgccacttccgccatggtgcttcccgccacctcttttgtgttctccgcctcctccagctctggcaccaacgccaccacccatcccggcacctccacctgctccggacccacctctagcacccctgcttgcaccaattcctcctcctgcaccaccaccgccaccaactccaagtccgccgcctgctccagctccgctactaataccgccccatcccagcaccttcgttggctccagacccacccccagtgccaccgcccactccaagtcctccacctataccaccaccgcctccaaggcctccgccgaacccgcttccaccaccagttccgaacccgcctccagcaccaccactccatccgaagccgctgcccaatcctgtgccagcaccagctccaaccccaaagccattgccgactccttcaccgattcctgcaccacctccaaagccaccactggcacctccaccaatgcctccactagcaccatcaccaccattgaggccattgcccttgcccccgtcgaaatctctacctgtattaccaccaacaccgccaccgcctccaaaacctcctccacctcccatcccacccccaccgccacctccaacgccgcctccagcacctcctcctatgtcgccccccatgccacctccagcaccacctccaatgccaccactggcaccacctcccatgcctccgccaactcctatgccaccacccacaccccctccggcaccaaacccaccacctgcaccacctccaaacccactgccaccacccattccacctcctccgagttcgcccccaccaccaactccacctcctgcaccacctccaaaccca

SEQ ID NO: 67101 - DNA, 5841 bp, Oryza sativa
ttcctgcagccctttcgacaattcggtagctgtccagaacggtgatgatcgaacctcccttgatggcagcgacgccaattctgacgacgagggtgactactctgacgaggacgatgatgaagacgacgacaatgatgaagaggatggttttgattatgaaaacgatgatgaggatgatgtgcctccgactacttctgatggtgatctatacaaccacacggattttggtagttcagacagtgaaaactatgtttcactgtcagggaggggtgacccagatgtaaaaagtaaagggagtgcccttgacagcagaaactcgtacagtgagcaatcaactgaactgacaaacacatgtagttagatgcactgcacagcacgtaaataggactactacccaatttatttggtcggtgccatcgttggctgctgctttcattacatcttttggagctgcattcactggcgtctttactgcaagctggagcctgattgactttgatcgttggagctgatttcactggcttttttgaccgaaagtccagatctacacgcatatagaccaacatgaatcttgtgcgtgagttcttattatggactatattttggtccaatttcattgcttagaaatatgttttacacttttacagatcatcaggagcaccagcagagtaaaaggagcaacttcctgaagccctgatgatccttgtaattagtactccctctgtcctaaaatgtcctaaaatataacaatttttagtcctcaggatttgtcctaaaatataataacttcaccaacattctcttcctaaccaatcacaacccttcaccgtttacttttcctacctaccttcactacctatcccatcacaatcctttaccattttctacatactttttcttaataaccgtgtttaactctaaaactttttatattctgggagggagggagtaattgtttaaaaggtatagagaactcctgtgttccaaattaaaagagtcaaatagttccctccaatacatgttagtataatacactctcagtttgatcaattttatagacaccataaaagtatgtttaataatggattcaataaaactaatttgttatcgtaaatgttgttagtttttcgacaaatttcgtcaaacctaaaaaaaaatagtttgtctttgagctggacgggaggagtagattttctttgaaccactgtaattctctgacgtggcgagcaacgattggctgacccacgccggatccggcccggcccggcccacgaacatactactgctgaagctgcaaaggaacagggctccgcctgacgcggcggcgaacctccgtgtgctgccgtcgtgctggcgctgctccgggcccacttgtcatcgggagagagagtaccagtacagtagaccagagcgctcgatccgatgctgttgatcgcgtaggataggatacaccccacaccacccggtggctgtggcttgggcttcgcttcccaaggcaaatgctcccggaggaaacgaaatttgtcaacccaaccgcgacacacgccgcgcgtagtggaattactactagccatgggtttttctttcttttttttttctctctttcagtagcaatgctcctacactagggctaagttcagttgatagtgttgagagtgatttgcgcatgattaattatatattagctaatttaaaaagcgtgaaagtaaaaaaacgagaaatgagagttaggagccttaggagaaataactaagtctaagcataggtgcaaatcataaataaatggtgcgagggatggaattttacgaataattacttttaaaaagtactatgaccgttctaaacacacacaaaatagttggtacagtatgtaaaaatattgtacatgagtgataagatcaaaggaacttgaaatcatgaggtcatgtgatttacttattttgttttgttgcattctatgtatataatagtattatataatttatcgacttattcaatcgaagagtctggtagcaactccgtgttacgaattgtagaaaaaatgacgtggaatcaatattgcatagtattcaatatcgtgggtgttttaatttttttcatcaaatagtcctcccacctagattactctagttgggataacacagacctaccacacgagttagaaggaaaagattttttattggctccaattgtctagtctaaccaattaacatttcttcatcatgttgacaattattaggcaaaattaagtttatccactgtagaggaggcaaatattcatattatgcatccgttgtgtacatggtaattttagacctatattgatgtcttcccacttctcttaatttgctccaataaaatagtttctctctgttatttttaatttgatattgtaagtaaaattggaggtgtagactagaccgaagaatatctaatgtgtaattaaggtttcctccccacttcattcgtctcataaaacccaacttagaatgagattagctaatctattactataatgaatatgaacgttctcctatccaaattcactgtaatagattatgttccatctcattttagtttaggttttttttcgacggagtatgttctaccaaacagattagttagttagtattgaaattataagcatataatgatttaatttattccataaataaatcatgacattgcaaatgtaaactaccataaacgcattattagatctatacatgtaaactaagcagtaaaacatgaacatatcaaatatgcacaacatactgagcacgtaccgaggtggcggaaagaccggttgttcggcaagaactactcgcggttgcgggcgtcgacgaaggcgcgcagcacgcgagcggagaggaaggcgagctgtcacggacgaacagggagcagtcgtgcgaagcgcttcccaaaaaccttattactgtcgccttctcccggtgcaggacgtcgaagacagaggttctggagacctgctctcccgatcgccggtgcacgccgacgagcgggatggagtagtctacaagcgacggcgcagcacagagtaagaggcaaaccctaaattgatttcgcgtatcttgtgtgaaggcggcgactcgcttgatcagggcgcccgcacgatctcccggtgcaggacgtcgaagacagaggttccggagaccagctctcccgatcgccggtgcacgccggcgagtgggatggagtagtctacaagcgacggcgcagcacagagtaagaggcaaaccctaaattgatttcgcgtatcttgcgtgaaggcgacgactcggtttatatagagataggtcgcttgatcagggcgcccgcacgatatatagagataggtcgcttgatcagggcgcccgcacgatatatagagataggtcgcttgatcagtgtgtccgcacgatatatagagataggtcgcttgatcagtgcgcccgcacgatctccactgatagaaattgatttcgcgtatcttgcgtgaaggcggcgactcggtttatataggataggtcgcttgatcagggagcccgcatgatatatagagataggtcgcttgatcagtgcgctcgcacaatctccacttcgcaaaacaaaaccgcaaaagaaggctaggcgaggcgagtgttccccctcttctctccaccacacatgctttaattggctaggagggcatcatcccttttaaagaggtccccctcttctagaataagtaaggtggtactaaactttccatgtatactatctcataaggtgggcttttatgattttctaaagaattaatctttgaatgggttaaggcccatctattaattcaacatttagcacgtcaaaacaaatgcaaggatccattcgcagcccctggctagccgctagctactcccaattactagtactaatcaaaatcaatttgcatgtactattaaaaaacaaacaaacaaacacttaccttttgcactctaatccatatgcatgtgactctcagaaacaatatccacgaaaccgagcaaattattaatcaagcaaacaaacacatacctttcgtactttagcgcaaacataatctaagctagtgtccatatcattaaaaagtacacttagccattctcacaaagtactcgtacttgacaccggccaatggaagggacaagcaaaataaaattaaaaaaaaagaaaagaaatccccctgaattccagtgaagtggccttcacgtgaccaacctaatgagtggcgatgcgttcagcttcttggtgagattgaactgcacgtgacatgtttcaggcttgagagtgctaggttgagtgcagctgtaatcacacagcactacactacaagtgtctggctgcattgcaagaagatccaacagaaagaagaaaataagaggaagaaagagaatcaaggttcaaggaggattttcagcaaaaatgaacgaaaaagaagtactaaactaattacagacagacaattatacatatttatttggtaattctctatgagtggttgtgcccttttacacaaatctagggttttgtctgactactatatattagaaaattaagttaatctcagcaatagtttgaagtataatagtctgtttgacacagcttcagcttggagcttagccaaacagttaacacttcacctaaaatagaaacggagctaggtgcagcgttctcataaaataaactaaagatgtggacctagatttagactactccataactcatctttaaacccaactcttattttaggagttgaagttctatcgaacaaaccctgaattacaacaacacagccaccacctctctttgcaagtctgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaacccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccaagataaataaattgacgggacgtttcagtgcaaacataagaacactatatgaaatctccgttcaattgatagctcaaattttaatcattacatttaagcacaaaattcctgagagtagaaatatatctaagttgtcctctcaatctatccaattaaacccacaccagcaacaccaccacccccaatggaaaccctatttaccaccgacatcacaaaacaggacagccatgatggctccaacatggaaaccccatctcttttcccacaaaaaagccatcattaataaggaaaagccactaattaaccaacctatataaaaaaaagcacaaaaagaaaaaggacgggaaaaaaggcgagaaaaaaaaagagaatttccagaagcgcgtcctgacacccgtcctccccacgaaagagagagacacaccgaatccaactccccgaaacccccatcccgtgggccccacacccacacctcacactgacagtgggcccgggtctcccaacccgggcccacacgtcggcgagacgggaacaccgtcccattcctttgcctcctccccccacctatgctgttttttgttttgctttgtttttttttgctcccactcgataact

SEQ ID NO: 67102 - DNA, 1928 bp, Oryza sativa
aggagggagggagagggaggcggcgctgctgctggtgctgatcgcggcggcgtgcggcttcgtcgtcgtgctcctcaacctccccgacggccgcgccctccccggagccggaggagtacccggtgcgcctctctctctcgtggaatctactacttgctcgttcccgttcatcctcctccggcggccgcccgcgctgatgaacttcgcgattcctttaggcatttggtgctctgattctgattctgattctgattctggcgtgctgcttaatttagccgcgtgcttttttttttgtgctgttcctgctgcgaactaatggcgatggcttgatggctttgcggtggggttgggtacaggtgcggttggggagcacacgggagggacccatgtgtcggtgaaggaggtgggtgattcggattcgagttctagttcgattcgattctactctgttttttttttctctccaattttctgtacattttttttcaaattcagttcagttgttgattcagtgttggtttttttgcagaggcggatggtagagatcgtgagacagcagcaggacgtagcagcacaggaggtatgtaaaagttagcttgattttagctgcatgtggatgtgtatacacattgtgtggttttcgttcgatttcgtcttggtggagtagtgtggtcgcagaatggagtagtgacactctctcagtctctctgttcaatccataaagatgcagagtgctatactgctatcggagtatcgattttgttgtgctcagtgatctgttctaacctgagatgattcatctctgctgaaatatagcttctggtgtaaggggaatgcttagtcttctgacaggacagagtgaagtaaattgaattagggatgagatttgggtgccctttttgtgcatttctgacacttgtcctagtttacagtggagacagttttgtgttgcatccctgagcaatatgcgtaatgttgctcaagctcaactaactgtgtttggaggctagtatagatatccaatcaatgcaaatttagtgaagtataacttctggtgagtggggaatgcctagtattctgtcattacagagtgaagtgaattgaagaagtgatttttgtgatccttttgtttttcattttatacagttgtcctagttcacgattcaatcgattttgttttggtcccctatgggatatgctcttttgctccaatgataatgttttgtcttgactggtttggataatagaataaatattcaatcaatgcacttaagagaaactgatgtcagttaatttttctgcagttagaaggacaaactgatgaaaatgctgcagaggcagatgaaagaatatctagatctcctcctggcactaaagagaagttatggatgatgcaagaccagctaattatggccaaggcctacttgcagtttgcttccctgcatggcagtgcacatttagttcgggagttgaagttgagaatcaaggagatagagagggtgataagccactttagcagcagttcccgtgtacccacgaggtaagctataatccatgatctgcaagtaaaggattgatttgtaatagtagttcagtctcacaagaataaatatggatagttgtgctattgttaccatcaatagtcagttctatgattgaaaccaaagcaattttgcagtgcactgcagaaaattagggcaatggaaatgaccctatctaaagctcaaagagcctacccacattgttctcatatgacagcaaagttacgtgcaatgacacatcaaagcgaagagttggtcagagcccatcgaagcgaaacttcattccttgagcaggttgcagtgaggacattaccaaaaagccatcactgcctagcaatgcgacttacctcagaatacttcctgttagatccgaaggaacgtgaattt

SEQ ID NO: 67103 - DNA, 10482 bp, Oryza sativa
gggttttttttgggacggagggagtatatggcacccctcaagtcttcgaaccattcaaatcatcgcattcagcccaaaccacgaggtctttacactgtcacgctgatgcggtagtttagtaaaaaaaaaaaagtacatgacccacctactagtgtggcgttcctcctcctccccccgcctctttcagtatcctcggtcggctgcagtggtctaggcagaagttgtgaggactaggtggcgacggcgtgcttatggttggcgcgttaaatatgaactaacaaaccttaaatattaagggatggagcgactattaattttccttttttaagtaagagggagtattaacttataatcaagacgacagtagatgcatagaaaaacagatagatcaccaagtaaaaacccctcaattgttgcaacgtccattttgtttgacagtactatttgtctatcatgcaacgaagaacaccaggaaatgcccggttgtatgtttggttgagctatgcctacgagctacaacgaattgatgaaacaatcaacgttgtctcatcgtgcctttataagagggggcggtataacgttgaaacatgtgtgaaatgaaatagatggcctatttgattagcaatataaattaatatttggaaaataaacatagaaaatatataactcataactagtaatgttagcaatacaatacgtgagagtttttaagaactcgtatttttgagaagcattatccagcaaatgataatcttgtattaatcaaccgaattgctaattaggtgatccaaactcttgacgtttaggccgggtttatatatatgtgcgacttgcttgagcttttggccggtaggtaaaataaaacgttggattagtgtatgattatttgtgtataattattataaaattggaaaattattttatttgatttttttttaaaaaaatcgatatacaagtgtagcaaacctagaattgtgtaacatccacggattcttgctcgtctgtgaaaaaaaactggttcctgctttgtggcttcggctctaaatgtccctgtatttacttctgggccgtacaacccatgcatttaactggagctgagtgtgtggtgtgccgtactgacggcccagttagacgaatggcacaaaagaggtacgaggcttctcaaggaaacaaaaggaaaaagtacatcgaaggtccctcatcatgtcctcggattacaaagtcctcctgcaaccacaaaccagatatttgacatcgctcatcttacaaaaccggatcacttttggccctcgggcgattttgactccgattttatctgacttggcatctgactcggtgtgggtcccacatgggccccacacgtcatcctcatctttctctcccctctccacctctcttgctctctccttccctctcctcgggcgggactgcggagcagttcggtgcgccggcgggcgcgggcggcagcgggggagcagctgggtgcggctggtggccggcaggggagcagctaggtgcggctggcgggcgcaggcggcgggggagtatctgggcgcgagtgacgggcgcaggcgacggggaggagcactagcaacagcctctgatggcgtggcgacacgacgacggcggtgacacgggagccccgacgaagcccccgtcccgacgctgcctcctcccctccccttcccttattcttatcgaaaactgcatcgataaatggcggtgcgtatccggtgaagagggatttgaggtccgacttgacgtcgatgagcgccccgtacattccgagcatgatgtagagcttctccgtcgccggggtggacatggccatggcgtccgcgagccgatgagctgcaggatgcatccccttgggatgtcggcgaaacactcatggccgagcttgttttgttcatgtggatgtgtatgttcatagatcggcagacatcagtgtcctgtatgcagaatcatagtagtatttggctgtctttggctagctctttgctgcagaaaagctcacatgaactctttgaatcgccataattaactatagagctggtccgtgcagttgttgatactctctccgtattttaatgtatgacaccgttgactttttatcaacgttaaccattcgttttattcaatttttttgtgaaaatatgaaaatatttatgtcatgcttaaagatcatttgatgatgaatcaagtcacaataaaataaatgataattacataaattttttgaacaagacgaatggtcaaacgttggatgaaaagtcaacggcgtcatacattaaaatatggagctagtccttgataggcatagccccgacgacgcacatccctcgctggtgacgagaataatggcaatccccttaataatttgggcgtaggcgatgggtgcagccgctgcgaccaaccaccgctgtggctgcggggctcttcccggtagagcggcgcttgtcatcgttgtcacggcgtggaaggcggcaacaagaagatggtggctgtaggtgacgagatggagacggagtctgctcgggagaggacggcagcaacgaggcaatgatggtgccggtgggtgacgagatcgggctcgatgccatcatcctttatccgcgcggagtcggcaaggacgggaaggagctgcgcgatctctgacagcgtcggagagcgcgagcagcgtggcggcggctgggcagaggggcctgcccgcccgcgcgtagctcctcccccccccccccccccgccgcctgtacccaccggcggtgcgggcgtgcgtgccaagctgctcccctgccgccgcccgtatagaaaggaggagagagtaagagaggtggggaggggaggggaagaagaggctgacgtgtggggtccacgtgggtccatgctgagtcagttgccacatcggacaaaacctgagtcagaactgctcgaggacctaaagtgacccggttttgtaagatgagggatgacaaatatctggttttgttgttggaggacaattttgtaatccgatgacaagatgagggaccttcgatgtactttttccaaaacaaaatagccgtccggcccataaagcctgcaaaatgtagaacatataatggccatgattttgttttgagggaggattagaaaggacttgataagctccttctgcagttacaccgttaatattttttctgatgtcgtgcacccaactcttgtccatatacatcttgtgcagtaggttggtttttttacggaatatggtatccatggggagataagatttgtgtactttttttttaataagtagacctaattgattttcgaggtaaacccgttcaactctagtcaccctcgatctataaatagagggccaacgtgtgcatagttgtacgcacaaatcattagagagctccacaatgggatcaatgggatacaagcttctagatctatttagcgcttcatcttttgcataagaggaggcagcagttctggacgagccgtcgacgtagtcagttctataacatgctatcaacatcgatcactactgctagactgatgtcgtcgggcagctataactacatatgcttcctcgtaaccatctgacttgccactccttcgagtcgtcctgcgctgatcaatctattttaataattgttgattgccattagtaaatttagtaaattgattagattttcttgcttttcctcaagatcttgtttttcctacttaaggtgtagcactagattagtttgctactttccatctatttgcatctattgcttcatgacggaaaaaatggaagaaaaccgtgtctacaaaatgaaaaaattgattagttgccccctttggactgaacgtacccagttacgcttgggctgaatcaggcatgcatcatccctacaccccatccttgcatctcccaacgccattatctcagtcgctctttctagacctttcatccttgttggaagcacgccaggagtatgtgtaccgctgccaaaccgcccatgctctgttgggtcgccactgtaggaaacgccacctgctatcacgtacgtcgatgttgttgcaggaaaccgctgaagacgagtgggaccaaatccatgttgccattgccgcaggaccttataccaaggataggcagtaaagtaatcaccgttaatctctcaccgatgcaccttggatacatggtgggaggtcgatggagcatccgtcgccaacctttaatttgcatagggatcacggcatggctggacacggcttagtctccgttgcaggagcctcagtcgacatcgaagttgagcctacacccactgccattttgaggatgcgtggatcgtggtggaggcagctctgccgaacaacgccgatccaccgccgcgcgctgtccctgccaaccgaggagcgatgggttgctgaccagcaaccacgtcgtgcaccgcctcgatgcccactgccaccgaccgacactcggcttcttccgttgctactatacagccatgctcatcgccggcgcgctgggtgaatgggcgtctccgcgagtgctggtggggagtggggaaatcctactctctctctcaccatcttcctcggtcttttacaggagggccagttgcgttggcatgtctgttagtgcctaactgctatcgagaatgctattgcacaactagttacacgactgaatacttgtcgcgcacggagagggggcacgggtggcggcgccgcgcggtttttcttatttttctcccacagttttttctttttttctttttgcggtttttttttgccggacggtttcattttcttttttttctttccgtatacttttcagtttttttgtttttaatacatatgtatacaaactttatgtacacgtatactaactttatatacacgtatataaactttgcatatgcgtatacatactttgtatatgtgttttttatatgcatttgcatatatatatatatacaaagttggtatatttttatatatacaaactttgtatatatcgtatacaaattttgtatatgtgtgttgtcgattcgacaactgcatcacgtcgaaagacgtggttctcccaacagtggttcgaagtaaagacaattgtattgcttagtaaaaatttttcaggtctccttgttacatggccctaaggggctatttatagccctattatagactcttcctttagtattttaggttttacaggagaatttacatggttgcccgtatgatagggacatctttacgggcatacagcgtcttttgcttgcatgggctcctaatggccaagtgactcagcccagtccttggcgaagcctctagaaggcatgttagcccgctgggccttctccttgcaaggtttgatacttggcaaaacccatgcccttcgtggcaaggctttcccctcacggctttcaaccgtatgctcctccggcagggtccttctttggcgaagctggtcaactcgatgccacggcttttgccgtttggctttcaccgatgctgtctcttcgaccttcgccgcttgcctccagcccgcgcctttgcttatgtccttggtttcagtaggcccggtcgaaggttctcccggccgaaggttctcgtggtatacctccaacaatgtgtatatattggttatacataaaaatataaaaaatatatacatattaaaaagtatatatatacaaaaatatatatatgtataaacttcgtatacatatacaaatgtatatgcatgtgctgtggagaagagagactaagaggggagaaactgaccgcgggccgcgcggggagcgcgactggtcgctaatcagcctcccccaaccactatggccctcctgaacgtgacagcctatgcaattgtaaaaaatagtactacctccatctacttttgataggtatatttccatatctagaaaatttaggcatattttaatctaaccacctatccttataataactttcttggatttaatgcgtgactctctattcttccacacaagattggctatatgagtgtcgagaaatataaatattaatgaatcgcttgtttacaatgaatactagtagcatgtttaaatggatcataacaaaattacttatccttggtcattgtgccaagataaaatataactgtttacacccaaatttggcacctaggattaaaatagggaaaattatcaaagtttggaagtctgccagttttcctctgtggggacggtctgaccgccgtatgtgggccggtctgaccgccgggtgagggccggtcagtccggcggtgtgtgactggtctgaccggcagagtccgagtacgggtctgtttcgccgagtcccgaagtttccttgtttgggaaggcatgtttcgggtttcctttggattctatcccgagttggacgtggaggagggcctgtagagggcaagactaacccctatatgagggacatggccggttcaattgtaactatccaatctacaatcaatcaatcgaatcgttttacatattggttttagttttcgcttagtttgttcatctttatcgttttgcgtcgtaaatcacccgtcgccgctgcgagagtgtcacacctctttgtaggtttgtcctgaaaacctttcgttttgactacgagacgggtagttatctagaatcggcttcgctagccggtttagttatcaaaacccatcgtggtttagcttttgctaggttgcggtggttggcgactctaagatcaccgtaaggcggtaggtgttgtgatcgtgcttatcaacttgtcacaaaaaattaccaataataactctcaaaagtaaatgtagggagtaaaacataaattcctagctggcctcgagtattgaattccgtctacggtccatggatggggatccagcggaaaatgatcaaagccgaacggtgttttcgcccgattggccacgttttactaaacactttgtgtttaagtccctttcactgttcaatataatcttacgatttgaacagctcgtatataactgattgaatgtgttcgtgcacatagactataactttgctgtttagggcttatgggtctctggactagtatgtaatgatgtttttaagcatttaattgtgtttactcttgatgcaagtccaattaattaatctactacatatgatttctatgttgagctttccataaaaaaatgtgtttacctagtgtaagtgacgctctccctttgtttgggtttattttcatgcatatataatgttttttggagagcataaaaatttgataattaatgttatataaggccaataataataaaaaaaaaataaatgtaagaaaaattacggaaaaattctgataatgacatacttcctccgtttcataatgtaagtcattctaacatttttcacatttatattgatgttaatgaatctagacatattaacataaatatgaatgtgggaaatgctagaatgagttacatgcatttcccacattcatattgatgttatatgtctagattcattaacataaatatgaatgtgggaaaatgttacaatgagttacattgtgaaacggagggagtagtcaaatgtggaaaaattccgataatgacatatgacatatgtcacattgttatgtgaattggtttttgcatgttaaacagaacaatatgtgtgaaaccaattcaaaatatcaacattgaatcgaaatgagaaacttggtcagcgcgcggcgcagatgttcagagctaggaaaaagtacatatatatcagttatattgtgaacatctgcatgttaaacgcgtttttaaaattaacaccacaccacatagtatcaatccctctctactatgcagctctcttatttttctcaatgaatattacgaagttatatatgccctggatggtaaaccgttcacaaccaccggtactgtactgtgtcataaaatgcattaatttattggagttgatgttttaaaattttgaaacaactcaggtgaagcatagctagacatcttcagtgtggtcctaattaatcgaactaattaagcagaggacagagagctgttagttggtacatataaaccactcgaggaatcaagctaattaatgacaatctagcttgcttcacattaaatcgaatgagaatcttggtcagcggtgcagatgttcagagctaggaaaaagtacatactatcagttatactgtgaacaccgcaggatgaagtaaattaacgctgcagttagcatatttgttggttcaatcatgcagtctctactcgatgccctaaatattaggtgaagacgactttgagctagggcaagtccaagtcaaggtaaccatgcagtatatatagtactacagtctagttccagtggtgtatgcactatgcagagctgctagctattagaagccctcatttccacccaaaaaacaacagggatgatgcaggcgctgctaatgccaccactagtattgcgccgcacaatggtagccactttactgtgtctcaccgtagcaatggcggcatgtcttgccgctgttgcagcatcctgccagaggaagtgcggtgagatagacatccctttcccgttcggcatcgccggtcagcccggctgcgccatgaccggcttcaagctgagctgcaacgacaccgggaacggcgtgcccaccctgctcctgcggaacgtggaggtgctcggcatctcgctgccgttaggtcaggctcggatgaagatggatatgtcctacgactgctacaacacgacaaggaaggatatcgactgcgtcgatatggttgatctgaacttgaaagggagtcccttcactttctctgacactgctaacaagtttattgtctttgggtgccgtatgctcgcttatcttggcccaggtgaacaaaatgatgtaggtagcaacctaactatcggttgtgcggccacttgtggtataggcgatgatctcgtgagtatcaacagtgccgggtgctctgggataggttgttgccaaacgaacatccctaaggggatccggtattacaaggtttggttcgacggtcgtttcaacacaacggacatctacaactggactcgttgtgcttacgcagcacttgtcgagacatccagctttaatttctccacggtttacaattccctatcaaggttcaatgacaatcttggtagccagccaccttttgtggtggactgggctattggtaattccacatgtgagcaagctaaaacaaattcagattcctacatgtgcataagcagcaatagcgtctgtttgaactcgcgaaacggacccggttacatctgcaactgccaaaatggattcgaaggaaatccttacctgaacgattcgtttggttgccaaggtaaatttctcaactagaggcttttgctggctagagtattgcatttacatatcatctattagcaactagcatactttagctttaaagtacatgtatttaccaaaatattgcatctttgtctagagcgtatttacatgtcattgaggggggggggtagggtatagcggtataagtaggtatgatatcaaaattttataaaattgtgataactatttattactcaaaaaaaaaggataactcaaataggtaacataaatcatgatcctacttaaggattgtaaaaggaattatctgtctacctattgattgccagtttttaggaatttccaagtagacaaaaaaggtgtgaattaatttagcatccatttaggacggaagcaaattattatgtttcaggtaaaacaaaaggagtccatatgaggtgcaagttggtaagtattaactgctaacatcaaaactagagtttatacttcatatgagctacgacttgtcaattattatcatgaaacatatgtattattaaattaagaaaacactaatatcttagatgagaggtaatctgctattttgttccaatctgcttttagccaaatcttgagttcatggaacggacagcaagctgattatcaggttatgatctccgtaattcacactagtttaattgtctaggtttgttgtgctggcataggaaaacaaatctgaccagctagcttattccatcattttggtggatgtattcaatatctttggttgaagggctaaaggactttggtgaatgtgttaattaatgtgtgttagttataactacttgtaaacaaaatgaaataagtatcttgcggttaaaacctcgaaaatgagtaaatttgtggtggaaactattgacttaggtgaaactcgtgtaaactctcacaaaatgtgatgaggtggtgtatctaaatgtgatattgttttaaaaaaaataattagatttacatgactttttgatcgggtttaaatgagttttcaccgcatagttatccccctcccaaccaaaaaaacaaaactctagaactaccaaattcggaatggtattgaagtgtgtgctagcattttcataaatcatcatgcttttgttttattcacaagcaaca

SEQ ID NO: 67104 - DNA, 66599 bp, Oryza sativa
atccatccaaaatcccttatatctggggacggagggagtactaagatcatatctcaaaacttttatctgataactaaattcctggtttgacaaatttaatctggctaaaatacattaaagattaattcaatacataaaattcttaatttcttgctttagttttcatgtgtttctattttgtattaattgttcaattagtatatgcatgcgtggggtgcacatgaataaacattcagtgtgataccaatagtaggtgcatgactgatcaaatctatccacaattgtttaaatcttggtgctcatatcatttatgtgtttaatttcagtaggatattcgttatgttaactgatttattcctaactccgtttattgtacatttgttaattaaggactgtatttagggcatgtacaatggtctttattagcggtctctctttattgtcatgcaagcatttttggtgatgtgaaagagagaggaagaagaaaatagaaagatggttgctacgcatgacaactgcatagagtcgactcgtagcatttattagaaatttttttgttgcattgagtctgataaaggaaaagtgactagtaaaaaagtattttggtatattaatggttagagactgtattgtcttaactattataacatgataacctttaattaacgtagagaccatacctttgtattttgtgggatacgtgtgtaccgtgatatgtgtgttatgtatgtcctccatgcatgtaatcagggaaaaaaaataggtgcaggcctagttgtcatggtgcagagtgacgacacatatatggcatgcgcacttgcatgataagccatgtctatccacagtgtctggcctaacatacaaatatgaggggccaaatccaagttgcattcgaaatttccgaatgtaatttgatttgatttcaaagagataggcaaacaacaatctgttgataaccggatagtgcacaattaatgaccagaggagaagcgatgctgcgattgccaggttcaaatcgtattgattggaagacacaaatcgtgtgtgtcaaagtatccgtcgaatcgagagttattaatacctatcagaagattgagagctagttcctttttttttttgaggtacgagagctagttcctcatcaacaaccagctagaactctaatttgtagagatggatactaattaaattcattatatctactgtccaaatccatgataatggagaagtactatatacactggttgagttaaatacaacttatgctgtcagatgtcaaccatggtactatacccaaccccccaggagtagcacagtacaattagaattaatacactggtacacatacgccagctatgtgaagactttcctgactacctgtaacagtagtgtgtgtattgtggtgtgtgggggatattgtacgtcttaaactcttaattatagtagcatttttcattgaaatgtatacaggtgatcaggtcgataagtatacttgttacttatattaatgggcatatgatttttattaagcatgcatttggggttcttttggaacataggatttccaatatgcggaaaaagaaaaaaaaacataggaacagagattgtcaatgttaagcaatgtatacaagatttcaaaacatagaaacactaaaggtaatgtcttcggatggttttttttttcgcgaacacgtctttggatggcatttttggagaaaatcacgtacacgagagagagagagagagagagaggagaagagattgtggattggacttaattagcaatggggaaaaaaggtgtaagctcgagttaaaattcctatgcaatagtgggtatagaaaagcaattaatccatacaaatttttactacaatcatattgttctgaagggtgttactagtataatataggaaaaaatcctataaatttcctccatccaaagaagccataatcatcagcatcattgtttgccttttgacttaattatcacctgcaactaataattaaattttgaaactaaattttagagttgattttgatgggtttttattgtattttattttcaacattagcttttatatcactaagaatgcatagataaaaggtttattttttttcagctataggccaaacgattaaactgtatatgtagtgtttttttttttgaaaattgtatacgtagtaaagggaaattgattgacaaaccggggcttatacatccgatggatttcgctgttgggctttttattatactggtcattttagaaatgatagtgcgggccaaatcagaaataaggcctggtttagtttcccaaatttttttctcaaaaacatcacatcgaatctttggacacatgtatggagcattaaatatagattaaaaaactaattgcgcagttagggaggaaatcgagagacgaatcatttgagcctaattagtccatgattatccataagtgctacagtaacccacatgtactaataacggattaattaggctcaaaagattcgtctcgcggtttctatacgagttatgaaattagttttttttattcgtgtccgaaaatcacttccgatatccggtcaaacatctgatgtgacaccctaaaagttttttttcgtgaattaaacaggccctaagcccagcagcaaccaagaaaaaagtttgctgttccatcaagaacattggtcaaagctagtggcactgcattcaaaatcctgatcaggatctatagctaggagtagcttccccgagagtcagcactcacctgcaggcacttgttcatatcgatcaccttttaaacacttgaatgagctataattatgccatcgttagcctgggttgacttgcggcgcctatgtcaaatcaagttcaatgtgatgtgatgtgtgttctgatgagttcgtgtattgactgctcgtattttatttgtactagtacggcacctatagggaaggccagagagtgaagagagcacaaaactgcagaataattcagtacccacagtaccatgtagatagatgtagctcaaattaaacggctgcgtttagttccatccaaagtttagattttagttgaaattagagatgatgtgattgaaaagttgtgtgtgtatgacaggttgatgtaatggaattttgcaaactttggatccaaagtttggatctaaacacaaccgtagagtagttttaatgagactttcacattggttcaaaatatactctaccagtacatatttaacccatttaacttttgtaagtactccagtttgtactactagtaatatatatgttcataaaatcataagaaaaacacctggtcatcagccttatacattttaaagaatcatatgcgttcaaaaacatcaatgcatctctccactactacacagttgattaaattaattccatatctgaactaaaaacacccccaaaaactcacacaccaaaaaatcaacattaccatacatgaatccaataagtgcagacatgtacctcacttagcagtagattttaaaggtaaaactgaacatcatgaacaactacccatcgatctcgatctctcttgccccccaaattaacacatcgcctatcgatcacgaacacttctaatttcttggctcttagtaatttacatgaacaataacttaactgcaatcacatcaaacgcagtaaatactacgcgtcagctcaggaggcggcgttcacgttcctgttgctgtggccgcacccgaagctgcagttgcagttgccgttgtcgggctgcacgttcgccggcggcgcggcgagcggcgccccgaagcaggagaagctggcgcggtgcggcggcggcggcggggccaccagcgcgtcgccggcggagacggcgtggccgatgacgtagtcgccgaccgccgccggctgctggtggcgcggcggggccgggtacgtcgccgggtagctcatcgggtgcaaggcggacggcggcgccgtcgtcgtgtagaggtagtggtggtacggcggcggctgcggcggcgacagccgtggctgcaccggccggagcgggatgcacgggtcgccgccgacaccgcctccccggaagcctcctcctcccatctgcatcgtcggtggaggagcagcggcgccgcctcctcccatgttcacatccctgaaactgtagcaagaaagctttcataagaaaccctagtcgatgatgagaaaggaaggatcgggcgagacgacacaacttgcaaattaatggagatttaattcacgcttagatcgatcgatgtgatatgcatacttgagctgtgcgccgacggcggcgaggctgtcgttgccgaagacgagctgcctggcgcggttgagggtttcggtctccctctctgaaagatcaaatcccaatatcccacaagttagaggcaaagggaatgcgagattagatgcatggaagatcaaaaaattgaatctttttcttaaggatataaatggttactgttggattagaatatattagatgcgtggaagataaaaaaaacgaacttcttcatatatttgtgatcgatcaaattggttctttgataaaaaaaatatcgattatatagctaggtaggttgttgtgtgatattgccttggcggtggcgattcatgtggccacccagcgcttgagatttgcagaacttgagggagcagaacctacactcgtacaccttgccagcttcatccttccctccattactcttcttcttagtaacccctgtaaacaattagctaatcattcagttatcccattctgaagctatgtaactgtacttcctttatctaaaatgcaacaattaaggttttcttttttccatgtaatgatcgagacggttcaggagaaaattttaagtagatgaccacattcagacacacacacaaaacaaaaatctatcttttttactctacattaaagctatatatgtactagcatttgctggttatgaatgttgcagtgatatccttactggatgcttcggcgctggatgcggcggtggtcgttgagctctccaccgtttgcttgccgaactcatccggcaggttgttcaggtccagggggctcccttcttgtctccttgatgagttcatagcgaagaagaagaagaagaggaaaccatttagtacgtatatatacaacttgttgaagatacagattcacagatggatcaacaagttcctgtttgcacaatgatgagcacacaggaactcaagagcgaggtagcccaacaagatgccgatagaacacaagtagtagtgcactgtgccgacaacaagaatgaatctatgcatagtagttttatatagtactagaatgacatagtagaaaacaagctgttcatggagatccatagtaggctagatagttgtgataagtaacaggagctagtagtaaaaatgcaggtatatatgatgtatgcatagaaaagattacaggtaatatcggatttacacacacaaacagacacatccaagagtgactgtttggaaaaaaaaattgctgaaaaaacaagacaagatatgtgcacatataaacaagacacacaaagacagcagtgtttcagagggaagatgtacataacatggagatgaacaatagaagaagacacaaaaaagtcatgaggggtagttgtgcttgtaggctccttcttacatggtggagcagagagcagcagggagagaaacagctgaacactatgatgcaaatgaggcttttggaaggagaggccggaagaaaaagaaaagaggggatcgagatatatatcggatgctgtgtgtgtggggtttgagatcgacttgagacgcgttgagtagagctctcatcagctcagtgatgtgcctgactgtgtagagagaaaagagtacaagtattattgatttagtacatgacacaaaagcaaaaagacactgcagtttgggaacagcaaatgcattggggaacggctgtcttaaaagtgttggtttggggtgtagatagagtgagagaagcagtagtagagcttggtagctgggggagagagaagcctgaaagttctctatcagttcacctctgcacagccgtccctttctctctcctgtcacacattcacatacactggtacacctacgtacactactaccactactacccctctctctctctccatctgattaagagtgagagagtaagatgctgcctgtgcatatatgattcttggagtatgtgatggctgtaatccaagtgcgaggaatgcagtatttgttgcgttgttattattatctatccaaagagagatcgatcgatcgagatcgaggaggatcagagaagaggacgtatggtatggcgatgactgtatgtcaatatgtgtaggtgagtgtccacactattagctgtagggcagctgagctgagctgaaagaaagccccacagccacagcaccactactctcttaacactgcactgtagtatcactttgtaagcagcaatgcagcagcagatatgcatgctgctgagagtgagacctctcttctctcctgcatatattgaatcattaaatagagtaagctacgccctctttttctttagatcttgtgcaaagggatcaaacacacaaacatcacacatgcatgcgcacacacatctgtacccatatccatcatctagtgtaggttataggcctatgtgtgtcctttgtttgcatctttctccttcaacctgtggttgcattgtgtaggccatatgcatgcatgcattgcagagagctcttgagaagaagagagagagagagagagagagagatactagagggtaaggtaataaagacaagggcacctcttacaaagccctggttctgaatttagttgagaaagagtatgcacaagctaggggcccctataggcgcatgcatatggcttagcctttgaggtctagtaggatgcatgcatgctaggaagagctgttgtcaagtactgggagtttagggtagaggaggccagggaggatacatgggcagtaaaaagtgcctttggagggatgtgtgtatggaaaatgtgagacaccgagaccttcaccagtacaagtgataggacctgtgttggatagtgctaatgacattgacatacatggttttcatgtgagatctctctccctctccctctctctctctcccactctttctctctcacatacacagtcacacacactacaatgggttgcaacattcaagcaggtttgtagcactggcttggcctggccatgtaagcccagacaaattaatgtaggcattggtaggggatgagatatgatcaaacaagaaaacatggacaaagacaagactagggtttaccttttccttttgaaaatataaacctctcctcactagtttaccaaaaaactggtgaaaaccgacaacttaatttctgtaaatgtcgtacgaaaataagaaagaactagtcggttttgtgaaacctgctttaacattcatataaacaccggttgatttactcctagccaatcttcgatacgttccttccatgcttgggagacatataataccctaagagtaaggacaataagaaaataaaaaatatatataagcatttctgcctatgtatttaaacactggttagatacatagccagcaatgcttatattttaggatgaagggaaaatatcattaatatctaacccacctccgctcattctcttacaaaatttgttagagctcgtgctatagctaactatagattttttctcgatcccatgttgtattcgcttcctttcaagtaaaagaacaaaaatggttcctcactaaattaaggcccctagcaaaagttcacatgatctttaatttgtagaactttcagagtaattaggagtagttaaatttcagcatgaatatataatcgggcaaaatctcacatccacaacatactccaatttgtgttgagttgaagagaatggaggccctatacttactcgagggagcaaattaaagatgaaaaaccttttcaggcatatgcttaaatttgtcaaagattatttcatgtttaatgtgaaatggtatatatgtgtatggacaactgatcattttccatttggatcttccatcagttggatgctagctgatgtacctggcctactatatgtcttttttttagataatggaatataacatactggcttttgctcaaagagctatagccaattattataatctcacacttaaaataaatgaagttcaaagaaacttaaaagatgaaaccaaccatcaagaagaaacaacctaaaaactgccaacccaagataaagagtacacaattactatatgtcttttaaaaggataattttgacattcttaagaaggtaccagaaggtatcatttttttttaaaaaaaaatagtacctccaaatactatatatgtatctcgaggtactaaaatttttagtgcaaaatttacctcgagatattttctcaagaaacgtaaaatttctccttttaaaaacatgtgtatatgttttctaaaatatgtgtgacactgtactaagataactaacagaggcagtatatattcaaggatgttgggtcctaaaagcatgcatatatcaggactcaggttgaagtgtgtgtccctagctagacgatatgcatgcatgggtcacatattcatgttatgcttgctaaaagccacccatcgaatcttggttaacaatacacatatatatgggtgaatagctaatttagtccctcaagtctcatcgaaggctcaatttgatccttcaggtttcgttttgtccacataggtcctctaaatatttgttttggcttaaactcatccttttacccacttaatatgttatatggctatttctagttaacatttctattagaaaatgtcccttttgcccttaatttgtaacaactatataatagaaaagagaaaaccaagatgaataaacaatgttgcatatgtaattcccattctttcaacatgtgcacatgaaacttaacctaatggctatcgtatacacttgcaagtacataatttattttcgttgtacataacttactatgcattatctataaaaaaaattcattgcatgcaattttttctcttatataagtgtatgatggggtataagtgtcatttatcgagagagttgttggttatgtttagccatgtggcttttaagtgggttcaaggataagtttgaactaaaattaaaacttgaagtactaatatggacaaattgacacattaaggactaaactaagcctcagatgaaacttggaggaccactttggctattcaccccatatatatcattcaaacgatacataaatcgacttgttgtaattgtgcacaactaactaacatttgaccaaattaattaaggggatgtaactcaagttagagccaggagatggatgcatatagaggagcaggcatggatggcagggcaagaggacagaaagaaaggacagggagaggaggagtagtgaaagatttgcacagtgggcagcagggcaggcaggcaggccaggtttgcagctctcaggggtcgtcgtcgtctctctcatctcatgtgagggaggccagaggtagaagacaacaagcaggagcctcctgatcgatagagatacctctagtgttgcattgcattggcgcccccctggccctgcatactcctgccatttcatgcagcattagctacacagatatatacactgctactgccactgcatgcacctctctcgctggctgcctcttgctgcagctagctgcatgccattgccatgcccttttaatttctttctttctctctttctcatcgatccatcgatcacctgtatgaatgccgtgcataatgcatcgatctgatgatgtgtgggggtgtcactggcatctgcatctgcattgccaaagtttttatatatatattcagagaactgatagatcgatctcctgggccccgtatacgcgcgtctccctcaccatgatccaagtatccaaccctctcgatctatcgctttatgcatcgtgtgtgtatatgtatgtatgatcgatcttgatcggaccacaaactaaactatagcatgcatagcagctgatagctgcagtcatctgcagcagggcaacgatgcaaaaagctcatgtgcatctcgatcatatggtcaatcagtacgcatgcatatgcaattatggtgtgtatgaatgcatgcataaccgagtgaaaaaaacaagtcaatgctcaccgttaagttgatcatatcaactgcattcaaaaacttgaaaaacgtgtgtctctcacatgtaacgaacgcgtatagacgttatagtcgaatgatacatatataaacgatgttcttgattcgtgcatggatatatacaagaacttaacatcgtgtgtcttctttatattgcattcatttatgttaatttgtaattcttatgctattatgtgaaacccgatgttagtattgatatataatctaaacttatggtgatatttttttcgttcttctgttgaaatttgtgcccataataatatacctgctatctatgattctaccagcttgctatttgctatttattaccttggttaatgggttaatacaatgagaccaattttcctcacttagggcaaaatcttcatcagcaaccttataaactaatattcctcagtgctaagtgctataaggttgtctgtgattctttgttatgtgttgtgattctttatactacgtgtgtgtgtatatatgcacttgttttcctggtgatgctaaccgaataggacttggtataattcaaaccaagtcctattcggcccaaaaggatatggccagcggttctatttttttccttggaaacagacgggagtttgtttctttttttaaaatcgaaaagattcgtttttttcgcccttttttttaccgcgtcgacggaatcggatttaattttttttaccgtgtcacattttttttaccatgtcgcatataatcggattcgattttttccgctcttttttcatgaacggacgacggaaacacttctaatttcttagtagagattatccggctagctgcctaaatccgaaaaaaaaacaaaactagttaaagtagctatagttggatcatcaaaatccgaactcgatcgtgtcaatattggttaatcgacacatcaataaacaagttttattatgcaagtatacctcataaatgtagtcgtcggcggcaaagaactaaaaaaagaaacactaaaagatcttagggatggaagacctacatgagtaaaacgaaagataggttcccttctccctcatcgttgtcatgagatgataatgtgtttgttggtactctgaccttagatgaatagatgagataacatgataattcattaagggtatgtatagtgtggcttgtgtaagctcttttagtgaaagctctgctgatattatgtagtttcaatgtaacttttaaccaattggaactataattgcatacaagctagttttagaattacattgttgttgttcacctcctcggaggcttcgccttagggttttgctcttcccgcggccttctgcggttcgtaatcttttttgcctcaggctttctgtgtcttttgtgtaaggtttttgccggtttcactttagcaaaccgtgcagttgtatggtttttgggcccgttccttataaacagggtcaactctatcattctaatatattcggcaatactcttgccgcttccacttaaaaaaaagaattacattcaactcagaaatggaggtgctcatatttggactaattaatttcacattagtttgtgccttttgatctggcaaccaatatttataattagatttaagtgcgagggtaccggaggacgtaagtagggagtaccggcgtcccttagagacactgtatatctctgtgatctgtccaaactatatatacatggggcttgcaatatctttgtgcaaaaaaacaacactacctcaaaaagcaaattaacgtacccctgccaatcagtggtcctcaatcataggctagctgaacacctacttcttacacatctgatcatcttaagtgtcaagcacatacactagtactagcactgctagctttgtaagaggtgtcccttgtcctcatgcagcactagctagcaagcaaagtcattcttgctatacccaaacccaacccaagctagggatgagatgagagggcttcactgactcaagcttgtcaaaaaggacggcgttcattctcaaaatgtcaacccacaggcctctcccattcattgacatcaatcttcatacatagtactatcatagtaaaatgatgtatatgtatatatatgtgtagtttacaaacgaggtaataaatagcttttgtagcggtcattataacgatagtggatttttacactggagtatatagcaacctctattgcaaccactacaagtagcacaacaaatatagcattttagaacttaatggccgttattgctcttaacgaccattattggctttgttgggctattattacacttaaacaatgttcttcacatatggataggagaaacttgaaagacaaagaacagctatagagggggggggtgaatatagcaattcaaatcttgcccccgaaaatactcatcaagccggatttctcaaaatccttactagaaccgcggctattagagaagccggatctagaaaagaagagagcaaaagaagagagaaggaattcccgaaactagaggaggaagagaaaaggaattcccgaaactagaagagaggtgaggaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaagcatacaccttcagaggaacattaacacaaacttaaaatctctcagacaaacacactccaaactaatcctaatacaaaagcctctcgggcaaacacactccaaactcacaccgaaactctctcaccgagcatctcaaaaggattgccaaaggagcaacatccacccttgcatccatctctctatttataggctaagacccctaagacattgtctcaaatacccctagggcgaaaccctaactcagaatggatctggtccacccattcttccttagaaccgaaggaagcctcctggatgcttgccacgtcgttgatccaaactctccacgccgcactgatccgcgtgctccctctccaaaccagtgacgagccgccacgtcacgcctcagcacgcgagagcgcgcgctccaccgcgtggatcccacgctcacctgcgcgcatccagtccaaagcctccacgtgtcccgccgagctgctcccacgcatgctcgcgaaatcgcgcgtgggtcccagtacaactcccgcctccgagccacttgaaacagcgtggaccccacgcccgcacgcgccgaattccttgccgccgcgtgtccactgcgcgcgcgtgcctcgcgcgatctcccgcgcttgcccgcgcatggtgccaatgccgtgggccgtcgtcttgtcttgggcctgctcggcctggcctccctgcctgctgatccatccatcatcttgagccatgaggaagggctggattggcttggcctccctgccaaccaatcacagctcacatgcacccatgggctagcaagctcctcatgcacacatgcatgtcttgcgcccgtgcatgacattcggccatgtgcacgcatgcacaaccgaagcaccactgtccatgcttgcatatgcacatgccagtgcatgtatacaagctcctcttccattctccattctgttcgcgaacccggcacttgcacttgaccttgcgaagtccgttgcgaagaccctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccggtacttgtcaatttcccatcacaaaagaactataaccacacatggtttcacaatctcccccttgatgggaacattgacaatcccaagcaaaaattttgaaaatttgatttttgattcacaaagcaaaccattttgcaaacgtcgaactttggtcattttgaaatcgcgaaaaatcaagaccaagtgaagtgacaagaagaaaagggatgcgaatgcaaatgcaagaatgctccccctatgtgccaaactccccctttcaccaagatctaaagcaagttttttaattttcaataagtgcaaatttctctccccctttgtcaatgatgccatcaagatcaaaagagacaaaaatgcaagataaaaatgagatgaaacttacaaattttagtgttttgagagctttgagagttatctaaaggcatcaaaaggtagacatggatcacacagatacaagcatgtgctcaagcctagctaagcatgtgcataagaagtatgaaacaggtcatggatatcaagttagtatcgccagcaagcaaaaagttttcaagtgaattagtgatttagtgtgcaaagctatttctagaagaagcttaaaaggaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatttttaagattgttttttaatttctttaaagacaatagcacaatcacgacggtccacctgatcttatcagtcagcaagtgatggttgtgccaaacactgccgtctgacctcaatcaagtgttccagctagagttcccattacaggctgtctcagtgctatcttcggcactactcatgcgtaaacgcactcagtagcccggacaaaaacagagataaagcttgtaaagcatgattgatacaaagtatggacgcataagcatgagcattcataagcatgtactgacagttattgcaaaaagaatgtaaacatggcatgagtatgagagggatacttcaatttaaacaaacttctagagcaagcattgcacattgattaagttcaaatgaatagtcaatttaagcaggtttcaacaagcttgaacagcataacatgatcacacaagctacttaagcaaatgaaagctagacaagagatcaaactagcaaaagagtgatacatgcatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacatgcactagcagcagctacgtactcagcctcagctgttgattgagcaacagaagactgcttacgagaggaccaagagaccaaagacgtgccaagaaaatgacaagtgccagaagtacttttgcgatcaatcttacacccagcaaaatcagcatctgaaaaagctcgaactgaaagggcagaagagcaggagtaccaaataccgtactcaagtgtagacttgatgtagcgaaagatgcgcttgactgcttggcgatgtgatgttcttggagaagcctgaaacctcgcgcacaggcacacggagaagtggatgtccggccttgacgcagtcaagtagaggagggagccgatcatgcttctgtactcgcgctggtcaacttcttcaccgtcctcatcaggaccaagcgatgaagtagttgccatgggagtggcgattggcttgcagtcggccatgtcgaacttcttcaggagctctttggagtacttggtctgatgtacaaagattccttccttggtttgcttaatttgaagtccaaggaagaaagtcagctctcccatcatgctcatttcgaattccctgctcatcacatcagaaaactgggcaacaagtgcatgagaggagccaccaaatatgatgtcatcaacatatatctggacaagaagaaaatcaatgccactatgaagagtaaagagagttttatcaactgcccccatttcaaaaccattttgaagcaaaaaggttttcaatctttcataccaggctctgggagcttgttttaaaccataaagagctttatcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaggtttcttcaaaatccaagccctcaacttgggtgaaaccctgtgcaaccagtctggctttgtttcgaacaattgaaccatcttcacctagtttgtttttgaaaacccattttgttccaatcacattaaaacccaagggtggttctaccaaagaccaaactttgtttctttcaaaattttctaactcttcatgcatggcattaacccaattctcatcagataaagcatgacaaacatttttgggctcaaaagaggcaacaaacgctgaattgacaagatcataagaccgatttctagttaccctttcacccaggcctccgatcatcgagtcaggcggatgtcggttctggatgtgtcggggagctgtcggtcctgatgtgccaccatcaatctcctcagctgctgaagatgatgtagttggtgcatctcctgaaggtgatgtagtcgaaggagaaccggtttcttgcactggtggtgtactgtctagaggtggaggaatggaatcatcgtcatcatcatctgaatcctcatccacaaagatgctttcatctagaacacctgaaatttctggtctagctcctgggctagcctcatcaaaagtgacttcacaagtctccacaattttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagcagaaatagcttcagtccagaactttcttggagtcgtaaactcatcaagcatagttcgtgccatctccacaagggtgcggttcttcctctcaaccaccccattctgttgtgggacatatggcgaagaaaactggtgttcgactccagaagaatcacagaaagattcaaatgcagaatttttgaattcagagccattatcactgcgaatggctcgaagagcaccaggaaactccaaagccaaactacgagcaagagactgaaagaagccaaacgtttcctcctttgattcaagaaaatagacccaagagtagcgagagaaatcatccacaacaaccaagacataccacttccccccaactgactggacccgagcaggaccaaccgtattcatgtgaagcagttgtcccggtccatctgtcataaccattgtaacaggcttgtgggaggaagatgtcattttcccatgacgacatggtgcacacacaagatctttcggagctttcaacttaggcaaaccccgaatcaaatccataccactaatgcgagacaagtggtcaaagccaatatgaccaagacgtcgatgccagaaaaacaaatccctattctctgaggcaacgagacaacgagaaggaccgggagcagaagagtcgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaatttgtcattgaccttgattgttcctttagccatcacgcgtccactgctcgcatccccaaaagtgatggtctcatcaccggatgcacgagtgagagaagtaaaccacttggcttcaccggtcatgtggcgtgagcaaccggagtccacaagccaagaattacttctccccactccaaaatcctcaggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatcattcttcccctttcgcccttgtccctcgggcttcttggtcgtcttgtcactcttcttcttcaacttgggacaattcactcttatgtggttaggctctccacactcaaaacacacaaatggttcattggtttttcctctctttttatttctcacatttttgtaagctcttgagaattttctagcaaaaagagcaagatcatcttcagggatcttctctaattgctcctcagtgactgagtgtaaagcggcaagagagaagccaccacacacaaaagctgagtcattagaagaagtactaccagagggatcagctaccaaagccatggagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatgacgagcattatcattatcagaaaactcttttccaacagatcttaacttcgaaacaatttctccaaaacgcttgaaataagaatcaatggactctcctgggtgcatctcaaatctttgatattctttatgaaattgattctgacgaaccaattgaatatcattgtttccctcatggaaattgcacagagcagtccacatgtcatgagcagacttgtggtgttgaacacgattaaattcaccagaagaaattccaccaatgattgcatttcttgcacgataattaaaatcaacctgagccatatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgataccaattgaaagacaaagaacagctatagaggggggggtgaatatagcaattcaaatcttgcccccgaaaatactcatcaagccggatttctcaaaatccttactagaaccgcggctattagagaagccggatctagaaaagaagagagcaaaagaagagagaaggaattcccgaaactagaggaggaagagaaaaggaattcccgaaactagaagagaggtgaggaagagagagcaaaactcatcatcgcaaagttcaaattgcaagcggaatttaaatggacaaggcaaaaatgaaatccttcaaatcatttcatttataggtgatgcaaaataaccgctcaactaggagcaagcatacaccttcagaggaacattaacacaaacttaaaatctctcagacaaacacactccaaactaatcctaatacaaaagcctctcgggcaaacacactccaaactcacaccgaaactctctcaccgagcatctcaaaaggattgccaaaggagcaacatccacccttgcatccatctctctatttataggctaagacccctaagacattgtctcaaatacccctagggcgaaaccctaactcagaatggatctggtccacccattcttccttagaaccgaaggaagcctcctggatgcttgccacgtcgttgatccaaactctccacgccgcactgatccgcgtgctccctctccaaaccagtgacgagctgccacgtcacgcctcagcacgcgagagcgcgcgctccaccgcgtggatcccacgctcacctgcgcgcatccagtccaaagcctccacgcgtcccgccgagctgctcccacgcatgctcgcgaaatcgcgcgtgggtcccagtacaactcccgcctccgagccacttgaaacagcgtggaccccacgcccgcacgcgccgaattccttgccgccgcgtgtccactgcgcgcgcgtgcctcgcgcgatctcccgcgcttgcccgcgcatggtgccaatgccgtgggccgtcgtcttgtcttgggcctgctcggcctggcctccctgcctgctgatccatccatcatcttgagccatgaggaagggctggattggcttggcctccctgccaaccaatcacagctcacatgcacccatgggctagcaagctcctcatgcacacatgcatgtcttgcgcccgtgcatgacattcggccatgtgcacgcatgcacaaccgaagcaccactgtccatgcttgcatatgcacatgccagtgcatgtatacaagctcctcttccattctccattctgttcgcgaacccggcacttgcacttgaccttgcgaagtccgttgcgaagacctcctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccggtacttgtcaatttcccatcacaaaagaactataaccacacatggtttcacaaaactaaggtcgtgttgagtctgaactatcgcaaaagctcgatttacctccctctagatacttaaataccggaagttcatgactcttcaacttttcaaaccaaacaagtcaccccaataacccaatccaaagtggttttagttctatgtggcatatacattgtctgcctcggagcacactttgtgacaacggcatgacatggtagctgtcaagaagagcgaaggaggtccctacatcttctccatggtgccaacggagaggagtgcaggcggcaacatagtcgacgctaagaggggacattgaagtacgtggtctccttctagatctgaccgatgacggtcctcattgggtgtgcagctaacctccctccatcgtcactgagccaagcaccacattcccctcgaggacaatgatgagctcgaacattgtcttgcctcacctcctatctccctctgctctcccaccctccttgttgccaccaaaacccactcccctccttgctcggtcttgtgggccctgggccctgcttccctcattcctaacgatggtggcgatggttcctcgatgcgcggtcaagagaactggggcaacaacggttctccttgttggtgttgaggtagtggtcgtgtcctcttgcttggatcaagatttggttagagggaggggggaggaagaagaagatagtgataagactgacatgtggggtcttatatactttttaaaatatatcgatggccttttcattggttggacagccgcatagcaaaactatcgccatatgtaggattaaaaccactttagattgggctaaggggaactttgtccagttttgataagttgaagggtgtaaaatgtctggtattggtgttgagggtgtaaatcaaacttttgcgacacttgaaggggcatgtaggacttaccccttatatcttattgatgttattttataattcttatgctatgaaatgtatctaaactttatgtgaaacttgatgttactattgataaataacctatatttattttttttataacttagcatctgtaattgcactcgctatccacaattcgttacctatacactactccctccgtcccataatataagagatttaggagggatgtagcgcatctagtactacgaatctagacagatagtgcatcctagtactacgaatctgggcaggctcatgtctagattcttagtactaggatgcatcacatcccttcaaaatctactccttatattatggaacggagggattagtccaatgtcagcccactatttgctatttaattattactaggagtactttgtttacaaggttaatatatatatgcaatgtggattgattgatcttaagcaattttagagatataagatgaaaactaatcttcctatcctatcataataactttggggctcgcaagaaaaagttgttgccttagcttattagcagcacccgtatcgagataggtcactaatgcgtgtttaattaagaattccgtagttttaggatgtgtcgtcccatccatctaagatcctttatattttgtgacggatggactacctatcataaacataaaatctagatttgttttatttttaaagaaacttttatatagtgattttttttaaaaaaaaacatttaacaatttagaaagtcctcacgataaaatagaaagtagccaagcgaatcccagatcagcctataaccatatatactttaacaaataaaataagtattccctatacatatatgtcatttagtgattattctaagctagttttgggctagagttcaccaaagttacaccacacttacacaccggctgagaataatcacaaaatgatctggtgccaaaggttgatgttcttttttccttcttgcaaggaaaataaactctataaccctccatatatatatggctgaactagtaccaatcatctcgaccaacagcagcagcattgcgctgtcgtcctcctacatctacggtggatcaatgccccagtacctaccactactgtcttctttattttctttgagaagaacttcacttcacctctagtggatggatggtgcaattaaatgatgctaatcaaacacccgtagctatagctagtaaatgcaaaaaacagttatccaccatgaaaaaaggctctcatcttctgtctcctgaagaagaaaaggaagaagacgaagatggaatcgatcgaattcacaccaaaattggaagtttgattgaaattggaataatgtgatggaaaagttagaaatttatgtgtgtaggaaagttttgatgtgatagaaaagttgaaagttggaagaaaaattttgtaaatcgaccaaatgtcaaaccaaggtctctgatgcctggctgctactccatcagttgactttgcaacgggtagccggccggtaagccatggcagtagctaagataggaggcggcagcaaagcaaagtcactgcaaaaaatgctttgatcggtgtgcatgtccactgcaaaaatgctttccaatttaggcgccacataaactggtagcctttcgccgtcctaggctctgcatggtccgtgcctttcatgtccagggacaccaacgcctgaaaatgtggattgcagtaataatggaggaaaagataggacggcaatgtactactccctcattgtaacgtttgaccatttgttttattcaattttttttgtaaatataaaaaacgaaaagttgtgcttaaagtattgtagataataaaataagtcacaaataaaataaataataatttcaaaaaaaattgaataagacgagtggtcaaacgttgcaagcaaaaactcaaaatcccttatattatgggacggagggagtatactattgcaggacattaaccatcaggcataaaccaaccacaagaaacatgtagtacattcatttgattaggaatttgtgattggagtatatctcttctcttctctcctgtccagttcttcagaatacattgcaggttggatgcaagaacacaaggatttcaggattcacctaaattgtctgtatgtattgatgtgtacatatatatagattatagagtaagttacatggactgattggtctttcagcactacaaaatatactgcactgagtcttgagtttgtggtttgcttgctgtgtatctacttacatggtaacatatctgcactatgctatattcaatgaaattggcacactctgtgccggttcgttcaaaaacatatctgcactagagtatagttctatgtaaataattcaggtctttgccaatgaatacaactgtgaaggctattctttgttcctgtgtattggttgttaactagtagggcatccttgccggaccagaggatgttctgacgatttcagaaccaagctcttgtattttacgcaacaaagccgctttctcccgctcaagctgctgtatgtacatgtcttgctcatcctggatgctttcaatctctgtcaaggccagtgacatggcctctgtgtcgccaccctcatcaactaaacctgtgaatttcttcaggctatctctcatctgttgaaaaaaaacacatgatgttcatcacaaaattgtcatgcataccaaagaggatactgagaggaatgtggcaatattgttatgcagagacatcgttcaaacaaaccaacgaagcctctcacctgcgatgatatcttgtgccctttgccaagggaagatgcatcagtctgaaagcttgttttcttctccaagtgtggtacttttcgcgtgatctttacatggacttctccgctttttactccttggagtggtatccattttacggcgggctgatttggaggaagcatgctgtattcgacagtgcattggcctatactagcagttggaaggactgcattatggtccttgacatgtaaaatcaggggttctcctgtttctggaaactcaaatgtctggttccaatctggagagagtgttttgtaaacaacctgcatggaatgagttactcagaatttctgatcaaatggattgttttttatagggtgattcatagtatctgtagaacagaatgaccatatataattctccagtctccaattagcgccaaaaaaggttttgttttttccttttataataacatactaaaactaacgagctattgctctataggtttcctctagtatgtgaggaggtaccacattttcaagagttaattcgtagcacctcgtagaggacctttgaaaagcccattttcctattgaagttcttatgttattctaaaccaagcacggactgctacaggctgaaagatttggactaatctgaattgatcatatgcacaccatctgaagatgccaagtgctgtactgtgtcagcatatttgttcatttctattacttcaaaacgccaacaaattcacatttcgcatgtcagaaaagcaatgcatgctgcatttcctaataaaggcatagtaaataactaaatacagaaaggttcaccaccaaaccttagttcgcttcttcttgctcccataatgcaccctgacataaggatcactagtgcctctgagatcagcagcaataagatccctagcttcaattatcactagctcaatccaggtagcttcaactctaccacttgaagtctgcttaagaagaacaatacagaatccagagaaacatcagtagacaaaatggtacaacagagcaaacggtataaaactaatgtttggtacagaatcaaggatatagaacatgttgctggaggtttcatgtgtagaaaaatagttgtactcaacatcccaaatttaaaatttttactgcgcatcctcttaagaaaaaatgtttctgacgctgatttcgcaaatgtatatatttttctgaattaagaatcctcgcaatattaaaattcaatgcttaaggaaggcaaataccttcaggataccgttgaaatcactctttattggctctatttgaagcctgatctctcctgaatccaccttttcaagtggaacccatacttcacggctatcaccatctaaaagtccttctagatttactcttgcgctgccaatgctttcgtctccaaatgtatctgcactatagcatttgatcttgagatattcaccaccagtgatctcatcaaactcgaatttatcattccaaaccggtcgagttgtatgagatagtgtttttgttttgtatagagcctataaaaagaatatgggattagaataccaacttgtataatagtaagtgaagctaaactttgggcaaggtaacaacaaacctttccatactgcactttcacatatggatcacactttccagatttaccgttaactgcaagggctttaccctcaactactgcaactctgagtttccgtcctgttctggactgaagcttgggcgatacatcaaatgaagagtgggatccgttgctcagagaattgctcaacgtaactgagccatcagagaattgccattcttttagcacaagagtgacagttaactgcaagggaaagagtttggaacagtattacacaactatccagaccaaataaactagaaaaggagaaatggcacagttaaccagttcgcagttgaataggtaggtgaaaaatgggcacattattgttggaaccttcatgaatgtcacggtagaaatgataaaaggaagttctccactaaaattgttaacttgggaacagaaacatcataattcatcatcaaaaccccacatttctggtcactctatcagtagtctatcctttatgtattatatctccagagctctcaagcccaactgaatgaaaccattgttacttccacaggttgtttctaaaaaaaaagggctgaacattttcctgatcctctctcttccgatcttgattccaaaagcgctaccaattcaacaggtcgaacttactcttttgtaatttataaaacaacccaactgtaaataaagttcaacagaaaatcaaatgtaggactatgggtcattagaactttaggctatacaagtagctgaggacctgaggtcctaaactcctaaaatctgttacttcacagtttgtatcgagtatatcaaatatggcataatttcaaacctgataggctagtgaaaatttgcttcggtggcttgataaaactaattagcacttcaatcaattgggaatccatttttctaaatgttacagcatatccaaaacaggttttggatgcaagagaaacagtgacaacacatcagtagttactatagagatgtacctcgcccctgatgtcctcaaatggaacaaccattccaacttcttgtccacaaagctcagtacgttttgcaacagcaccagaattatgtcctatagcccaaaatattgttgaatcatctagaacatacttgacctgtttacattactttcatcagcatcctttagatgtgttggaagaaccacaactgcatcatgtgcaatggaaactgactaaaataataagtttaactgtcatacctttatctcgcagcttgtcaagtaggtgaccttaacaccaccagagtccaattcatacagattgaacttgacaacacctgtctctccatgcaataccaggttaaatgtgctattccatgcagggtttggacccttgcttgtacttgtttttctcactaaactaccaacttctacctcaataaatgtctgtgataccttgttatcagcaattccagatgtagaacctccacttgagctttggcggatccctatttcattagttgtgtttctcccaacgttactagctgaaacaactgtgactgaaagaacacctccaactgctcgtttccttaaatctactggtggcaaagaaaaacacaatctgcgaggctcaaccattgtcttcactatggtttcggtcaaaagcttaacctgcatggctcatgaagcatcacatttagcattcaaatttcaatacgcaatggccgtaattgcactaaaagaattgcaaagataccaaggactaactaaatggcacacacaaacccaccagccatgttgagacaccgggtagctccataccaggaactgcttggcttccaccacttccaaatgccactcctatcctgacttctggagtggattcaaaagaataaagaatagcttcaccatcaaggatgggtaacagtagaagctgcaaagatatagtttaaatcgaagaaaataagagcttaatctgatgagccaactagaaaatgcgcttagacaagaaaataatcgtcaaatacagatataatactcaggacaagaaagcaaataaaagattttaacgtaagtggtgatccaagttcttatccacacaaaatttattgtgtttcaacaaaacgctaaagtgaaatagctcaaaataaggttgccactttatcctatgtgagaggcaggttaactacatcataatatcctatgtcaaccattaaggacaggaatgactccgaaaagccaaaaccatttttgttcatcatgattgttcattatcagctttgcgatctcagtgagcaaagctggcgacaattcttgcttaccaattcaaaagaagtctctctcaaatcaagataaatgagaaataacaataacaataacaataacaatgtaacagaatcaattgaaagagcaaaggacatacatctcccttgatgtgaatgctgtttataacaattcgagcagcgccaatcagtggttttgctaattttgccaaaaacattacactcatctcattgctgtcccaatcaaaacccaagcgcatgactttctgcatgttcaaaaaacgagagttgaagtgtgcaactgtacaaccaacagaagtatttcatctgcctctcctacttacaacataatattgttcaagatggaacaactaatgactaaggctatgcaggatcaggaagagctgcagaacatgttatatattcctaacagataatggaagaacacatgggttagttacagataatggaagaacacatgggttagttatacagatgcatagttataatcagaaaaggtgaataaaccattgatgacactgcattcgttagtgttttcaatgatgtaaggataagttaaccaaactagtacccaaaacagcacaactcggaatttatgaagcagagcaaataagctaaatcaccgctgttataattctgtagaactaaaaacagcataagcagttctttcaataatgatcagtgcctgaggcaatgatttcctccctctctaagtttaccacaggtgagtatcccatacacagtacagaatattaatatctgacctggtcacctgaagtcatccagcgcatcccatgctcccccaaggtaggtggacaacaaccaagtgagaattcctgtaactctattttatcctggagagatataaaagcaaatcattagtactacagtcagaatagcagcaggagaggataaacaactttaagagaacttactattagttttggttttcgatgctttaaacgtttctgcaaattcagagaacactcactggtcagctggttataaaaaaagcagaatagaagccagtgtgcaccatatcttgcaatgcatattgactatttgactacaacaaataaataggagcaatggagctgagaaaaaaaaatggccaggccggcagcgaagaagtgccccagccaattttattaagattggagaaggttaaaacaattgggcaacaaacatggttgttgttttacaacaagctgagaaattttctaatgaattttattttgagataatcatcaccaaagaaactcaaaaggtatatttccaaaagcttttaaaaccaataattattacatccaagcaaaaactattagacgtaatagaaactttcacaaatgatagcaccttcattttctagcatcctagtgctcaaaagattcataaaattatctagcaaatgtgcagaagctgacctcaacagtagattgaaacttctttgacagttttggttccatataattgggccaaacttctaccaaaagtttgttcaaccactcgcaaggctctattggcgtcgtaggctacaagagatacaaaaggggtattgctaaaagttcatgtataaagagcaaaacaaaaaaaaataagtgaaggaatatactgttgtattcagtataagatgcttccatcgtttgttcaaatcttctatggctgacctccttttaaacctcccatactgcattcatcattaaaataaaaatagtaagaagacaaaataaactctagaaagtggggcgaggtgtttctctgtgttattcttttcagaattatgaacactctgcaactcaaaagaatagatcagcacttccaaaccaagcaacaagcaatacttgcagtaaattagtactatctcaacacctagaaaaggactatttgtctgacaattcagcaggacatcaaagaagccaagccaaattcatcaaagaacaactttatccatatgaataccatgggaaggaaaaactacctgaattgttgcccatacagcagccaacaggggaacccagtttgagaatggcacaacccatcgttcaacaaaccatgcaaacaagacaagagggaccaggaaggggagcaagggctgctccaccatgacctggttgaaaaattctagtgcatccttggcatgcaatttcttcagcttcttcttcgccatctctcctccctgctgctctgtgaattcagcaaagctctcttctctgataaccacacagagcttgatgcagataccttttgttgttttttttggcctttgtttccactgcttcccgagttcctgtcactggccccttttgcactgtgggtattggatacctgtccacctacaattttggttccaattaatggccacagcaagatagacacctaagataaagcatgtatgattgcgacctattgctcccagacttgcgagatatttcaccacttctagaatggaacaatgaagagaaaacctccaaatttttcattctttcaggcagcgtgttctattagcacgaataaacaagaaattgacccaattgatggccctaacaaagtcaacagctggattataccactaagattcgttctagttctggaccacataaacgagagagagagagaagtccaagccgcagaaccattacagtgtgcgtacacatctggccaagaaattcttgtgaaaacaaccaagcagcataggagccaccaaagcctgaaacgtcacattcgaacaggaaaaaaacacatccatgttcttgacaacccaaatgctaacctccatgaaacccaaatagatcccctgtaaactgtaaaaaaaaatccgctaaaaaatctgcaatttaacactgactgacgtgtacccagcgagtagaataaactgcatgctccaatccaacccagtcaagaagaactcctcacccgtcgagtcgccaacgctatggccaggtccctgcacccatggagattgattcgcgcagagacaccgtgaggccaagcagacaggagatcgagaggagcagagaaggagagtcgcgaaggctaaccggaggcggagaaggcgaggtggctccactccacgcacgcaatagggaggagttgaaaaaactgcagctttcccccttcagagttgctacgaattccacgaactgcttccaagatgcctcctttccgatccaatccgccgcaaccgcatccggcgaaatcaccagccttccccgccggcgactgttcttccccgcctcctccaagaggggaagttggcagaggtcaaactttgcaagtttggaatgattctataaactccaagaaccaagaaccagggtgggacaaaggggggaaattttattttttgtgagttgaggggggctctgatttgttggaactggaagcgattgggcggcagaatcaagtagtagtggatttcagtgtgctgggacaggagggaacgaacgcgtcaaaatcgggctcgtgcgtgttcgtcaatcgtcagcggcgcagcgctcttctgtgccacgctggctctcattggtttgtactcctactccgtagtaccttggaatgcgactgatttttttgatcgatctcttgtttgtttctttgggttaattggaaccatgccattacaacttcagctatttggaaatatgccattacaattagcaaaaccggctgggtgccatcgcaatttcttccaaattggaaccatgccattatatacgtctgaattgccatccatgccatttgtcctcgcacgtatttccgtatggacgcttgtgcccctggctgagacgatacaagccaaccatcccggtccggctcaaccatctctgttccccattccctattccccattgtctgcaaaccctagctcgccgacggcgatctcgacggcgatcggtgcagcgccggcgacgacgacgggggctagggatacggcgccggcgacgacgacgggggctagggatacggcggcggctttaccgatagcttctcccggcgtagacggatcaacgcggcaacgagtttggaggcgagctataccagtggcagtggtcgctctgcaatttcgagaaggtgcagagtcccatcggtggctccttcaatcccagagctgaaatgtgcttgtgggcatgccgctgcggtgcagacatcgaacacaccaaggaatccaaggcggcggtggctgcagtgtcctggggaggtgagaatccagtcctacttgtgcatatttgtgtgtgattttctttctgaatccaatctggtttccttcttgtagaattgtagatgtgccttgtggatttgggaagatctcaacgaatacgttgaggagatggtcgcttactgtcatgctgacgagtacgactatcttagagagacatgcgacagtttgcgccagtttatagcagatcaaagacatgcatatctctcagttgtcagcctaggctgaggcaaaagagttgcagttgcaagccaattacgaagctttgaatcagtccaagttggggtgtgcagacttaaagaagaaattggagtgcgagaaggcttggactcgcacaattgtgtccatgatgatcttgttctatgtgttgttagttgctgtaatgataaggcaggtttaggagatgttctgtgtgatgtctggtgtgtgaaatattgtgatgtaccttaggtgtgtgaaatctggtgtgtgtatttatgtttgtgcaagttggggaatgcaatgcaagggctatattttggaatctggtgcaaataatctgctgcctaacatagaagctgtttatgtgcaatggtgactgaaataaatttgctgacataaatgacataaacttactgacataaatgacataacttgctcacataactgacataaacttgttcagaagtgtagcaactgacataacttgttcaggagtgtagcatagaccaacatgcagcacacaaaagacagaacatttcaggtttggagcccattaccatggccaatatctaacaagtccaaatggccatctacaagcagcaaaataaacaagtttgggtttttacatcacagaccaacctagtctgataattttctaactactctagcgggtggagcagtagaagcaacaagattcttcctcttctggggagttttcttcttcttaggagtatttttcttcttgacaggtgcagatgaacttgcttcagctgcagctccaggcactcctttcttcttaggagggtttttcttcttgactggtgcagcttcggcctgacctgcagcttcagccacttgtctcttcctgcacacagatagtaccattagggaagttttgaggtagtcaatttgtggactaaatagaaagaagtccaaattacctttttttggttgttggctggattgtttgctcatcttgatgaactggctcagcaagtttgcatatcttttcaaagtgaccaaaaccctgacatctcttgcatgtaactctcttcctgccaggttgttctaaacaatctcttattctttgcactctaggtcttccagcacctctcttctacctaggtgggtataccttgaagccaagatctacatgtggccactgagacctatcagtcattgttgccactctagctgcataagctgctctaaaggtctgaacactatagtagggactgacaaaatcttggattcgacctctgttagtgcaaatccaggccaatgcatgtttgcatggctttcaacttgccataccctacatgagcagttttggttctgtaaatcaactgtgtgccttctagtgttgttgtcagactcaacaagtgtcacttctgcgaaaccttcatcgcttctaacaacctttaccaccctgagacagacagttgcatcattcaattctttcattacatttggcaggatgccatccacaagctttttaccaacttctctcctgagggccatcttctccatgatcatctccctgatcccatccacaagttcatgcaacaacagacctttaagcttcttgatctggttattgaaactttcagaaacattgtttgtgaggtagtcacacttgctagactcagaaaagccacatctgtaccaaatccttgagtgatgcttctcaagatactctattgcatcagacctcacttggtatatttgttgcatgtaccacctaaatccatcctcagtataacttcttgcagttggatacaggtgatcagtgaaggcaggaccttgaaacttcttcatgaagttagcatagagatgcctcatgcattctctgtgctcaactttttcaaatgcagcatcaacagctttttccaaacccttacaagcatctgttgatataactaggccctctggattatctatggccttattgaggtgtctcatgaaccataaccaattttcatcagtttcagagtcaaaaattgaataggatacatagaacaaccaattatgtccatctacactagtggcagcagctagttgaccagtatatttacctgtcaatcttgttgaatcaacaccaacatagggcctgcagccattgaggaagccatctatgcaaggcttcagaacaacaaacatcctcttgaagcacattttcttccctatcttctgtacatcaatctctacaatagaccctggggacttcctctccatctcagatttccaattaaaaagaaattggaagctctcttcatatttaccatgtatatgttacaatgcacacttgaacccagaccatgccttcgaatacttcaactttatctgaaaatcttcttcaagcttgtgccttgcatcactagctcccttttttgggtttttcttgacccaatccccaatcctgtctgcaacccaaccttgagttgccatcttgttttcttgcaatttggtagatgcacatgtgtgctcaaagggaagaactttgatctgcattaaacatgtataattaacaaaattgcattacacaaacataatcaaaagcctaatcaaaataaataaatgaagcaaaccatagcacctgtatgactttggtcccaggtagctttgatgcatgaacacgccaaggacacccttcagcagcacaatgggctagaaaacgtgttggatctgtcttcaaaccagcaaacacaaaaccttttttaactgcatagtgccttattgcttttctgaaagcaattatatcaggaaataatgcatctttctctatttttggattctcagggtcacgtatgacattaaagacctatggatcttcatcagtaacctactcctcaggagctctcacccctgcaacaggaggctgagaagactgaccagtgccagtgtttccatcgggttcagcaaactgtggaggctttttaggttgtgagggaacatacaaatgctcatcatcgacacccacatattcttcctcattgtcaaatatgtctggttctctaacaggttcttcctctattgcaggcttttcaacaccttcaacattgggagcgggctgttcagaaccaatgatgggagcagagttgtcaggaggcacaacacatatgggttctacttcattctcgacaagggtggataaaggctcagatgtaccatccatcttattgtcaagcactgaaacaataagattgaattggctctctgttttgtacatttcgaataggtcaggtagctgactattgtccacaagtctaacatcctcaccaatcgccttgtgcaaaaaccagattgaaggagattgatttgttccccaggtgaactcaacacttaaagtattcatcagaaattccatggaaaagctatctgaatccacaacccaatgccgagtagctcctttcgtgtaagatttcctaccatctgtttctatcatgacataagctccaaccctaacctctactgaaaaccagtgcctaccatgaaaggagagaacatcaactgaaaatctacatgtaaatacgatgaaatacccaatgcacttctacatcagctatccaaggagtatattcgagttcaagttactcacggtatcgaggaaataggaggaatcgagcctcccagatccatcccctccatcggcaatttcgctgcgcacgatgatgtcgcaggtgaacttgcgatcttcaggggaacttctacatcgtgggtcgtcgtcgccggcgccgtatccatagcccccgttgtcgtcgccggcgctgcaacgattgccgtcgagatcgccgtcggcgagctagggttttgcagacaatggggaatggggaatggggaacagagatggttgagccggaccaggggggcctcgcccagcgcctctcagagatgaccggggccctcgagcgactccccgaggagctcgaggagacgatcaagtcatcctcgagggacctcgcccggggggcggtggagctcgtactggcaagctaccaggccagggaccctgacttctccccgtgggcagcgctggaagagttccctcccgggaccgaggacggcgcgcgcgcgaaggtccgggacgccaccgaccatatcgtccacagcttcgagggtacggcccctcggctcgcgttcgcgctcgacttcgatgaggagggcagtgacgacggtgcggacgacagcgacgacgaggccgacgtcccgggcgcgtcggagtgagcccccaggcccccgccaatcttaataacttttgcttcttcttccgaggccttcgggcccccttcttgtatagactgatttaatctgtaatcaaataaagaggaaatttctgcgtcagctctgcttgttgtgtgtatgagacgaggatggtctgtgccgcggtccttctttgtcttggcttgaacaagggctcgtgcccaggtcccagcctcaaacggcgcgggtcggggctagtgcctggggagatccacgtgtcgagactggccaggccgggagcgcggtgaccaagggttatggatgacccgattgtgggcctttgccgattcccccccgaagttcaccacgccccggggcacggctcggttctgggccccgtttggcgattttagctggcccgggccgccgagggcaaggtcgagcacgagcgtgctaattcaagccaagattcttcaaaaggaaaacgatggcacagacacagtcctcaagaaatcgaaaatgcttttattgaaatacggaagagaaaaaaggtaagtatatgcatgtggtagcccccggccaactctgcacgcccggggggtgcggggttggcccgagcccgagacatgatacccgacccccactaggggtagaagcgacgaaggtgctcgatgttccacgggttaggcagctctgtgccgtcgcccgtggcgagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggatctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttggggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggccttgccatccgaggtgcgtgaggcggagtgggctccgcactcgccttcatggacatcggcgagaaactcgacgccttgttcccgaggaatgcacttcaggaggactccgttagccgcacgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcggatcccgaggcctggactccgacgggcctcgggggccgttcaggcgcgtccgtctcccctagggggtcgggtcgcgccgacggctgggcgagcctttcttcaaaggcgcccggtggggtctgggctcgcgaggaagcgagccttgagagttcgtcggcgaccgcgttatcccgtctgggcacgtgccgaagttctatcccgtcgaagtggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactcagccatattgttggtcgcccgaaagtcaaggcggaccaggtatctgaggacgtctccgctcggcgaggtcaacatgacccccgcaccggcgccctgaagagacagggagccgtcgaactgcatcaccaagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatttcaccacccgtccagtaccctctcggttatgcaagatttggccgagggggtaagacgtgaccaccgtgacccgatgcgcctggaaataatggcgcaacttcctcgaagccatcagaatagcgtaaagcatcttctaggcctgagggtatcgggtcttggcgtcccggagggcctcactaacgaagtagacgggccgctgcacctttcggcggggccgatcctcttcgccaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggcctcgggccgccgttcggctcgggggcctctcctgcctgctctctcccgggtcgagtcgacgcagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgagggcccgctcagcctcctccgtccaggtaaacggcccggagcatttgaggagcttaaataggggcagtgccttctctcccagcctcgatatgaaccgacttagggcggccatgcagccggtgacgcactgcacatccctaagcttgctggggggggcgcatccgctctatagctcgtatcttctcggggttggcctcgatgcctcgggcagagaccaagaacccgagaagcttgcccgcaggcacgccgaacacgcacttattggggttcagctttatgcgggcggagcggagactttcgaaagtttccgctagatctgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagtttctatgggggtaatgaatgcagttttttcctcatcctccctagccatgcgaatctgatgataaccagagtatgcatctagaaaacacaaaaggtcgcaccccgcagtggagtcgacaatctgatctatgcgtggcagggggtaagggtccttaggacgtgccttgttaaggtcggtgtagtcgatgcacatccgaagcttgccgttcgccttgggaacgacgaccgggttcgccagccactccggatggatgacctcacggatgaatccggcctccagaagtcgcgccacctcctcacggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctccttgaccggaacctcgtcgcacgtgaccatccgctgccttggggcggccgggacggaggtggtgagcctctcgtcgccacccgcgggcttggacgccgcggcgaggtggtccgcgcgctgctccatacaagcaagcgcgactttgaggtcgccatggacggtgatggggccaccggggcccggcatcttcatctggagatatgcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgttgatgtcctcggcggtggccttctgcttggcctcacctcgccggttgccggcgggagccgccggggtcttgccctcacggcgctcctgcctcttctcctcctcccacttcctcgtccgctcagccaagcttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccacgaagcgccctcgacggcgaggacatgaccctcgtcgtcggaacgggccggccccttcttcctcctcctgttccgccgctctgaccgagtggcggacccgggggcggccggagctgtcacaccagagccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacaaaaccgctgaatgtacgagcgaagagactcatcgtcccttcgctgtaccgcatgcaagtccgcttcttcacctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcgcccccggcggcctcgatcccggtcgtgtagatctggagaaactcggcggggttgacgcttccgtcgtatttttcggtgacggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccattgcgtgggcggcgtgacgagcgtcgcgccggcgctcgatatcgaggcgggcatccggccccccacgcatatctccttgggtcggaggcgtcgacgagggaatggcggacgaacggcgggtaacggccgccgctcgccgcgccctccgcctcgacgacgtggagccggcggcgggagcgccagaggtctcggtggcggaggaccgcccgccggcgcctaggcgctgctgcgccgtcatgaccaagtcggccacatcatccagccaacgccgagctggagtctctggatcggggacgacgggcgggtgacgcaggagcgcgcccgcagcctggagcgcaccctggggcgtgccgccattgccgtagacgaggcggcgacgcgccccgtctcgccgtcctcccccgtcgcccgcgggcggcgaagtcgcggatcctccggcctccccgagcgcctccccccgcccaagatttcggcgagagggggacggtggggtgcgagcccgacggcgcgggttctgctccccgtcgtcaccgctagcgttcggagagaggctgtgcgcccctgcccgttcggccattgggctgagcgggagaagcttggcgcacacgaaagaggacgagggcttagaaagacacgcgcgccccctacctggcgcgccagatgacggagcgtggggctcctcaccgggagactacgcaggcccccctttgccggttcggccgggggcgctaagtgaggttcttcgccctcgatctgaggaacgtcagcgagagaagaaatgcgcaagacacgggcgacgtagacaggttcgggccgctgagaagcgtaacaccctactcctgtgttctggtggatctgtgtgtgaaggaatccagagactcgagagcgagagagagagttcaggttctagccaacattcgccagagtcccaactcccctttcgtcctcccttttttttaggcctgggcctcctttttatctggtcaggggtcaccacatgggcctctagctacctaagaaaggaaacatgcttttacaatgagggctagtctacagccggaagtgacctctgacaagccgagcgcacgtctcttgctccgctcgcccctcttccggtggacgcccatttcaaccttcatttaatggccagcgacttccttgtcatacttgcgctgaagcctggaatgaatctgaccgggactgacatacccactcctggagttggcacgccggctccggctagggacgagagctaggaagatctcatcattccgacgggacggggcgaggcgtgtggcaggccgcctgttgccacctaacccgcgatctgaccggtctgtgaccggtcactcaccgcgatcggtcacggaccgaataagcgtgcgctgcgccgcattaaatgcggcgtggcgcgctcgtccaacctgctataaatgcggttaggtgagcccgctgtgctcacctaacccacacacgtggcgccaaaaccacagggggtcggggcaccccagccctcggggccgaaacgggagcggcccgacccctcggggagacagagggaggggtggccacgtcaccttcgggcccgactcccccgagggggtcaggccacgtgggtgaccgcggctacccaggcctctagtcacgatacccccggccccatgtcaccgacacggtccttaattgaccggggacggtactagccttttccagataccacccaaatcctctgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaataaaacaatttcgcaattgggatcaacatgttcaaggaatagtgatgacttgccttgctcaggatagtccttattcttgatataattcttgatcaaccttcacctcctggaagttgctgacgttgcctcacgactaaccgatacataaattctataacacgcaagaaaaaccaatattcaaataacaaccaaatatgcacaacaaaatatactattcatgtcttctaatggattccaatcacgctaggggctaaggtttcttaatctttctattgtcaacgtggcctatttaggagttaaccaacatagcatttataggatacatatatatttggctaatcggtggtttagtctatcaaatggctatggaaggattatggctaagcatgcatctatctacataggacggttatttactagaggttctgttgttagatggatttaggatcaatcaaataattacagtgaatcatttgtattatttattttattgatggaagctttactttaattatgaacatattttacttgtcacaataaattataaaaggttaataattatccatgctttgtatgttagagttgtttaggttaatcatattatggttacagattatcccatcacataattttacaatgaataatcctaatttacagttgaactataattataattatatgaggtcaagatttataactagtatttatctaatatacatgtttgtcatacactccctcttaatttaatatatgcaacacgcaaattaatactataccgtaccactataatgggatgtatagtatatgtgtaagcaacaatatcttattattggatcatatatttgagtagttgctttttactgtaagctatacaatacatgttgattttaagatggctctgtttggttaactaatggatatcaaccgactatatacatatattctacttcacatgacattgtatcgacaaatttttaagtggtccaaatacaactagctctatgattactctcctaaacaagttaaagattcatctatgtgtgtttatattttagttacaaaatatgaggctaaactttatgtaaacaatttataagtcatggatttagttatatttggacatagaccagtaaatagcactaatattttcctatacacccattaatttgaaggattgattataactaatttatttagttgctacagtgacaagacatgttaaagataattatgctactgtacaatatccatttttattcattggcacactatttaggttaactattatctaatcatttgatattaattaatttataattataaatatattttgttaaatactgaattatatatcattggaaagcttatgaatttagatgaatttaggttcaagtttcactcaaatccaagttaaaatgaataagttatgctagtgtaaagattcaaatttgaattaatccgagaaattgcgaaaagctactgttcataaatgatttatttttaatccaagacatatccacagccttgtaccaactgacaagtgggaccccgggtttatttctttttcctaccgaattattttctaaagggaaataggaagagctaatgacaagtggggcccacatgtcatagactcgagaccataaaacttctataattagatttttaaccacccggacctacatgtaatagacactactaataaagattaagaagggggttactattcaccaattacgtggggcccactctaatctctcctctccttcctctctctttcttcttttatctctttctctccctcccggcttcttctccctcctctctccctcggctctctggcgacggcgaccgagcaaggggaggaggcggcggcttactgacggcggcggcggcgacggcggcgcaaggcggcgacgcacggcgcggcggcttcgaggcgacggcgcggcggcacgaaggcggcggcgcggtggagagaaagggggaaagaaaggaggggaaggagggggggtgatgtgggatggaagggcgaccggaggggatttatagggcgcgggggaggggcggccggctccatggcgatgcgacggcgcgcggcgcgtggggcgcgaggcgcgaggcgtgacggcgacgggcgcgcggctcgggacggctcggggctcggcgggcggtgatggcgacgggcgacgcgacggcgacgggcgacgcgacggcgacggcggagcgtcgacgggacggcgacgctgcgatgggacggcgcggcgcggcgcggggcttggcgcgcggcgatggcggcacgacggcgacgggcgacgcgatagtgacggggcgtgacgcgcggaggggtggggctcgaggcgatgcgaccggagacggcgacggcgcgcggcacgacgagacgcgagggggcgcggcagtggcgcgcgcggcagcggcgaagtgacggcgcgcggcggctcgaggcgcgaggcgcgcgcgggaggggagatgggacgggcgcgcggcggggcaggggcgcggggcacgaggcgacgacgtgacgacgacgacgatggcgcgcggggctcaaggcggtgatggcgacggcgcggtggcgacggcgacggctcgacggcgacggcgatggcgcgcggcagcggcgcgggcgacgacgatggcgacacgagcggcatcgggcaggagaaggaggaggggtaggacggctaggaactaaatcgaacacctagggggctaatgaacagtgctagccggctatttaaccctattttagcctattcctatataaattttattctataaatcctaatttttacacaaatgaagtttactcaatatttgtgttattctaaccaatggattcaccctagattaatattacccatatttatttatttatcgcacaaatgaattctttttagattaatttgagttattggccctaaggtgaacttatatatttttgaagactttggggtactattaaatttaatataacgacttgtcatgattaatacattagcagattggtcaagtttagttgtatagcaatatattttacacggataggttcaatctatttattctataaatagtaaattgagactcggcacaatattaatctaattgtttaattaaaacctcacaaaattttataaagcttaatttaattatatgaccattatttcatgtgaattggtttacctttatatatatagaccattagagtttagtaatatcccattaattactcctagtgaaactatgttatagatagagttccattataaatggtcatcatttcatgtgtatttagacgtcatggcacgcaacacatggttcacgtatttagtatttaatccataatttaaattagtaattaaccttccgtttgtctggctttgttttcttgtgcgtaattatttgtagggttaacaatattatattctcgtaaatttatctattacttaaattttagatccttactttactttctttgtgatcatttacggtttggcaagcaatagcaatcataacaaccagcatgatgtaaaagttttaaaaagttcaaaattttagtgatttttattgtcttgaattttcaggatgttacaagtctcttccaaggagttctggtgctggccgcgtgaaggaagtggctcctcgatggcttggctgatgtccattgttatatgtcagagctgcttttcgctttggcgactttcgtgtcttcagtgtcgctgcagttgtgaagtcggcgctgctgggtcgcttgggcggatagctcggcaatgataacacctcttctacgatgtgggagttgttatgtcgcttttgtgtttagcttggcggtgacatcctgcttttgggctccgccgtcgttgttagttgtgtagcggtgggtttcagccggttttactataattaaccgtgtaattgtgtggttttcaggcccggttttccttataaactgggtcaattctcttcttctaaatataaaagtggaacaaagttccgccttaggtttcaaaaaaaaaaacactctgtagaatctaaccaaactaagaccctgtatagtttcaaaaatatcacatcgaatctttagacacatgcatagagtattaaatatagataaattaaaaaaactaattgcacagttaggggggaaatcacgagacgaatcttttgagcctaattagtccataattagccataagtgctacaataacccacatgtgctaatggtggattaattaggcttaggctcaaaagattcgtctcgtggtttccaggcaaactatgaaattagttttttcattcgtgtccgaaaacctcttccgagggtcaaacgtccgacgtgacacccaaaaattttcttttcgcgaactaaacaggttctaagtgtcacattttagtttaaaatacttatattttgggattgtccatattcataatcctatgaagcgttccatcctatgaagagagtactacttttgtgttctttttcctgataattctttaacgaaattttgaccatctctctgggtttttcttccccatggtgtaaacggtaaacaggtttaccgtctggaattcatattgtgagacgcacatggtagaaaagcatgtacagcatggttcgaacaaagaaaaactaggaagttttttatttttttaaacctaaggtggaactttgtttcactgttatatttagaagaaaagaattgactgtcgaaactaggaagttttagcttaggaaaatctcttttgcaaacttagagctatggactgtcgaaataattacatttaagaaagtaaacaaattcctaacttactgtcaggcaatcaccttttacccaaagcaaattctcaattatcataattcaccgcacctgaatttgatgcttgtgtcatcatatcacagttgttccctctccctacctttcaccatcagagttttcggtgccaaaagagacacaacacatcgtcttgattcttgatttagagtattcgctatactcatggcgattaaggttttggtgcatgtggtgttttgttagcggtagtctaattgatgtatgggtggaattaaagtgcagcaagtgtcataaagtgtatatatggtaagtgatacgcgagacaaattatacaacatgccaacaatttggtaacatactaatttattattgagtgataaaaattaattaccttggggctataaaaattaattaccttggggctatttaaaagtgcttgctacaacgttttgaactacaactacacagcacggactctcgacgcaacatttgaatgtacatcgtataaccgctacggcattcatttaatgagctttgatgcacgtttcataacaactcgctggctgcaagcctgtaaccgtgttggctggctgctacaacagctatatccaacactttcaaacaaccccaaaatatgtgcagaagcatgccaccaaacaaaaaaaaacccataaacacatcctattattgccgtgaaaaaacaaaatagcctaaggacagaaattgtgttaagcagctgaaaatcatcatgagttgaggatgatccgcttggttaagtttttgaacagatccgtatgtttatagtggattatctaagtgattataaatataaaaaatatatatattggtaaataagcttgacaaagagctttgaagaaggcatctaaaaaatagaagtaaattctttttttaaggtattcttagcaagtaatccgcagaaaagtgccatgttagttttaagcccacatgataggagtattttttaaagccgaaaccaaatctgtttttgtccaatccaggtacccaaatggtcctttctctgtactgatggagcatcgaagtttcgttgctgcggaacagaaacaaaactgctgataagactttgttatcctcttccagaaaaaaaaaagaacgaaaaacgagcatgtcaatgttgacgttggccttttctttcagattttttcgtcgaaacaaaaaaggcgtcctgtgcttgctggagcagcacatggacggacagacttccatagcgtccttgacacttcttctgtcagtgatggagatggttcatggagaatcagaatactgttactggttggttggttagttggttgcctaataaattcgcaatgtcctcctcggcccaactctcattcggcccaacaaagtcgttacgttgaaatgggcctatctgaccagtcgagagtgatgggccttgatccaattctgagatggcccaacacatttgcacacgtggactggtggtctctgcagagagaggcagagtagtaggtgcggtccgtggatgatgtcattgcatttgcagctgccctttctgatcttatctgaccatgatgcgtcatatccatccgcaaagctaaaaaagaaaatctgacaaatcaactttattctaataaattaattttgtgtgatatggaaatatctgtcccttgataatatcatgtggacaatttaggtagatcataagtataccagtactacatatatagtataaatcaatacactatgataaggtgggataagatcaaagtgctattgatcacatggaaattttatgttgcgttgtgtatttgtgccaagattaaaaaggtaaactcgtggaacttatcaaagacgaatatgcaaaaatgtatacatctattgtgtcatttatgatttttatcgttgatatgatcattctcattatgtctatctatatcttcgaagtacaacaggattgaaatagagctactccacataacaatatcagaatttaataagaagtcagggacaactacaacattgaaaaaaggaaaaaaaaacagtggagaaccctcgttatgagataaaggtggcacaatgtgctatttataagtaaaaatgtatatcaagtacaattgtacttatatcataacattgcgtagagaactctgttagctatacatgaaggaataactcttttcaacattaccatttattaataataaataatcaacaaacacacacgacgtattgtaaaattggacaaatcaatattgctataggaaagtgaggcatgccaactactatgacacatcacagtaggtcaacatcatctctctcatctctagtagtactaatagacttccaacaacttccacctatatattaatgataggtaatttgacattcaaccatatgttcacatatcgcttcatgtatttaccactagttaaaaaaaatccatataccgtttatcgcaatattaacgtacgatattttttttttcatgccatgtaattcacgtcagaatcatacatttcacccgcccataattaaaaatgcttagtattttataaggggtaagaacgaggagaaaactagtaatgccacgcatcgtattatccaatctgagataccataacttatatccacatttatatttacgctattcgttaccaaaaaaataaaaccctagcttttttattaacatgtgagaaggtaaaccggtgaaacctaacaatatgtccgacagacaaaaatgtgctcatagtgccatatatacacaacaatattatcccatccatttacaagtatactcacatccacatcatcatggtctaacagaatccatccagaggtatctcacctgaataaaaaaggagcagcagcaaaaaaaaaaagtgagaaaaaaataatccaacaagaactcggggaagaagattacattacatcggaaaaggagaaaaaaaagagagagagaagagcccgaaacaaacgtgacaccaaagtgggtagtagacacagaggtggcgcaggcagcacacagaaaaccagcgagattttacacacgcctcgccctcgcgttcgcgtcgacgggaataaaatcccccgcgtctcctcttctcctcgcgcaactcgctcatctcatcgctctcgcctcgactcgcctccacgaagcccacctcgactcgccatggccatggacgacctcgccggctcatcctcctcctcctccgcgatggacgccgtggtcgccgacccctcgcacgggtggcagaaggtcacctaccccaagcgccaccgcaagcagggggcggcggcgctgccctccgcggctgctcccgatctggggttcctgcccaacggcggcggcaaggtcaacgtgttcgaggccgtcgacaggaacgccgagaagcgccaccgcgcgctcctggccgccagggacgcggccgaccccgacgccgcgcggatcgccgccgccacggcctccgcgtactctgacgacgacgacgactccgacgaggcgcaggcgactcgccccgagggggaggtgaagaagcccaaggtgaagaagccgaagaagcccaaggtgacggtcgccgaggcggccgctctgatcgacgccgagaacctcgcggcgcatctcgtgcagatctcggtaatacccgtcctgtttcgctgaattcctcttcggaaatcgtcagatctcgacttgtttggactggatcatatttttgtctttttgttaaggatcggatctgatgagggtttagtgctggatcgttcgggttttttcaaaattccgacaaaatgttgggtgtctactagttttcgattaagatggaggaaaattctggtcgtaccagaaagttgggatctccttgatgtaaaaacacgggatcttgggatcttggaaagcatgggggttttggtgcaactattagatcttttaacgtgtcatagctcttttctgttttgttccgtagattctaaccctctgttctgtgtgcaggaatcttacgagaaccagcaggatattcagctcatgcggttcgccgactactttggcaggtcatttgcaagcgtgagcgccgcccagttcccctgggcgaagatgttcaaggaatcactagtgtccaagatggttgatgtgagttactagagttgccctaactcttttacgcatagagatattgcatttggaccagatataaaaaggcaattgcagtttatagggtgattcacttgcatcacatatgaaatgttactgcggtttatctgattgttaagttcttatgatctttttcttgtatctacttacaaattttacgaaaattaatggttgtgcatgaacattgatactgattcatgcatcgtcatcattgagttgtgaaatgctaatgctgcttttggtaactgccagtaatattattcgaattatttgcagacttgacgtcgctgtaaacgtgcttgtcaagtatgctagttttaaggatggttatgctatttctgctcaccctgtggatgcattatcaattaaaacaaattatttccgaacacgattattcatgtataacaggatacagctggataagttcaatgcaattactgcaacaacttgagtttacatttaacggtttacctgaaatccgcattgtccaaaaatctttctgtatttgtgacatggtattgtgttcagttccttccattttccgctctgaaagggggaggcgtggaggcaagttaatttggaaggtggggggttggtgcggattgtagtatgaggagtaaatgggtgtatcagggtacacattaattggattagcatggaatttcttagcctctaataaatcggaagcgattgcttgataaatatgcaatatgtttcattccagaaaagaaacgacacatactcgtgcaattaataattcagtgtattaatggattctagtacttctgttttgattttataagcatgaaaatgtccctttatttccgtgtctctctatttttagatttgcatctaactagttaatatattgtgcagattcccttgtgccatattcctgaaccagttcgcaacacagcgagtgactggatcaatcagagatctcctgatgccctgggagactttgtcatgtggtgcatagacagcatcatgtctgaactgtcaggtcaagcagtaggcgctaagggttcaaagaaggccgcacagcaaactccaagggcccaggtagtccttgttcgatcacgacttaactctcactatacaagcctctgcatggtatcatggacttgtgatgtaaagcagcataaaaatgctctacaagatggaaatagcatgcgttttatatttgcgatatgtcctatattgtattcacatcaactgagcctagcgctaatgctgtcatctaatgaagcaacaaccttgcaatgagaaaaaaaaatgtaggctttgcaattgaaatattatatgaacaatttgctcacatcctgcattgctggaagcttgtgcttgtcaataccatttactttagatagatgtgaatgtttctgattgtgtaattcaattagtttagccttttctcattgcttttaacacttcctcacaagaagtaagataataagcagattcgattcgattcgatcatttgtattagtttattactccgatctatggatcaccacgattgctaaaaagtttatataaattctaagaagaactgcattttgatgacagaatattcaagtcctactttatgtaaggtgttcatgaaggagattaaacttttttttttctgttttagggccctgaagattgcatggtggtagatatgataaaacctaaaatgctgatctaataatctgactgccataattcacacttgcttatcggacctgtgattgtaattatggatggttctatcttgttttcaagttggtttatagtttttaaatgactattgctctgttcaggttgcaatatttgttgtgcttgccttgactgtaagaaggaaaccagaggtactaacaaacgtcctgccaaaaataatgggaaacaataagtatcttgggcaggaaaagcttccaatcattgtttgggttattgctcaggtatattttccctgctgtgctcttacttgttctgaatggtgctaattattttcagtgctccatactatcattttatattttcttaaaaaatatctcttgcgtgatgtatcataggcatctcaaggtgacctagtgactggaatgttttgttgggctcatttcctgtttcccacactgtgtgctaagccaagtgggaatccccagacgagagatttagttctgcagttgctcgaaaggtatggctcaacttaaacctgattaagaatctagagccgtttttctgttttctgatatatatcagaagtatttatatgcataatcttttttgatatttcacgtgcagaattttgtctgcccccaaagctcgaggcatcttactgaatggtgctgttagaaagggggaacgcctgattccccctgttacatttgatctgttcatgagagctgcatttcctgtttccagcgctcgtgtaaaggtttgttcttaattcttccttcctgtttgctgaaattttgatatgcgatgatgttctgacttctggtcatcatatggaactctttaggctacagagaggtttgaagcagcctacccaacaatcaaggagttggcccttgctggtcctcctggctcaaaaaccgtgaaacaagcagcacagcagcttttgccattgtgtgtgaaagcaatgcaagaaagtgagctgtcatcctttttcaccctaacttctctttctatatagagcttgttacctttgttttgcaactctgagttgttgcattattgcacattatgttcagataacgcagacctcaccggggagtctgctggtgtattcatttggtgcctgactcaaaatgcagagtcctacaagctgtgggtgagtaatctttgtctgtctgcctttataacaccaagtgagaatgttgcaactgaagttttcttaattctgatttgcaggaaagacttcatcctgaaaatgttgaagccagtgttgtagtccttagcactatagtcacaaaatggagcgagctgtctcataagctcagtgctgaatctcttaaggtgactctgaagaacttaaggactaaggtatgatatgtccctgttgcattacttgttttgtttgactgtttatgatgtttgtttcattcttatgtatatgcaatgtgatgctatcctttgcatagtagtaaaattctgtatgactagtgaattctgattcatgacaaaaagagagcttcttgatagcacaattagtttgggataaatggcgttacctcctttttttttttgataaaatggaaatcaaggtgccacaactcttaaggacatgcaaaagcaagtaaacttgtttgacaccaccacctttagctgttcacataccccctaggtatttgtactccgtagtaatatgtgcaattggttgcaattgcagaatgaggcggccctagaagcagcaacggactctggaaagcaggcatctatcaaggccgcggacaagtattccaaggagatccttggaaggttgagccgcggcggagcctgcctgaagggcagcctgctggttatcacgcttgctgttgccgcaggctttgtgctatctcctaacctggagatcccatccgactgggacaagctccaggccatggtggcgtctcacctgtcgttctagaagtatatttgtccagcagttgataaaagcttatacagagaatccaaaggagatgaagtgaagattctaggagtgaatgaagaaggctaataagaagggatagatcctagaaaagaatacagttacctttttcgcatcttttcccaagcccgtagttggggggagatgcaagcaactttgcagagatagagagttaaaaagttttaatcgggttagactgatcggtcagaagaaggaaaggttgggccaaatggttcggcctgaggactaacaccacctttgctctatctcgtttttctgcatctgcagcatctcagatgatgagaaacatttttgcttcttttgtttttcctttttcttctgaatcttgtttgcttttaccaacatgccatgtgtgatattattgctgaatcatctgtacttgttggtgttgatgatatcatatcctgctatgttgtggtgtaccaatcatcctatacttgttggttatgatgttggatgggtgtaccaatcattcctaaaggagtgtgaagtgttttactctgtggttgcaagtggtgaaagtgaggaagccgtgtgagtgacgtgtcgacgcagcggcggccggtgacggagacggatcgagggcaggaggaggagatcgccggcaaagtgagggcggcggcacatggcacatggcacatggccgcgggccagcctgtctctgtacgctctcattccttcgtaccaaggccagttgactcgggcgcgaccgaagcagcacgatctctcttcttgctttgttggtgatcaataacgtggacactggtcggtggtggcgaccacgcgtcgacggccaacctcgaccgtggcgggccccggccgccgtccaccacccgggccgaccatgggaaggcaacaacagctactacacctacaccagtgagagtggtggccggagcggcgccacagcaacagctaggacctactagtacaaagggtgagccagccactggtaatggcctcttcccctcctccgcctccccgctgctcctgctcgcttcctgccctgcaatggcggctctcctcctcctctcctccgccgctcgggtacgtagccggtaacacatgactcagtcaatcttggcacttgcggagttgcggtagcttcagttcttgatttgctgctgcaggttggcgtggctgcgccactggcgctgaggcagcagcgcccggtggtgctgcccggtggccagctccgcacgggaagcggcgccggcgcagcgtcggcgtgggcggcgcgccctctccggccggagctcgccgcggtctcccgccccgccgtccccgcccgcggcagggcgcctctgttccggcctcgcgcatgtaacgcctctgcggccccattcaattctagctctaccacaactgattggtgtaggactgactgacgaatttcgccatggatttggttgtgaggagcagggatggcgtcgtctcagattgccagctccgccttcacctggggcaccatcgccgtcctccctttctacactctcatggtcgtcgcccccaacgccgacgtcgtaagaattcctcaatcctccaacccacacacacacaatcgaattgctctcacttgctcctctaatctttctctgtgctggcgcagaccaagcgtgccgtggatagcagcgcgccgtacgtcgccctcggcatcctctacgcctacctgctctacctatcctggactcccgacaccctacgcgccatgttcgccagcaagtactggctccccgaggtcagtcaatcaatcagtgacaccactctgcactccatgatcactagcattctctcaacctttctcttctcctgcgcagttgacggggatcgtcaggatgttcgccagcgagatgaccgtcgcctccgcctggatccacctcctagccgtcgacctcttcgccgcaaggtgagcaaattcttgattcatgtgtgtagtagtgtacctatggatgatggttgtatgtgttgcaagcgtgaggaggttgttaaaatggcttgagttttgggatcacaatgcaggcaggtgtaccatgacggcatcaagaacaacatagagaccaggcattcggtttctctgtgcctgctcttctgcccaattgggatcgcgactcacgttctgactaaggtactggcgggttcaattggtcgctcacattgatcgattgtatgtaggttcatattgcttagatggtgtatttttatgtgattcatatatgaataaaatttattcaattaactatgtgttacatcgagttcaatgtgattcttgtttttccccacgtattgaatcgatttggcagctgaacatccctataccggtttagcgtactctactttctcagtagctaatgaagaaaagtgcaattgacaatatgatcagagataagcgacaactcttaaatgtttgcaaataaagaaatgagatgattagagggaaatgaatcgatttgaaacacacttattcaagtggtacactgttcaaacatagaggaattacaacaattacatttatgaatgctatactaggcttatgtgtttcttgtcacagactactttcaattgtacatgaatgacagcatttacagttttgaatgctgtactaggcctatgtgcttcttacaaataaatgtgctttccaataagcaattacaacaattacatttttgaattctatactataggtatgtgtgctttttataaaatatgtgcacaaccactaattagagtggcagcaacaaataacatttctcctgaatatttctggtgatcataacccttactgaacttgtaatggtatgacattaccatctggtttatcctcaccaaatatccggttcagtatcaacgccaatctgatgccggcctgtgctagcctcttctccacgattgggtaccgagagtagaaatagtcatctgtattccaggatgcagaatttgccaattattattgccctaagcccaaaatgacttcttgtactagttttagtcacaaccactgtgatataaagaagtatactcacctcctagagtaatgtcttgctcaacatctttgtaggcataattgcaggacagatgtatgctctcaattgcatagctgcatgacattgagttaaacaatgcatgtcaatttctctttaaaaatgtactagacaggtggaagtgtttgagcaggatatatcattactcatttgcacaggtttcctttttgttgccacaattttcccagtgactgatatcttcagaccatccatcctacaatttacacaaacatcagaaactggaaaagcatttctgaactgataaatcattttacatgtctgtgctctcactgtgaggttcatcttgagagcctccaccatggtatccaagcttctgttatagaagtccttcatggccgtctctatgatgctgttgtcccacacctgtaaaagcagcacatgaacacagaaatcttgtgagtgaaaaatggcagtttgtgctgatctgaataattcagttgacatgacatgagagaagcagtacagacatggtgaaggttttccttcctccggtaccagtgcactttgatggtgttgcccccttcgtcttcctcgaagccgacgtgcagcggctggtgcacgtcgccgacgaagtgggccaggaacatcaggctctccgtcaggttgtctggtttatcaatcagtgcatgtgtatggatgttcagagatcatcggatcagtgtcctgcctgctgaatcagagcactatttggcactgtgttttgcagataagcttacatgaactctttgaatcgccatagctgtagagctgatcggtgtagttgttgatagccccgacaacgcacatcccttgctggtgacgagaattatggcagtcccctggataattgagagccacaagcagattactccatgatgaaagtaaagctcatgtttcagaaatcagagaaatgtttgtgccttagctctactcatctctgctatcatctaatcagagtggcagatttcaccatggaatgctgaattattaatgtatacctcagttaaggtcagctgctccaattagcaaactttatcattccattgaagaccacaaacaacatatccagtggttaggattatctctgaactatactagtaataattaacaacaggtctgtgtgggcacatgtgtgactgtctctgtcagactgtcagcggcacattcctggtcccataagaacgtgctaacaaagtttggaagatatttctcgagatattaagaacgagaagaagcagagaacacgcaattattataatcaagtcgtcagattcctgttgttagtatgtccttttttttcttccttggagtctaaacattcattttacatgcacaattacgacagatgtctggtttttatggtgaaagctactgattgaatgcaacatgaattcgttgtggtttggaacaaggaaattagtggatcgaatcattggtgatgccgtgagactctgaatctgtctgtgatgagagtttgagttgtgtatctttactcaacctctttctctgattgtttgtcctccccaacaagcaacagtacgtgccggtataatttggatattcgatagggaataattcagaatgggctaatggcatctacgctgacgtacttgctgctcatactgttactgatttttttttcgctagcgcaaaaggattgcacgttaatatataagaagaaaaaaagtttttattacacaacgtaatcaccagaccggcttatgccaagggaagggagaaaaagcaaaacaaaaattgaagcaaggaaggctaattaaactactacggcggctaaacataactcctaacagagcgagaagggcagagccactctacactcaagaaaaacccaaaaacgttactgctactactccatccgtttcatattgtaaaattttttagtattgctaacatttatatagatattagtaaatctatacatatatatatatatatatatatatatatatatatatatatatatatatatatatatatatatatatattcattaacatttatataaatatgagcaatgctagaaagtcttacattatgaaatggaggaagtgctaattaattgttttgaacagagaaaaaaagaataacgcaaagcgttctctcgctcagcctggtttgcaaccaatggcgcgcaattaagctcgctttgaacgatcaatttgtattctgtaaatgcagcgttcatttgcagctataattaagtcgttatcttaaaagaagaaaatttgaagctaagattgtggaggtgagtgaagacgtacgtgagtacttgaagttgcagacttggggggtgttggcgtagtggagaggacgagaccagtagtagtggaatcgcacctcgtcggcccacgggcacaccgtcgacagctccccgccggccgactccggcagcagctcctccaccgccgccgccgccttctccgacaggtacttctgcaagtacaacactccgtgttactctctagctgcagcctcttcaggtgctgtgcgaggagaggaggaaggggattagcaaagccatggtgtgcggagacctcggcgatcttgcagacgatgatgtggccctgcttgccccacgcctccgcacgccgaggcgccgcggtgagggagacgacggagacgaaggcggcgagaggcagcagccggaggcggagcagaggcgctgcgagtgccatctccggtggtggtcagctcagcctcgccggagtggttgggtcgtgggctatttattgggcggagaaagagcacgagaggagaaggtaacgtagcggtggcatgggctgggctagtgggccaagattatccggatgggccggatgcttgtgatgctgagggcaatttcggcccataaattttatacagatttttatcatgccgacaacagtctctggcgtttttatcggagaaaatttccagactacgacatgatacattgctactcctgccaaatttgttgctccattttttttctcatgaaatcaattggtgaggctgattttcatacaacgacaacactggctttgtttgagttcattgtacatgaagattaagtgtaaaacatgtaaaatgagaaaatcattagcttgattaagtttaaattattttgaacttaaaaaatggatttatctgatattttatagtaatttatatatatatttctttttttttgcaaaaaaatgtattgtttagcattttgaaaagtatactaatggaaaccacgagtaaaatatgtatcttaatagaaaaaaaaggggcaatacagctatgcagctagctgttgcattcatcctgcaggagaaaaacacacacactgaataacaaacactgctgtgaatgcacggacatggcaccaggagggtccagcagtagtcaggcgtgtgcatgggtatgaacatggcctcaattttcagcagcgtgtgaacgagattgccggccgtgcatgctccgtagttccgacagattcctcatcctctttccctttcttaaaataatggcgcgaaatgatacaatattccggaattcctattgggtgggtgatcgctcctccatccacccagcgatcactcccctgcctctctcctatactatatactcctccctcctctccccccttcctcctccccttcttctctttctactacagtacaccacacaaaactttttaaaaaacaaaagttagaaaaatttatgtatagaaatactatttataaaaaatttgaattcaaattcaaatttgaattgggcatgtaaacttttgacttataaactttggatctatacattttaggtgtataaactttagatgtatagaaataatatatatagaaaatatttgaattcaaatccaaattcaaatttgaatttgaatataattcaaattcaaatttgaatcgggtatataaactttaggtgtataaactttagatgtatagaaatactatatatgaaaaatatttgaatttaaattcaaatttgaatcggatatttgaattcaaattcaaatttaaattggatatataaacttttgacttataaactttaggtatataaactttatgtgtataaactttagatgtatagaaatactatatatatatataaaatatttgaattcaaattcaaatttgaatcggatatataaacttttgacttataaacttttggtctctaaactttagatgtgtaaactttaggtgtataaactttaaatgcataaatttactaaagtaggaaagtaatgaggtgccaaaaaaggaaacaggtggagggagggagggggggcggggggcgacccgatcgctaccaggtaggtaggaactaccccactattcccgcttaaaaaccccatcaccgaggcactgatactgatcgatcgtctagctagcttcttctacctcgcatccgatcaggaattcaggatgcagcagtcgatcatgtcgacgctgccccttctgctgctgcttctcttctcctcgctcttccctgctccctcgcacgcctggggaatccatggccatctcatcgtctgccagatcgcgcaggcacgcacattcttccgtcttcttcctcgatctgctcctcgccttctttcatctgatcgtctcgtctcgtgcagggccggctgagcgacgcggccgccgcggcggtgaggggcctgctgccgtcgtacgccgggggcaacctgagcagcctctgctcctgggccgacggcgtcaagctcaggtacccctggtcggcgccgctccactacatcgacaccccggaccacctctgcagctacacctacgacagtttgttgattttgtcctcaaattcgactgaaatttgcatggacatgctgtcacattgtagcagcatgcatcatgttggtttcttgtgttgcattgtcaggagactgcaaggacgaggatagcttcagggggaggtgcgtcgccggcgccatcaacaactacacctcccagctcctcacctatgatgcaacatccccttctactcaatgtaatactgctccatttaattcagttctgcaattttttttgccttgttagtctcaggctgatgataagtttctgatcttgagttcttcagataacctgacacaagcacttctgttccttgcacactttgtgggggacatccaccaggtacacccaaaaaaatgtgattagtacgct

SEQ ID NO: 67105 - DNA, 6841 bp, Oryza sativa
cagaacaggggaaagggaatagacactacacggaagaaaacatatagaaaaacacataccgctaaatcttggtcagaaccaccggtggtccaaatcctcttttcaaggcctagaagtattgcagccgtcatggctcgatgtagcatcctcccgagcctggccgatagggagatctgggatgcaacggcctccttggtggagataatacaagcacaggggcataggcatggtcgcctgggtagcgcgcctgagcaggtcggccttgtgcactgcaggcgaaggtgccgtggtgtgaggagggacgcactgggggcgattcaatcaaagcagcgctcccgtgagctggagatccaagcaaaacaaccagagaagtcgccgaggggcttacagagcgattcgaggccgagaaaaccctagagggagagggtgagacggggtgccgcgcgggggtggaaagacggtggtggtctccggggagaagcgacggcggccgtggatggcctcgccgggaagcgacgacggcgagcaacgggagctgcgtggccgagctcgagacaaaaggggaacggcggcggcgtcgtaggtgacgacgcggtcaagactcgagagaatggggaatcggcaggttcgtggctggtcctcctcttcctgtcgtgagtgactgggtggtgggctcaatcggcctggcccgatacgatgcaagcgcgtggctgggcaggagatcggacggtgctgattgttggggcgacgtggccgcgtgggcgaatgaatagtgaacagtaccgacgtgaggtttataggattttatatgactaggggtgaacgttggatagaagggaatgtgctagtgctgttctgaacctcttgcgcatacattaacatgttttatctaatctaataaacatgattaaatttagcgtttgcttttacagtagtagaaatatgaaattgaacaatggttagtctgaggaatcataagcctatgatctagctggagtcttctccggtttaagctaccaattgaaacatattaattgatgcctgataaacatatcaattgatgaacaatgctggagttctatctcataaatcaacaaacagaaaagcaacttaattgaatcacttgcaccaatctataacttccatgtatacatgaataaacatgcatcattggtatacgtgagcagggataaacatgcggattgtataggaactgcaagaaattttaccatatgtgcaaaaacagggaaggtaagagatagagtaactaagcaaaccgtattatgtcctagcagtggtggtcagcttgcaccaatgggcaaacctagtctttgaggtaggttaagcctaggaggagggaaatgttggttggtaagcttacttccactccctcgctatgcacaaaacagattgacataatgtaccactaagcataaatgaggcaaagcatcaccattgtacgtagtgagtggcccactgaggaaacatccaattagtgcatatatcgacaaatatttaaagaaaaaacaactaaaaaatgtttctagttttacctgtccttcaaattcttcagaggttgtctcacagtgcgtactgatgaattgtaaaccaaccaggtaaaactgaaaataagcaaggaaacaaatcaatcatagtaagtaagtgaatggtaaagctccttgacttttaacaatctaaaaataaataaatcttgagtgtaaggtgagacagtggacaggaagaaaaggcaaggcaatctaggaattgttgaagaatgccaagacatgattatcattttgtatcagcaaccatgacatgtacaatccaacaaaatgtctgacaataattcatattggcaaaatataaattacagcatattgccaaatatatttctgcccataaacagccagatcaagtgttagataaaaaagtgaactttgaaactgatatgtttgaatcaaagtagatatatatcaagcagttgaataggtcagtgggtctgatagcaaagagaaacaatagcatctagctatcctcattcatatgtaacaccgtgaataactgaccatgcatctcagttttttttatcatctcagatttttgtcagttggtaataactgagcatgtattgttttttaaatggaagttgcatgtagcatagtcatttctgaacgtaagcttaacagaaccaataggtatcctataatgctatacatgagtaaacatactgtagtaactggtttttagagaaaactactggcatatggacaagactggcaagtgatggatccgcacctgtaaatctttcagtcaaagaagcaacgtcttccagactggcatcacttgccaatgaaacctgagaccaacagaagatattaaaaatgaaaatacatcaccaacaatgaggttgttaagacaccaataatctaaggagttcacagctggcaaaacccgtgattaaaaatatcaacagaagacaaaatggcaaatgagagctcacctctctagagtgaacctccagaatttccaaacactcatgccatccaggaaaatcacataagacaaatcttccaggccacaagagtgcaacatcaattgattgtggcttactgcacataaggaagaagaaaccattaaaaaataaaggaaaacaaacaagctattttagttccaatcttattctcaccagtaaaaattcagtcttcatagcatttcattccatgctaactatttcttgacgatttgcgactggtcattgcagtccatttaaaattgtttggcatgctgcaccaactacatcttcttatgctttgagagctaaccttgttgcagcaaatacaaatactccagtcaagctttctacaccatctaggatatttatatacacatcaagtcataagccacaatacaacatttgtctgaattacaacaattcaacacaaccaaccattgtctgagtataggtcataccgttcagacaaatgctgggtggtagcacaaatgttggggaaggatgccttggatcccttcatacgaagcaactgggtggaactctcgaagcaattgaagaactcgcagagcatctcgtagctgaccaagtaaaccacccacaaacaccaactgaaagttagcagcagtaaaaattagcatctcaatagatcaaatttaatggtgggtatggagactatattcactaaaggagcgagatctgcaattaggtatcagaataattgtctgaaactaagaaaaattgcagaattcaattgaaccagatccaaatggtggagcctggacctttacctctccggcagcttggccttgcgcttgacggggctccggacggatgtgggaccaacatcgagctgccgttccacggcctcgagctcgtcctcatctggcgccagcgacgccgcccccctctccgaccactgccgcagctcgagcgccgcccgccggaccccccttgacagagaacaccacgccgccgctgctgccatgcgccttccgcaccgccgccgacggctgctccggcctatccggcgtccagatgtgccctgccgccgctgcaaccttccgcgtcggcttctccggcgtcaagaactggtcggccaacgcagccgccgccttccccatcttctgtggggtggcgataccggccgccgtcttggccctcttcgatggcggcggcggcgactgttaccaagtgcattacatgtattccctttttgttaccatgagccctaagccgcctaatcgccggcgtccaccgatccggaaatgaagaggatggagagggagagggagagggagagggagagaggggcggctgccggctccccctcgcctcagaggggccggatctgccggcgaggaggccggagtcaccggatccggcggtcccggcctcctcgttggcgtatgcggcggagggagcgagagtatggcgacggcagtggcccgcgtgccgggcggcggctagcacggcagcagagagtgcgaggaggaggtcgtcacctgcaggaagaagagaatgaggggggcggccattgcttgggcaggagagagagcggagcgagaggaggagaggaggaagacgaatggtggcggctagggtttggggaagggggttagggttttttctattttacgaaaacgcccctcatcttatacttttcagagcgcggtacgattttccgatttttctcttcttcgtatagaatatttttgtttacagaggtcctgtaagtaagaacgcataacgttaaaactaagggatagggacctgtaacaaattatcaagtaaatgaagggcttttttgcaaaatggccagcgatgacgcggaggcaggagctctcgcgaaatccctactccttccagcgcgcgctgacgtgtcgcgccccggccgcgtccacgccagcgcaaaacgctgaggagcgagcagccgggggtcacttttaatactttagactaggggcgagagcgcgcttcgcgcgctgctcttgtggagctggaagtttttttcatcatttaaatgtataggaatatagatagtgtagtgtattttaaagagaaaatcccttatatacccctgaaatttttcctaatcccttctatacccctgaattttgcttacttccttatatacccccaaaatttgattttgatcccttgcatacccctcccgttagttgaccgtgtattttctataaaaatgaccattttacccttggatgaacaaagaaattcataaattacattattaaaaatataaaagcttctcgcatgagactattatagttatgagtttgttgtgcgatgcattatttatcccaaaaaaatatttttagataatgaaataaaaaaaatacgtatttatttttttaaaaaaagatcataaaaatgaggagcattcatataaagataggtataccaatgttcacaacattttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacagtaaaatgatggaaaatgtaacggtaggggcatggaagggatcaaattgaaatttcaggggtatagaaggggtcgggtaaattttaggggtatgaaagggatttagtgagttttcagggatacacagggaatttactctattttaaaaatctttccatgccgtaggattgagacaatggagtttgcttgtcagaataatttgtgctatttatcatgtagtgtattgtatggttcgatatagctatagtagaaaataaaaggtttgcgtataatggtgtctttgacatgaaggagaaatgtttaggtagtacgcagccataactatattggttccatataagtagtagttgttcgaacaacatttcatagcacagaaggtggcaaggaaggtaaacataacattacttatttacaatgataatcatgacctaggggtcatgaacaaaagggcttgcttcttagcctctctaggcttgcagctaacttgttgcttctacacttctagcttgggtggttcgttctgtacatatacacaaaagacttgctgatggactacatatatccgtctcattcactgtaggaatgaatgatgagtttagaaatttagtgaagtttactaaagaattaatgcgtatgtgtggagaggtgagctgagttattcagaattaacctgtcagtgggtttcttctgggtactatccttgaacaattttttggcaattgtggtggtttctgtaggtctacctctgttcattataaggacatgtcaaatacaatgtgtgcgagaaatgtctattactgtaactttgaactgaaagctttacagacctttttttgggtgtgctctttggcgccagtgaaggatctgcctgtggagactcatctggagattcagcggtgacctttgccttgtagaagaagcacttttttttcagaaattgatggattaggttatgaaaagaaagagcatgaataccttatccgaagtatcacggggaacaattgtagttaaagatgcactttgtgagatcttctcttcatgatgagtgccaatttttgccttgcatagttggtcaataggtcagagtgtatctccaattatttaggaaaatttgtttatagcagaggaagtgcaagagtaggtattaagaaggataccttagtatcagtagaggtctttgcagtgtgagatggcatagagtagcctgagacaataatgctttttttggtaaatactaaggagcttgatttgctagttggtgtctcatctgttgcagcagcaggagtgtattttgttggtgttgaagtgccctgtgctggtatgatggctaattgcgattcggtgcttgtttcacttggtgttggtgctgtctggagagaactgcttgagcttgccgatacaattgctgatgctggctgtgaagtacttggcgacataagcagcggtggttgatttgctggaccagaggatataacactattaacctggagagtttcttcgcttctgttaatatcctttgtgaagctgacattccatagaaaaccattgtcaacaagtgctaagatttcccttggaatgaattcactgtccggtggatttttttcgatcagagattccactggccttcgtatgatgcgttgcgcagtt

SEQ ID NO: 67106 - DNA, 15499 bp, Oryza sativa
ggcgcggcagcagcgacgcgacaggcgacggcgtcggcgcggcggcagtggcacggggctcgggacggcgtgcgcgcggggcagggggagggttagggctagagaacgcgatcgagcacttagagcgcaatgaatagtgccattttctatttaacccgatttaagcctatttatttatttaaatttgattctataaacctaaattttgtataaatgaagttcactcggtatttgtgttattccaaccaatggatccatccttgactaattttacccatattttatttttatataattttcttgaatttaattagggttaattcttattccatcacatttaaatttaattgttacaaatatggtcgtaataatattttacttatttctatcctcaccaaatcttattttaaattgaactttaattatttactttgtcaatttacttttagggtttattcctaattaattattcattattcgtgatttatgaactccgaagtcaaaataaaataaaatagtgaaacaaaatcggcatgatgcaatttatttaaaaagtttttgaaggcctatatttttggagtttagatttttgtcggtctaatttttagggtgttatagtagacttgtgaattttggcccaattcatcgtgttaattctgagtttttatcccattcatgcataagtctgattctcgacatcgtccgattgatttaacgtctgagttgatgtcgattctcctccattttatgcttattctctacaaaaggttagtaaacctaatactagtggaatattattattctaacatatatatgcattgtaagcatcactagttctcctctattttggtaatattgatgggcgaaactgatcgataacgaccgtcaacagacatattatctattttgggtataaatatgtacccgacaccctctaaataattaacaccatttcaatacactttcggcacatcgccaaacctttctattattttatttcaatgagttcttgctttcgagttgggctgcatcgacttcgatctccgacaagaggtaaagcttgttatgggggcttgcgttctcgggatcagtggttacatctttatgacactataatcttgtttatgtaattcgtcgagttataatatatattgactaatcaaagttgatattttaatccagtccttatcggccgatctctgtttagggttctatcgacattgactagaatagttcgtcggcttagattatgcaatgtatctaccatcttggagaggctttcattggcttgtttacctaaatcataagtttctctttatacttagtgctgcatcagttaagtttgatcaactaagtcgtatctagaaacctaatatttagcttgcttcatgattgctaatagatatagtatcggagttgcagctgatcttacatgatatatctattttgttttacttaacaagttatatctgccctttatattaggctctcaatagatttaaatatattaagtttgtcatcgatctagttaggttaatctaacgtcaaattgatacttatttaacatatttacttcaaagtgatatcctagtatagagttatatcggagctatagccgatatacttctaaatttgcctatcggctatgacatgagcttgtataatttatagcttgatataactttagatataaatgatttatactgtctcggcggctgtccaatctatcccaatcatttcgtttaaagttatattgattcatagattatatagtgctgatttctccaaccgatagagtaagtttagttactttctttatcatatcccttatagccaatccgactaacattgcatcgcctaggtcacagacgatatgtcatcggctctacgaccgataggctatcgtttatggatttaactttctatctttatttactttctttatcatataccttacggccaatccgactaacattgcattggctaggtcacagacgatatgtcatcggctctacgaccgatcggctatcgtttatggatttaactctctatctttatttctcgttggttgtaggatcaaaccaactaacatgccctgaaccctgaaggcaagctttggacctgcactagaataaagcaaatctcttatatcagtgtgtgtttttttaattaacaaaagcgcgagatcgtgcggtgtcgtgcgatgggtacacgataccgcggtctcgcacgacaagggtatgagagaccgtgtgaccttgcacggtaagtatgcgagaccgcatgagtcgcgagattaatggatcaatcagcatcatcaagaattaattaattaactattatttatttaattagcattattagcaattaattaatcacttattaagaatttaagattgttaattaccaacttgccgtcattgctatcgcactctgatctcgtgatttcattgcgatttcgcactgccaaacggcgataacggtctattgatttcgcactgccaaaccgcgatgacggtctattcgtgtaaatctgttcgaatctcgtatattttttaagaaaaaaaacttcaacaatatattttcaaattcttttggtatgcttatagggttctcttttaaatcaaaccgaagagaaacgaaatagctaacttacttttaaccatactgctaaacctttgtttcagcgcagcgtgtacttctataacgtctataaaagctgctgatatcatagattgggaaattttgaagagtagtcgatcttatccaaatttttttcaataatggaatgaaatattacagcctttcactagtacagaaagccctattggtgtcggttgggaaatggcaataggtgccgttttcccgtccggcacctattgctggtaccggcaactaatggtaaaatagaaccggtacctttttgtctgcacgagaaaaaaaaaactctggctcaaatcaagccgaaggcctccacatccagaacaatatccccacattcagaatcaaaccgtgatcccctccacatccttagatccagaacaatatccctacatccaaaatcaaaatccaaagaacacatcaataacaacaacaatttctacatccatttaattataatgctcatctgatccaaatccccatgttctcggtacacatatgaataagagaacttgagagaaattaaacaaagagaacaagaacgggataaaaagaacacactcgaaccacagcggcattgaggatgatgcggcggtgacggggcccttgggttgcctccttcttccccttgagcgtcgctaggatggcggttgtggacgacttgcacgtgaggggagggcgcggtcgctgccgccttcgtcgggcagccactggccgcgggagaccgacgccgccctcccgccgaatctggaggagggagggcgcggcaaccgccagcctcgcgagcccgccgccaccgccgggcagctaccactagagagaggggagggagagacgcgaggcgacagaggggagggagagagacgcgagagcgagagagcgtgggagtagataaggacaagacgtgggtgggagtagataaggaggcgtggcgctcggctcatcggttcgggtcgttattataggtgtcggttctttaaaaaacgaataccttagtattggtaccggtttttactaatgaaccgacacctatagtttcttaaaggtactggttcttatttttttgagcgtgtggaggtaggaaaaggcctataggtgcggttttaaaggaaccggcacctataaggccgatccctatgagtgtttttgtagtagggtttgctcaacgagttacagccaattattataaggctcacacaaaagcaaaccagagtaacaaaaccaaaagcaaataaaactaataaaaccaaacaaggtaaacatcccagaactagtgaattctattggtgaatctccacccaaagttggcaaagaagacgcaagtttaggacacgcctctcttatttgcttgatatgatcatgcctttgtaattgagataattcccggagccaatatgttaccctgaaaagaacctgcaaatatgatttttaaggtgatctatccaaatccatttcatttctattaagccatagagcacaacatatagcggaagctccaacaaaaataagatccttgatatttttattaactcccacgaaccaattaccaaacacatgtgatatattatgtggagggtacaattcaaaggagaattgtatagataaactagtttttttttaaaaaaatattatgtttgtgcatacaaagcattctacacatttcatccatacacatacattactcaggctggacaaagcagctagcggatgatcaaatagtataggattgaattatcaccgttctcgaaagtgctttgttggtaaattagaaagggtggttctgagcttcaaatccttcgatggagcggtggacgctccaattcagattgctcctgtggcgtcatatcaccaaatatattgagaccccaggtataagacttgccagacttgttgaactcaatgattttgtgcgctctgtccttgaaatacacgaagcgccgaaccatgtcatcacgatcgcgctctatgtcatggaagctgcaccaccgctggtacagcgcccaaacggcttcctctgactcgaggtccttctcgtcgtaagcgaagcaggtggctggatcatctatcggtaaaataacaaggcgttatttaagttcaaagcaggtggttgtttcgtctatcggtaaataacaaggggtaactaacaaggcgttaattaagtttcggttggatgataatgccatgtactctttgactccttccatccgaaaatacagggaattctctgtttgtcacaagtgaaactaagtttgactgaatttatagaaaagaataacaatagattcattatgaaatactccctccgtttcgttttatttgacgccgttgactttttatcacatgtttgaccgttcgtcttattcaaaaatttttgtgaaatatgtaaaactatacgtatgcataaaagtatatttaacaacgaatcaaatgataggaaaagaattaataattatttaatttttttgaataagacgagcggtcaaacatgtgctaagtcaacggtgtcaaataaaacgaaacggagggagtactaagtaatagtgcatgtgcaacgcacattaggaaataaaatcaaaccaaatatgttggacgtatgttgcagcctaatttgttttttaatatttagtatagtatttacttggacttaatgtaaaaggcaaagtgaaaataataattgacataaatttatatcacacaattaaaactactaaccaccatcaacaacaacaacaaatactaatactgctgttaggaacgtcccaacatggaaaaggaacacaacagtaatgaccaaagatgatttgcgggaaaaaaacaaatatttacatatgattttaactacacatggatccattccctcaatgaatgtttagaaaatgaaaaggaaccagttaagattgagtgtattctcgtgtacggttgtaccggttggatcagtgtataatttgagataacaagatcacatatttacattgaaggaaaaagattgcactgagcttaggtttacatagaagattacatactactcagatcctgccatggcctgcatcatactacctggacatatatgtgtcgagattcgtagcaaggattgaactttttttttttgggacggaggggtagttattattaccacgtcaataaacaatcacaatccagtatatagggtcaacaagacaacaagagtgtgaaccttactttgtggtgagtaaactttttatggtacaactctgaacaaacataattgtacatatatattttttttatggtaacagagacccacatcacaagttcgcaatagtactgaggctaaaattttcaaagttacttctctgatgtggtagatgttaatattttctctaagaaatttgatcagcttagaatttgctaagaaatttgatcagcttagaatttgacttagcacaatcccaggattacttatatgttaggacagagcaagtacaaataaagatagtgcagggatagagtgtgtgtgctttagtgcgttcgctagctcagatcaagggccattgttccacttgtccgtgtgactcatgtaatggggttagctaggccatgtacacaataaggctgcaaatgaaataaactgaatttcttcactgagtttcttcttcagtgtgtttttcttgttcccttttccttctctgtttcctataccaaaattctccttctccccaaaatagaacaagatatcaataatactgctaataattcaccccaaattacaacgagttatccataatactgctactagtcaccagctcgggtcataacaattactacctccatattttaatgtatgacgctgttgactttttgtctaacatttgaccattcgtcttatttaaaaaatttatgtaattattatttattttattgtgacttgattcatcatcaaatattctttaagcatgacataaatatttttatattttcacaaaaattttgaataaaacgaatggttaaacgttagtcaaaaagtcaacgatgtcatacattaaaatacgaaaagagtacgagcaatcggtctctcacgagttcgggtcataacagataatcatcatgacgacagtatccttgaagtggaggcaaaataaaaaaaaaaaatggcggtcgattaggttacctggagcttcagggtcaaagcaatcgggggagaggtcggcgggtccgggggagtggtcgccggggatcatcgcgatgccgcgccggaggatgacgagtgggcccgacggggcgtgtggcagctgaggccgcgtccaggcggcggcggtgcaggtggtgtcgccggcgtagccacaccgaggagcaaagcggcccatgtacgaagccacatgacgggcggcggcggccatggcaggttgatcggatgtgaggaggtccggtactcgattccgatctagggtttcaactttgcaattcgttggactaattatccttgcttgtgttttcagttgagtatgtccctgtggcaatgacacgtttagcaagtccttggagcgtgatgacccacaaccaataatcttcttgatcaaaactcaacgaatggttcaatgattcaatcagacattagtcaatttgttgatctcaataaaagaatataaggttattatcgacaatgaaagacaccgccgacaaaatatccggtggcatcggtttagtgattttatcattttcagaaaaaataacaagctcaaaattattattttttgaatacactcacccttatgaatagacacacaacttactcctataaacatctacgaaggacttagtcggtatatcataaaattaatgaagtcaccacggccacgggcgcctcactgtcgacgtatacatcgtctaccactgagagaataattagcctaaatacaaaactcggattaaattgacctaacagaagtgatgaaagtgcattgtaaaataccaaaaatttgtatactgacatattagggtttaacggatattgagtggcaaataagggaatttcaatatatatattcccctgattttttttagaaacacaatataaacgcaaacgctcacactctcacccctaagaacatatacacgcacattctacctttataaacaccttggaaaaactgagccaatacatcttgaggttaacgaagtcaccatagacacatcgttatcgatggatatatatatatcgtctaacactaaaagaataattagctgtaaatttgatcacccgtgtcaagtctgagacttaaatttcaggtgaacaaaggttctaccatgagaaacttagctagttgagctacgctcacttcatcccctgattatttttgttaatcaaccgcttaaaattttgtaaagttcactatggtcacaattttgaggcagatgtgaaatattaaagtcttattacaatagattaaaaccattcaatattacgtagataatatatgcaaaagattgaaacagatctcttaactttttgcagccggcagaggggagaagaggaaatgcccttcggcgtggaagggatgttgaccgagtgccacaccatggatgagttctagtatctcatcgaacaggccatggtgtgtggcaagctcgtggtcatcgagttcggtgcatcctggtgtgaaccttcacgcaggatcgctccagttttcgctgagtacgccaaggagttcgctggagtagttttcctgaagttcgatatcgatgagctggaggaaattgcagactcgtatgatgtcaacggagtagtacccaccttcaccttcgtcaaggctgggcagaagattgacatgatccaaggagccaggtgtgacatcccggctcaggacttaataggattaatagaatactcataccaacaagttacaacttcttttccggaagccgcttctgggtgcgcacgagtgaggacaaagtgtgcagaaaagacttgtgttgctctgtgagagcattctatatcctaagaaaactgccagatatagagagggcctggcggtcaccgggaaattcttcccgggtgcgcacgagtgaggacaaagtgtgctatgagggcagtctatatcctaggaaagctgccagatgtagagagggcccggcctcggagagtgtggggcgttacagatggtatcagagctgacccttgcagcgttacagatggtatcagtgccgacccttgcagctatacgtatatatgaatatgtacgcgggcatacggtgcacacgggatgatccacgatgtggtcgtatggcatgacgtatgtgcgccgaaaattgtctgtatatacgtggtgctaataggagacgttcccggcctgggttgaccgacgaggacgtcggtgtcttaagggggagagaatgtgacatcccggctcagggcttaaagaggattaatagaatactcataccaacaagttgcaacttcttttccggaagccgatctcgaaagaactctaaggttacttcctgggttcataagaactttcttaattcttcccgggtgctagtctgtgtcctattaaagctgccagatgtaacagggcccggcctcgagtgtggggcgtcacaccaggtctctccgttcgaagattcaaatgcacactgcttctccttacttcctgggttcataagaactttcttactgtctttgcgcgatgaagtggaacagctagtagttgttattttgcggtcgggaccttaacatgtaattaagaaaccccactacagtgctctttactagtggtaaaaagtaatctaaaccattgatataatttaatcgaatggtttaaaatctacttgtactgtcaccccagtttgtggtaggagaaacatgaagggacattattattaaaaaatagttacagaggggtataattatcatttagcagtgactaaaccttctaatcataatattagtaaattattgatttacccttaattaaggtaaggggtgttaccgtgttaggcactagacactacttaaaaaatcctcatagggaccggcttatttaaaaccggtacatattgatcttttctcaccttccgcgggataaaaaataaagaaccgacacctttgaacaattataggtgccagttctaaagaaaaactggcaccaatacaattggtattgatttttttaaaaagaaccgacacatataatatattataggtgccgattaattaaaaaccgacacctacaaattaagccgagctggtggggcccaccatgagagataaggccagcggctagacacctcgatccatccagaaatattctagatcgctctatcgctctctctcggtcgttcgctcccctctctctttccctcccctctcgtggcgcctgcccgggaggtagcggcgcagcggcggcgtcctcctttccgccagatccagtgggagggaaactgctcctcttttgaaacgaagaaagctgatgtctttgtaagcagacacggctatgaagcatcaggcaatttctgaaataggaatgtgggtgaaattctacagtaactgataaaatgagtggcagatatgtagtcaaatacagttgagaggtgctgcacagtatcaatttatctacatagtcttcataaagatgtcctctgttgatatgtcactgctcaattgataacagtcctgaaaaaacgcatctagtactgttctgccacattgagaagtaactttgaatcttgctctccatcatgatcctacatgtggttttctgcacgcagtgctccacaggttgcagctgctcaaggcagttgctgctacactcggaggggagaccatcttccaccacgaggcataccaacgcgatacatgttcaatggcatgaacctagactccacaatatatataactgtgtcatcaactcgtcaaccaatctttctgatgcggacatcactccttcggatacacacaacaatcctccaccggtcattcaagaaccgataacaagagctcgcgtgcgacaattgaatttagaggtaagctcgttcctatgttcttctttgtatgaatttgagaatagattgctacctaatgattatattgtgattaggaacaatggagaggacaaagagacacttggagaaggacttagagttatggaggatcatcaaggacgtccaagtcaaggtggagggccaaagcaagccaactttgagtgcaattcggagtccagaaccagtctacactaaaacgggcgtccaggtcgcatacgtgctcggattggggcgttctttatatggatggaagctaagaagataacctttccaatggttctggtcccacgtccaaattctttccgagtcaacgggaatcgaccgaacaagttgacgtctacaatctgtgccagtgctgcgtcaccgtatttaggcctttgggctgtgtatcgtattggaacctattagggttgtgtcaagggttggttgcatgaccctaaactctatatatcagtacccgccgtcaccagtggcgaatccaggatagaaaaagagggtaggcttgatctccaagtattaagttactacctctgtccctaacaaattttggctatgaatttggacacatgattgtccagatttatagctaaaattgcttatattttggagtagtaaattgcagtacttacggtagttattcaacacatacatgatacatgattgaatagaaaagaaagaaataaagaaaaataccttgccaatacgaagtaattgattactacatcagtcatatgagaataacaaacacctatatgcatatactccgtaaacatagtataactgctgctctgctagtgctagcggctactgtggtgctgctccgcgcgccgccatggcgcctactgacggcttcgcgcagccgctccgcctgcagcctgccggcttccgcgcctgcggccgcctttgtttgctcttactcgccaccagacagctagctacggcgctgcagctcgaggcctcgagctcttgcgacttgcgtcggcgtcggctgctccagccgccaccagttgccagcgacagctcccaccctaaacacccccaaccctatccccacctgacctgtgtgagtgtgaagtgtgggaagtgggccactggactgggccattactatcgaattgggacaacctgttagaataattgggctaggcccaatttataataattaaatctcaaagacccataataaatgttgaggataataataccacctcagaatttaagcgagaaatatctcaacctaaatagggagttattagaggctccctgttgaccagttgaggtgggggtcggaatgccacgcgcgcgcgcgccgggccgtgggcgaggcgtggcgtggctggcggcgtgcgtcacgtcacaatccttttgcagccactaacccacgttcccacgattccctccacaaccgcgcttccacgttctttctcctgatagtcacgacgcaatccttttgcagccactaacccacgttctcacgattccctccgcaacagcgcgtccacgttctttctcctgatagataaggaggccgcgagtccgatccgacttcttagcttttttcccggtgttagtttctccttctccgcgcctgagttgctctcgcttccccgcttctgatctcttgcgcgcacgagagattggaagaagcagtggctccgaaaccacacctttgcctgagatctgcaccgggtaggcgggagatcaggtttttggggagtgcctcctgcacgactgctcatcgccatgtctggagttgctgctgccgccgctaccggcggaggtggtacgccgccgccgacaggagctggtgcgccgccgccgacaggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctattctacgtgatgcctctagcatgttatcgcgttactggtatgttcctgtttctgacattcatgatgcgcatagtatgctactggttatgttaagattaccctacactgcttatgccatgatcattgtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatatcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgagagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggtaaaggttatgacagcggaggcttgttccgcttttctttgaatgacatgtgtaataatcataatgctgtgaaccatattagcaagaatgatgagtctaatgtgtggcattcgcgactctgtcatgtgaatttcggttgtatgacgcgcttagctaacatgagtttaattccaaaattcactttggtcaaaggttccaagtgccatacttgtgttcaatcgaaacaacctcgcaagcctcacaaggcatctgaggcgaggaatttggcacctctagaacttgttcattccgatttgtgcgaaatgaacggcatgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttctaatgagtttgcatccttttgcgaagagtttggaattattcatgagatgacgcctccctattcaccccaatcaaatggggtggccgaaagaaagaaccgtattctaactgagatggtgaatgccatgttagacactgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagtcaaaaagcggaaacttggaccaaaaactgttgattgtgtgtttcttggttatgctatccacagtgtgggttatagattcttaatagtaaactttggagtacccgacatgcatgctgctacaatttttgagtccagagatgctacattctttgagaatgaatttcttatgaaatatacacctagcacttctagtaaagaaactgtcatgctccatgagcactttgcaccgatagaacacaatgatgaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaattgactcgattatatctaatggtacttgggaagtcgttgagcgtccatatgggtgcaagcctgtaggatgcaaatgggttttcaagaaaaagcttaggcctgatggtacaatcgaaaagtacaaggcaaggcttgtggccaagggttatacccaaaaggaaggcgaggatttcttcgacacatatt

SEQ ID NO: 67107 - DNA, 15633 bp, Oryza sativa
attgcttactggtacacatatattatcatctgagtatattgttttgccataacctctatgtacttgaatgttcatgtagaaaccatttcacatccctacaatttatgaaaaggaaattcacattctttctcaaaatgttttcttttgtacttgaatgtatctgcatgcatagacactgttttttaaaatgaaaattaatcaaattttcttctctattctacattgttttatatattcagaagttggcacagaatctgaatctactctaaaagaaaaaaaaactggtacaacaagttatttaattagttcaatatttgaactcttaattgactcatatcagaacaaggtttcatttaagttatcactgcatactttagcatatcattaattatttactagcaaatacaaaaaatcttataagggtccctaaatgtaggtattgttatcggtatggctgctggttttggaattcttgtacttagcttatctgtggtactccttatccgtaaacaaagaagtgacattctgaagcaacaacggaaaaaatattttaggaaaaaccaaggccttctactacagcagcttatatcatctgatgaaagagctagtgataacacaaaaattttctccttagaagagctgaaacaggcaacaaacaactttgacccaacacgtgttcttggtagtggagggcacggcatggtttacaaaggcattttatctgatcaacgtgtggtggctataaaaaaacctaacatcattagggaagaagagattactcaattcatcaatgaagttgcaatactctcacagataaatcatcgtcatattgtaaaactctttggatgttgtcttgaaaccgaagtccctctattagtgtatgattttgtcccaaacggttcactaaatcaaattattcatggtgctacaagtaatagggaatcatcattgtcttgggatgattgtttgaggattgctacagaagctgcgggtgctttgtattaccttcattccgcagcatcagtatcagttttacaccgtgacgtgaaatcttctaatatacttttggtgcaaactacacggctaaagttgcagattttggtgcatcaagattgattcctaatgatcaaacccatgttttcaccaatatacaaggcactttcgggtatttagatccagagtactaccatactggacatctgaatgagaagagtgatgtgtatagctttggtgtagttcttttagaactgcttctcagaaggcaacccatttttgaatgtgagtctggcacaaagaaaaatctatctatttatttcctttatgagataaaaggaaggccaattactgagatagttgcccctgaagttcttgaggaagcgaccgaggatgagataaatacagttgcctctatcgcacaggcatgcttgaggctccgaggtgaagaaaggccaactatgaagcaagtggaaatgtcattacaatctgtaagaaataaaggtttcagttcagctggtaccagcccagaaagcaatcatgggatgcaaccagccctatccgaaacatatgtaaatctgcatcagcctcttggagttcatacaattggtataattaatttagcatcttcaaactgcaatagcttgcagcaagaatttatgttatccgctagtttcgcaaggtaaattatattactccggctattgaattatttctagatgttttcattatatattattgggaacatgtgcattcccacaatcaatctgtatgtcctaaataatacgttttgttctcatttgtgaaacattattaattgtttgtgtgaatttaatgcaatttgttttgtatgcttcatgctgaaacttttggtaagttctcatctcaaattggattcttataacagtgcaacttgctctaatttttttagtgagatgtgtgacttatttttctctctcattttttttacttgctcaaatatatctatcaatattcagtattgtggacctcgtggttttcggttcacctcgtacatatgtttttgttacaagattaataggctagttattgtagcagagacgactcttctatctctgtttgtaatattttcaaatcctagtgcaatgtgtccgcatttggaaaacttccatcttgaatattatggacttcatgtgaaatacttcaagttgcaaagacattcagcttgtagccaaaaagcttgaataattttcagaatgtggaatacttcaagggtttatttcttatttaccaccggcaaattcgcatgattctgagcttgatgtgtcactgatatgtgttccctagacccacatatcgttatgagaggaaaagagaaacaagggaatgtatcaactttccatgcaaatttgaatgatccatttcacgttcgctgaaaaaactgcacacttgatggttcaattacgtcattgttccattgaaaatggtactagatgcaagtcctcttaggctcttactctccaaccggacctgggaacaactactcacgacatcatttccaaaaacaagttagaagtcataaattactgccaaaagatttaacggctttctaataaccccaagctctaagagccagttcaagatgctcagtggaatgtaccatatatcttaaagcacggtgttacctttaaagtaatcactaggttttccttcgttaaattcacgtatatgcatagtattttttgaccgcctcgctccagatgcccactagaatgacaattcataatagccattcttgagcaaatataatttaaaagtgcagtaagaaattggattccacgaaaacattttttccccaaaatatatccaaagagaaaaacttccaagttttaagtttaagagtatatatgtatcaactatgcatcgccatttgcatgaaaagcctactgcagttgaaaagaatcaagtttctatccattgttgagtgagtgcactccatactatagatggccatgtgggccacccggcacagcacggcccaggcccggccttgcctagaccgaggcttgttgggccggcacggcccgaccgacgcaccgggccgtgctgtgccagcccacatgccgcactcacggcccaacactactcgggttgtgccggcccggtctgaaggcacgacggcctatcctgcttttcctcagaataaatctaatttttcttcctcctattgggttgtgacatatatatataactaaaataagtctatttaaggtccctatgttttggacagtgacatttatatgtctatttttagtccctatactttgtgtgccgggcctggcctgctggcccatcgtgccgggccagcccagcgcgccggtggggaggcccaggcatggcccggcggtcaggctgggctgacacaggcccgacccaagtcgggccgtgccgtgcttgcgccaggccaaaatgccgtgccgtgggccggaccttggggcctcgggccttatggccatctatactccatacattaacaccaacagaaatcagtcattcaaaataatgcgttatcccgacacagggacttggtgatcttcacccgaatgtctcctgagtccttcagcattccagtccctcgactcctgatgatttccacatttattccgaccactctacaatcatctgtgaactcaagcaatattctttcttgcaatcgaatttgcaaggtgcgttctgtacagccgtgtgccgcgccatcatactgtcgagtgtcgacagtggctggttcaattcggtgcatgagctacgtattacttgttaagcagtggttgctctcagcatagtaaaaatttactcaccaaatggtgaatgaccgggcatatccatattttctgtaagaagagcagcatcgaacggacaatctcttcccgacttcgaagtctgaaaggaaaattagtaagtgaaaagtgatatgcttttagtattaggtataaacagggcaaagcgtgcatttgctccaatttagtcgctcacttctaattcctcgtgccggtagcacatatttcgtataacatttggcatcatcgacgcagcagatttagaagaaagaatttgataagaaaaggattatggtgtatcctactgcgctgaaaataaaccaatatacccgtggagaggtgacaatctggctgtcaatgttgtgatgggcacaactatctacacatacgtatgggtagacgaaaagctcataactggttaactcgctcagctcgtgactagctcggcttggctcggctcggctaaactcgttgagccagcgttttagctcgttagttataacgagccagctcgatctagctcgagagccaaacaagcctaatgcagcaaatgagcagcccaatcctagccggccctgtaaggccaagcctaatgcagttcgatctcccgtctggctcctcgcccattcggccgttccgggattgggattcgatgacatttccccatgacattctcgatgattgagtcactacacgtgggtccaggctcatgtgggtcccgcatgtcagtgactcaatgtcactgagaatgtcacgggtcacgggggaatgtcaccgaatctgcgtccgccgttctgagcctcgatctaatgttgctcctctctctcctcctgttgtctctctcgccatgagcagcgacgcgctgtccatcttctccctgttcgggtgtccaagtaggtgcggtgcggaggacgacaaggtccgttaccgcggagtccgccgctccgacgtggtccggccggcgccgccttgtccccagccgcgtggtcctcctgccggttcgtgtccagcgcaaccagccaatcccatcctcccaactgcgaacctatcgcaaggtgtacagagaccaaatctctggctgagtcgctggtgcgttgcacaatgggatgttcagaatcaggtgcagagaagacaagtctggtgaagggacaacgggatgctcaggataaggggtagagaagacaagtatcttgaagcgaccatcgatatcctgatgacttccattcaaattgtagctcccatcatcgatgtcaggcaactgagccatttttttccctcattgctcgtgctagcttatcttgccgcagaacccagctgacttagctggctcaggttggtgtctgctactctgttgggctgctactcagggcatgtccagttcccaaacaaaatttttcacgcggttacatcgaatgtttggacacatactggagtctcctatgtagaaaaaaaaaccaattagacagttcgccggaaaattgtgagacaaaatcttttaagtctaattgcaccataatttgacaaagtggcgctacagtaaatatttactaataacggattaattaggcttaataaattcgtctcgcagtttcctggtggaatctataacttgttttgttattagactatatttaatactttaaatgtgagtccgtatatctgatatgcaggggcaaatttttttttgccaactaaacatgcccttattcaaccacagtggctctgtgtgaaatccgatgcacctactggtcattaaccgagcagattttcagtacgaaatctgcaggaaatggattttcaggaagaaaggaacttcatgtatgcgtttttttttaaataaaccacataagacagtacaatgtttcatattggtatagtagaaaaaaaattacaacacaatagtcctggagactataacccggaaaaaagacaaaccacactatgtgcctacaacatatgtcgcactgttgagaacaaaaaggagagcgccgacccaatgcactccattccatccatgtctttgggagtaggggagagagggcgacaatgaagaatggatccgctctcccctgtgaggcctgccaacgtggctatcttgcgttggctagtgcgctgctgctagaggatagaccatctgaagagtgtttcgaaagaaatggcccttcaaacgatgcctcaagggatgttgcgttgtcgatgatgacactatcgtcgtctgtcctggaaaaaccaggaatatatttttttttctaaaggattccaccggagcacaaaggagagacaatacccctaggagggttgtcgctcgaaagcgtcaccactatcggccctggacggactaggctttcacccagagatcttcctacggtcctacctgcagctaccactatttgagcaccttgaacatacagccacctcaccaatgccccaccgttgtgcgcccatgccaggggccctcctcatctgcaaaatccccgctgccaccgctcacccaggtcaccggcactaccaagcacgaggggagggagagcagccaccgatgtcaccataccttgtgccatcgaggatgcttcctcccaaacatccaacaaccagccacactgcccccatcctaaccggcggacagagataggggggggcatccatactaccattcccggcagccgcctaatcctccccctccaatgcgccaagcaaccgccagggcctctgccctcatgtcgcactgcattctctccctccccttgccaaggagggggcagttgcagtcactggtggggatatgggcgatggtcatgccctagctgccgccgtcccaccgacgttgtgccacattgctccttcgtcgtcgccaatgacagcatcggcacacccaccggagcagccgtcactgcatggccagattttagtgtggagggccggatccgtctgcgacctaaccaatgtcgacctaccactgcctccaccatcgtggacaccgacgtacttgccgtaacacccaggccacatcgtcgctgtctcaaggaatgatccaagcaatgtggcccagatacggccgcgacctgaccgatgctgttccaccaccgccgcacctcacccatccgtctccgtcaccgccctggatgccgttgcggcctcctccgcctccatcactgccgtgcatgccggcacaagcgggtcagctccctcagcacattgttcgctggttgcccaacagtccaataagaggggaagaagaagaacagaaccccgccactgccatccttgcagccgcgtggtttctggtggctcgctcaggtggcagcgagggaggaggagggaaggcgggtggtggtgcgtgggctgagtcgtcgcctgtgtcacccggatcagagcgacgcgggggctaagctacgccgcctacactccgtatgtggaaggtgcgttatgcttaccttcaggtatgttacaattggtattctcttatgcatgaacaaatggatccattagtgacataaaaattgttacgtagtttcttgtggtctcattagacagagataaggatatgggagcatcatggttcatacatggtagagagtaatcacatatacaggacattatttcaaccgtctatcggaatatttgttacatcaagtcattgtcaccgtttctctctttttttttctcagatctgctgtaaactgcaaattgtaaatctcctttgcttaatacaaatatacacaagctttatgcatattgtcggaaaaaaatccaatactagccattaagttatatactccttgagtaaatgtatttaagttacatgattctacagcgaaatgtgaagggaatctagcaaaacaaatgtgtgtgggctgccttgctagttgggtctaaacagtgcacagaagtaattcccctcttttggttgtttgcgtctaattcctcaatccggttgcacctattttgcaacttcctgctgatcccaaactttttgcatctgcaaattgtgacagatctgaaaaagaaattgattatgccaagacaaaacaaaccaacatacggaccgtttttttctgtgaaatactgagagtcaaaaaagctggttgtacagcgtggaggtttctttcggctgccttccaaagacagccctaaaccagacccaaatgtccaggcgacgatcccctcgaatggttggctcttggctagccccgaacacaggtcacctggagcaggatcattttttctcgtgctatgttgttggttcagaagactctgcgcgaaggcattgtattcggcagtgccttcttggtttatgaattcgactattcaggtagtcatgccgtgcaaagtatcctgatgcctcgcactccaattttctaccatcatcgatgcctggcgttcctatttgtctaccatcatctttctaggtaactgaatgagtttctctggtttctcgtggccttttttgtagcctatctcgctcactgatgaggctggctgcctgtttcatatttaaggacgcatgctatatgccaaaaactaaaacagtataagctactccctccgtttcaaaatgtttgacaccgttgactttttaatacgtgtttgaccatttgtgttattcaaaaaatttaagtaattatttattttttttcatatcatttgatttattgttaagtatactttcatgtacacatatagttttatatatttcataattttttttaataagacgaacgatcaaacatatgctaaaaagtcaacggtgtgaaatattttaaaacggagggagtattattaacggatgcacatgacaccaccactagcacagaacccaccatccatcacgggtgctaaccctcatctgtgatggataaaagcgtggtcaaggatgtgtggtcgctgatgtaaaaaacccatgcgtaacgtgtgaagatccgacacatttgagtttgacctctaacggtttacatgttaacacccgtcatcgatgtacagtaagtgtgaaaaaaaaaccaaaaatgttaatccttggtctttgatgtcgcattaaacacaatcacaaaaccattagttaggtacatttaattgttcggatctcatattacaatgtaacaaaatctcttgctaaaaagaaaaaaccatctccctcagctgattcacattaatcacaaaaagcaaccctcaaatcatctccccctgttccccacaatcatcaagtaagcagattcacatgtacaaaggcaatacaaatcaaaaaaatgtggacaatagacacaaaattgcaaatgtttagggaagtggggaaaatatttctcacttcagctgcagctacctgcaggtgcttcaaattaatctgtagcgaaacatgggtactacttgcaaacgaatcaagaagatgttctggtgggatgagatggcggcggcagtgtactgtctcggtgagatggatctggccatcctaatcctagcggcgtcggatccaattaagcagcgtgccgatgatgtcaccaaggacttcctgaacaagctggattcatatctttttggaagccacttatggcttttgtgagagttgagtttacaaagaagttcgagtttcgagattagtcaaattttttgagaggagtgcttttattgtactttgtaaaaatgaatagaagtaacaaacttcaatcaactttcgagagttctttgatttgtgtttgctcgtttgcatcgatcacaccggcgagtggatggtggtcagactggcagtttcacgttggttagaccaatggtggttcggcggttagaccggcagcagcggtggtgacaagttttggtcattcagtgtgcacggtcagacccgcccacaaggcttcaccattgttggtatttgttgcatacacaaataaatctgtaaacgcactgataccgccgtaacacttccccttagagtattacaactgtatcgtacacaaggaacgcatgtgtatatctacgaacgagatacaagcattcgatgaacaattactttataaaataagcattcgatgaggtacaagcaagaagaatactaatagctccggcgcttctccggaactccggtggaagaattccgacaaacccgacactcctccgaaagttctcggtgagaactatgatactctggggtactccttccagaacttcccctcactctctcactaacaccacatactaaagcaaagcctaacgcttgagttgatgttgtgtgttttccatgtgagtgaagacctccttttatagtgtgttatgactgttggaatggcgattactcctacgcaaccgcaattgggagagcatcaggaacctacatgtggaaggccaggatgggcggccagtatggttgttcggcattttggccaaactgtgggccccacttgctggctgctccttcggctaggaggctagcagtgggcccctatggtggttaaggatggtgtgttcccactttaggttagttttgactatcatgtgggccctccaatccttgtacttgcgtgtgattggtcggagattcattttgttgcatgttgggtctattttcatccataattgacctgtatacatatatataccaaagctagtggaaatggttattagtaaacccctactactaagtttcgatataaaactttattttgtgtatacatgagttaacgactaaagtttgcactgagtgaccgtcaacaaccagtaaggttgaaggtgtctgtgtggtcagaccgacttgtcaactccggttagaccgatcttcatagttttttgacggtaacttttattttcgctaaaagtttttgatttttggtgttcctaccattcacacctctctagtaggtctagttcttggtattcaatcctacatgcacctgtatggaatcatatatagtgtgctgagaatttaacttacagaagttagattcagataagcatagcaacataatacactgaaaggagatgattttgcaatatattggggatattggttacagagaagaaggaaacaacagaagaaaaatagaatgtttttccttttgaagcaaagaagaacaaatgttagggaaccggacttttactgtgctacttactgtcacctgttcccatggttcacagtatacatatgcgaagtacacagaacaccatggacaaaacatgcactgcacatctattcatcacttcctgccttaacagatcttgtatcccacttaaggtttgtatctattgatgattcgctcatccatttctatctcaggtgcgagtgtctgacagagtgacagcctcaaaaacggtttctctgatcactacgctgatttcatttgggtctgtcaaatggagtgatcagtcggcgtgatgcttaatttcttgatggatcagaagactcggcaggaaccaacacggagctgttccaacactacctgcctttctatgcagccagtgcactgtgatatgccggtaggcacacagtgcaggcaaaatcatgtttagagtaagctccgaccgatatcctgataccttgcattccgaacagtcatcctgcttgtttttcgatctgattgtccatggccatcttttcttgcttatgttatactggctgatgagtgatgaggttgcatggctggctgctatacatatttaacgacagatgctatatgcccaaacagaaaaacactaacttatcattaactcagcggatttttcgtacgaatgttaaatgagagtcgacacctctctttcgcctttctcatttagcaaaggaaagctagctactgcatattaaaactactaaaaatattaagtcccgcctctgaccacccaagacactggcgacttaattaaattggtcataaacgacagatactagaaaatagccatcccatattcatcatggacgaaaagaaaatactgttaatgcagaatataaaatgagcctatgatttgagatatacactatgtgttataaggtagaaaaaaaaatccaaaatgggttggtggtcttgaaattttctatgaaatatagtggctttgacatgtgaatatgccagacagtgtatgctggctgtcaactcacaaaaaattaagaccaccagaccagataaagttgaactatggactatggtaacattggcagcaaaaatgtatggtagtaatagctgtcagataaccttgatcatgctcgacaactggtatttgtgttttgcagctttactcgcttcttcacacgaaaaaaccaacgtagtattgaatgagacatttcctgtacaacaactttgttgttgtttgaacaactgccgcaccatctatgctactgcatgacccccatcctccacttatatatttcttttatccttatattttaaaaaatttaatttcattttacatacaaaattttatgtacttccagggttattttgtaaatttgattttactgtacaactaaaaagcaaagagataataacatctctcgatcttctccttttcgtcaccattcctgtaggctgtagctgttccttttttctctctctctagctgatcattgaagttgaaggagagtccagaggggaggagctttcatgctctgtcaaatcatccggaacctctgtgttttgatgggctctatttttattttactggctcctcttttatttttctatcggatggttaatatccattcgcctattgtttgcttgtgaatccattgactacaaatcaacatatgatgtggctcatctttgtgacatcttggaacttacttttcactaatacaaattagctaccagcctataaacatctatcaatctcagcaaccccatcaatttcaattttcaatggtgaccttctcccattcttagctctgatagagggctcaccaaccatgtcaataaccagagcaaagactcaaaaataaagagctgcatggattgagtgatcatgtccatcccctcaccaaaggaaacaggacacacatgcgcgcattgatgcatttgttctgtgttgggttgcccagcacaatttttcatgctttaatccgttctttcttctcaccaaaggcacggcgatctgcctttgctctgcttcggttgcccagttctaatacctgagccggttttcacttatttttgtatcctggcgtggacgctacgtacaattacagctcaaattacttcggatctttccagaggcatttgggatttcctctaccatatgtggaagatatagaaaaatttcgagaacaaaatcatgtggactatgctattttgcagcaaacaaatcatgcactcctaaaaaacgattttcctggatgaacccctcgtcagattccagacggcccataactgaccgcgtctgaaaaaatcatcctctcatttttgcgtgtagatccttaagatgcacgcacgtgaaaatgattttcgcgggcagttccttaagaggtccacacgcaaaaataagcctatttttacgtgcggacccttgaaaggcccgcacgcgactatcatcttaagagcaccgcgagcgaaaatccccttcctccttaggcattttcccctctcaaccacttcaaaaattctatcttatcgtctccacctactcgttgttatcctatttcttttatctctctctggtctcttctctccacaggcgtggggcacggtgatgggtgcgaggcggccggcggtggccgggaacaaaggcgagcgacaggcgcacggcggcctgcgatggccgacggcggccaggagcggcggcgggcagcggattcgtgcgcacaaccctgtggaggtgcccctcgcccgcccggcataatctggaggcggcgcccctctcccgcatggatccggcggtgggcggcggtgacggggccaggagcggcggaaggcaacggcaaacaacgacaatgacagcggtgaccatgaggtgggcggcggctagggttaggttcttgattttatttttttgcattttttttgtgcgtgcaggcgacataagccaaccgcacgcgaaaatctgatattttcgcgtgcgggtgcgtcacccacatgaaaattttcgtattttcgcagacaccccattgtagacgggcatgagatccgcacgcgaaaatccctttcgaccacacacaaaaatcgttttcgtattagtgatggaaactaattaagatgaggattggtcatccctgatcagtacaattatctcattgttcacgcacgcaagtaaaaagctggacctgcaaatgccatcctggcatcctaccatctgttaactctaaacctatccaaacgtgtccagggacctaatgatggtgacataatgtcccagccctcgaacgatctactagcgtatgcaagccattttgaagcatacaatgatcagggcgcctccactatttgtcttgctggtctagagcactcgataccgagatgttatgctctggcttgaattgaggatgccttattgccttccttcactgcgtgatggaatgttcaggaaggttgccatgtacgtaaaatcaggcctagaataacgtgcagactctccaggctggtgttggtatcctggtgacttccattccaattggctaccatcatattttctaggcaactccgccgatttctctaattgctgctggacttcctctctttttagcccatatagtcgcagaggatagctggctcaggttttgtgccttctactcatttaacctcactggatttttcacattttggtccttttgaaaaacttatttcgcaaatagacccttggaaaaacttatcccagaaatggtcctttttggggccagagtggctggcgccgtcgtccaacttgacggcgctagcctctttggcgccgtccccctgccgacgtggcggggcgatgctaaggtggctagggggagcgcgtcagaatggctagcgccgtccccccccccccccgaaattttttatttttcttttatttgtttaatatttttttcattcttagggacacacaagaaccaaccatagaaaaaatgaacccaaatggacgtaatatgtgacctgtaaaatttttcctctcctatcctctctttccgaactagtgcagaggagagagatgtgcaacttttttatttttattttatttttttgatatttttttcacacttaggaactcacaagaaccaaccatataaaaaataaacccaaacggatgaaatatgtggcatgtggaattttccaaagctctaccgaaaaacttctctcctcgaaaacacaatcttgcaagcggaatttggaggttttaatattgctgaactttttatgtagatgtacgtggatatattatttgcctgatttcgagtccatatgagaaagttacgcctattttaataaatgacacatgaatgacttttcgggagagctttggaaaattctagaagtcacatattttatccgtttaagtttattttttctacggttggttcctgtattctcctaagtgtgaaaaaatatcaaaaaataaaataaaaataaaaaactacatcatttcatgtggttagagattaagtaatttcatatagtggtagagtgattatgtttaacatgctaaaggagttatggtttaattttaatgaaggtgcaaagtaggctaagtggtatactattttcggatatctagctaaatggtatattccgttcgagtttaattttttttctctggtagttggttgtatcgtgatcttaagtgcgaaaaaacattggaaaaaataaaacaaaaataaaaatgttgcaactctatatagagaaacaggaatggaggcgaggggtggggcggaggggggcgg

SEQ ID NO: 67108 - DNA, 9437 bp, Oryza sativa
ccgtcccgttggacgacggcgccagccactgtggcgccccaaaaaggaatatttctgggataagtttttccaagggtctatttgcgaaataagttttttaaaaggaccaaaatgtgaaaaatccagtttaacctcagctgctctggggggaaatggtacacatgtcaattttgcgtcttccgcctatccgacggtgacggatgaggtgaaaagagccaaatgcacatagggaagtgggtctcacatgtcatctccatccatcatcttctttgctctcccaccatctctttctttacccagaaaaggatgctccatacagctcattagctaaaaggattttcagtagtaaagttgcatggaatggagaaccattttcctttatcactaaggaaaggattgacacatgataccagtagtgaaaaataactagttcacccggaatatttgacgtttaggataagatttgatcaaaatcttttataacttttattatttgacaagagattggtagtttgtgtcaagagcagaatgaaactaagtaagaagaatagaagtttgtggaaccggttaatactttttccatttattggatgattttaatcctctatccagtgcagtgccacctgggtccaatcgttcatggaacatgtaacaaagcacacaacacgcaacaaactaatcaagcacgctgttcatctcttcctctcttcattgttctcactagaggcttgtacatattgctgcttctctcgcccttctctatgatcacgtgatatgcagtaaaagtcccaaaactccccattctctttgtgtttcagaagactcagggcagatcaacatagaactgctctagtcgccaatactgttggcccaaaaccgagagacgttagcccaacctggtgaaaaccttgctacactctaaaaggtagcttaagaggtgagggactcccctcacttacttttaagttgattcaactccccatagataagcaatgtgggactattcccaacaaatacctccacggtgtctgcattgtgatgttaagctaggcacactgtgtaggtaaaacacaggtcttgcataaagctcaatttctcgtacagtaaaaaacttctcaagggaatggcccctggcccagatttccatataaaggatacggcgaggaaaaaaaccttctttaacctgaattctaattgattggatatcctgcataaggaatcgaaggaagacccaacgaaaaatgcacactactcccacttttctatcaaatcggtcataagcactacctatattccacaaaatagtgccccacaagtaggatctaataaataggcatgtgattccgtagaaagacatcacgaccccctatgaaaagaaaagccagctccggttggtgtcctgatgccttgcattccaattggctaccatcagttatctaggcaactcgttacaggctgctaagactggctgccccctgcttatttaaccgtagttgctatatgcaacaaaaaataaatatgtgtgcattgttgactacaacaacttcgcattgattcgtgttggtgtatgtgtgcctttgtaatgctgccctgaagatgtttgcctggacaatttagaagtatcgtacatagacttaatattatttataagttctcatagatgtttagttccaatctcatgcagtgatggattttttttttaaggggacgggtagggagctcctacaatttcactatagaagaagggagatctgaggatgatgggtcccatggctacacccctagtccgactcctgcgaaatctggggcaggttctcacatttctccatggggagaacaccctccttgcgatttccagtactgcggcgaaatcggggatgaccgccaggaggaagaaaaagaaagggaaggttgtacaagtcgcccgcggcttttcagactatatagtgcaacttgtctccctagctctcttcttttctcagaactagtctgctggtcgactagaaaacacgtgttatatataagtccggatattcttccggttagttctgactcctctaataggtgtgttgcatgctacttaattacataatactgtgccatggtaaattaaaccggcaatactagtacacaaaataactaggagattttcagggattggatgaatcgagggcttttacttgcatgtgaactctgctggacaagagttaatttaattgttttgggatgatgtattagtcgatcctgtcagattaaatgggggaataatgaaggtgcacagtgattcgatggctagcttttctgagaattatggtgcaactgagccgttaatcctgtcaataagtttcgcattggtgagctgcatgcatcagccagttcaggggaaagtttaaaccaatggagaataacatagttcatttatactctaatagatgcaagcaggcaatgtatgcgtaagcttttttaagatgttaacttttgtaaaaaatataacggaacctttattgatcattgttggagatagatcgtagccagtagcccaccctttggctgtgttctttccccaattttcccaacccacctgtctcgttttccgcgcgcacgcttttcagttgcttaaaaaatcatattaatctactttttaaaaattagttaatacaacattaatcatgtaataaaacgagcttcgttttgcgtgccggacggaggggttgccaaccactcctcccaaacgcagcctttatattgggacgaatcatgaacagagtggatggcaaaacaagaaaatactagtgatgccaagatggcaaagcacgccgaaggcgatgggaccactcctatctaaacttgtccaaaaaggcttaaaagtacagtttgtccgagtgaagggacaattatggaaactactactagtaagatcactttaaacctcacgatagtttggatgttaactacctgtaattaattattaaaagaaaatgacaataaataagatgtcctagtgagttacaatcacaagcgatctctattcaaattttggacttgtctaacatgtcactagacccatgtgatagcaggtcacgctttcacggttcatattcgtactagaaatcagaatcaaacgagcttttatccttttattccacatgagatttctattctcgttgagctcatcttagggcacctgcgttatcttttaacagatatgccgcccctgccaaactccccacctgacaatgtcttccgcccgagagcttccacttatcctacacctctcaagtcatttcacaaagtcggactagagtcaagctcaacagggtcttcttttcccgctgattccgccaagcccattatcttcgctgtggtttcgcgggatagtagacagggacagtgggaatctcgttaaccattcatgggcgtcattaattagtgtcatagggcctgttcactttgatgccaaaaaaaaccttaccaaattttgataattttggtaggatttcttatatagttaccacaatttggcagcaaactaaatgtagccacttttttggcaactttaccaaaatttggtaaggttggaaatggcatcaaagtgaacaggcccatagttactcccgccgattacccgcacttggttgaatttcttcactttgacattcagagatctgggcataaattacattgcgtcagcatccgcgaggaccatcgcaatgctttattttaattaaacagtcggattccccttgtccgtactagttctgagtcggttgttcgacgcccggcgaaggcccccgaagggggccgttcccggtccgtcccctggccggcacgtggcggatcgatctcatggcaggatggacagacagtaacttgggcttcgtggcattgagtccagcaggctgtacgtgttctaatttctatcccagcgctagagattgccatttgaatggcaatccgagttcacaaaccctttttctcagctgtctcacttatggtggcaaatattcctagctcaccaccgctgatggacatgtaaacattggtaaacatggtctggatactctgtatattaggaacgaaattcctgataccttctattccatgcatacagctgcaactaccacgtatcatttggcatcggcgtcttatctcattgacctctcggcatattcaagggctcaataacatgatcttggtgggattggtgcgtcgggtacttatgcatatgaaaattgagttggtcatgatggacatgatgaaaatacaattaatgcacatgcattattccaggaataggaagtacattgctgtcacaattcatggtgtgaaatatatatacgcgtatgtgcagtatatagagctctccaaacatgtgaaatattcatctggtcctatttacaggctaaagcttagtaatagctactaaattttgtttttccttcacttaattatgatacaaattttaggagcacacctgttatttgcattcacctagtatataaatatatactacctccgtcccaataattgtatttctaggatttaaatttgtcccaaaatagttgtcacaatagagtagtaattgtctcattaatcacttcccattcaaatttctccctattttaccctcaaccacctttccacttttatctatacaccatttaacgagggacatcatagtctttcttctcaaaccttaatatatgccaaataacctagaattacaattattttgggacggaggtagtatgtcctactagatgtaacgggctaggtctacggcgaagtgatcaccacaccgagatatcttccaagtgatggtagtgtcaaagagttatttaatggtaaagaggcttcctcaatttaaattgagggctagtagggccatcctccaacaaatattattcaatagatggtttatatatatggttcgagataacgttggcaaaatcctatatatgccatgaaacacctcatctgtgacatatgacaaccctcatttgtgatgggattttggtttcgatgtagatcttatgacttataatgcatatatatttgtggatgtaaacgatctctaataaaaaagttgtcagctataagattgtatatatcattttgatctacaactttaatatatcacatgtctccatctgtgattgtttgcaaaattgaaaattttgaattttcagtcattagtaatgtgtcgtaactaccaaatgttgggtggtagttacgacccatcacgaatgagtgactcgtttatggttcatagaaattatctgttacaagttacaactacgctcacgtatgtagtgagttgtaccaagtagccacattttaaatgagttaattttcgacctgttaaagataagttatctgaaaacctgttatatatggaaccaggatctgtgatagaaatgagcataaggtaattcaaatcatgttattacttagaaccctaccgtacagatttcttccccttaattactactccctctgtcccaaaatataagcgtttttagaccttgacacaatattcgagatgctactttgaccaacaatatctataaaagtaggaaaaagtacgaattacccccctcaactatcgtggtctatggaattatacccctaaactgaaataacagacattttacaccctaaagtattcataccggacaaacaacccccctcaacactattttgagtggttttcacttgagcttgcacacgtggcgccaacgtggcaacccagtcagcaaaaaaaaactccctgggcccacctgtcatgcccatccgctcggacggccggctgccaaggaggaggcgcacgcattggatggccggtggcagaggcggagctcgcccgagcgtccggctgcggaggtggagattgcccgcaccacgagcggctgaggcgaagctcgcccgtgcgaccagcggcggatgaggcggaccgggtggccaacggtgggcgactgagatagagatcccctgggcagcgggcgactaaggcggaacatgaccaggcggccggtgttggacgtggagcacgcccaggtggtgaccgactgaggcggagctcaccttgaggccggcagcagaggtggagattgctcgagaggcaggctgcttaggcggaactcccccgggcgtccagcggcggaggcggagagggacctagcttccgccagcgttggtggtgctggtgctgcgtgggacagagagctcacgctcccacaaaggtgacggccctccccttcgtgctcaccgcctgccctcccgccacgcctaccacccgccctcccccattgcgaccttgtctgtccggaccaccgccgacgtcgtcgccttctcctcccagaccgccgccgtctcctcttccccgcccaccgcctccgcactgcaggaaaggggagggagtcgaaagagaaggagaggggaaagggatgatcagcggtggcggccctcctcactgccatccacctcctgtgcggctccatctcgtgcgtcgccgccgtggacgtggccaccgaccctcgtgcgtagcatccgtgatcgcagccggccctccccgccgcatccgcagtcgccgcccaccctctgcgccgcgcccatcgcgcccctagcggtagagagagaaaagacacagaggggtagggtatgactatgggcccatagttttttattattatttttttggaattctgcattggctccacatgtatgccacattggattaaaaccagtccggattgaacaagggggtaatttgtccggtttcaatagtttggggtatcaaatatctggttttgtgggtaattcgtactgtcatgattgttcagtgggtaattcgtactttttctataaaagtaatatgttataaataaaatgagttgcatattacaatactttgtttaatgataaattaagagacataaaatttacatgattgatgatccttttgtttgttttgctattaatagtcaaagtaaaatatatttgacttgacactgctaaaagtgtttatattttatgatggagggagtaggtgattaaatttctcatgaagccgccgtcactgcgacggtgtgctctggcagggcgcaccctggttggccaactagcagctaaggtagcgcacggaaagctatccccgttgagaggtagtgaacgctgaacagtttccttcttctcgctgcatggagccgatttggtctccatcactaaaacttcattgcaactggtacatggaataatctgattctcaaaactcaaattgtaaaagttcagatgcagtgatagaataatttgatttcacctagagaaaaatacatccaaacacaaaaaaaaagtaattaactactcatttacaaaaatgtttaacaaccgattgatggtcatccctcgcgtgactcagcattctattcaacctgtgcccttgaaatgcttcacgtagtaccgacaccgtcaggccccactggttaatattacttaccacgaaaaacttctttatccgggcgatccatatatgctgagttggtgaattaattagcatcataacaggatgcaactcatggctggtcatcggcacagacaacttataatgtttgcccgtgcagttttgatcgcacgacggaaatataggtgcaccatccgtggtaaagaaggtatacatcgacaccctagctaaccaagcacgagctgtatccccaaggccttccattccaatttgagcaacccagtaaatttgccctgtgaggtatcatcaaccagtctaatataaaacgcatgacgttttgcgagggtatggtttgattggttgtgttctctgccatcgagctgccaatgtcgtctggtggtggctgctacttttatgcagttaggcatcgatctgcattctgtctcactctctctgaagcaaatgcttattgggcgcaaatagctagagtatggatgcattcctttattgcggttggcctctgatttattactagtgtttgtgcacgtactctctccatctcataaaaaaccaacatattattatattcgacacatcatattactacgaacctgaacatatatctgtccagagttgttctattagaatgtgtcatatctagttatagatacgttttatgtgggacggagggagcatattacatccggacatccagtcattgacagggatcggtccctagttaattaatatatatgtgtttgtgcacatgtattaattcgatcagggctcacactgaggccaagtttagttccaaattttttttttcaaacttccaacttttccatcacatcaaaactttcctacacacacaaacttttaactttttcgtcacatcgttacaatttcaaccaaacttacaattttggcgtgaactaaacgcaccctgagttataaggattgtattgggctacagtgcacagtcctttccactgtccaactcaactatttttatttgttagcctaaacatatatacaaaatttctttcaaccttttggcattttttcccccaaccataagaatttctgggctaaaagcttagacccatcaattaccaggtctgcactgagtggatgtttcacacaagtaaccatgatgcacgtataatttgttctaaacagagcacatatgcaaaatgtatatactcaagaattaaagatcaaataaattgcagtgaaaagaatcagtggacaatgaaaaagttaccaaataattgcttccctcatatggtaccggtgacataactagacgaaaatatggaaatgcccaaagaaaactaaaagttgtgacgaagttacaataacattggaacattatatgtacatgccaatgtgactgtcgaactaataaaaatcaggtggctgacgagcaaaacagatatataacgtcaacaaatacgatggtagaatattatgtcgggatagtaaggctagctagtgtcacgaaccaagcaccacccaaccaattctcaatgcacagaggcctcaatagattgcaactgctcaaatacaagtgttttgggatacaaattgaggagaaagagaggtatagactgggaagagagatcagacaaagaggaagcaggagattgggactagagaataggaattgagagggaaggtagcagcaagaaggaagaagccagtttcatccaatctgttcgatccttctccaactaccagttgcctcttatatcagtttcccttccagccatttaggcctaggcctgcccttgatgcccggcccaggaaccctgtaaggcccatatcgtgacagctagcttcctcgattggggaaatatttatgtgcataaaatataattggggcaaatatttatgtgcaagcgaacaatcacaagtaggggtactgaggagaattctgaactatatggcagagaccctcatctttgtttgcccttct

SEQ ID NO: 67109 - DNA, 11403 bp, Oryza sativa
catgcaaatatcttgcccaaaatttcctcttcttttattgaattcggtaaaagaaatgttcaaatttagtcaaaattttgcaaaattttaaagtactttggtgcagtaaagttccaaaaattttgaaaatattggtgaaaaatcagaactttcagaacatttgtgaaaaataaaagtgtaaacctccatgatacactgtatcgacatagaatttagtcaagcgatccgcgtgtgagcttggaacgcagctgatgtcactctaaattttttggtacagtctattcctatactccatccattccgtaaaggccaatctgaaatataatatgacatttttctagtagaatgaatctgaacataccatgtctagatcttcattacactagaaaacatcacatgttatccttggttggttttcatgtgaccgagtgagtactccactactttgccacatggctactcatgtttgcttcattgcttgtaataacatggatagtacatctacaactaccacatcgtcaaagatagtcagacagacagtctaaacatgataatggcattgatcgtgataaaactgatgattcggtcgacttctgccattagttttgaaagaagatgaaaatcatcaaacgaaaaggtcctatataccatcaagcatctcgaagcagcaactgaaggacaaccaatggagcagcaaggccaagcgtttgcagaactccaccaccttccagcatgttcattggagcagacgctacccgaaggatctcgtgggtttggctacctgcgagaataagaatcactatcttgctggcctctgtagcttgctacaatttctagtaatggaccatcacaattagtgcgaaacaaggtgcagagttggatggaacagtgatacctcgtgcgtctcaaattcctcataccttccattccgactggctgtaaagagagccggcgtactgtgcaatgaatcgtatacaaattaaaggatcaagcaaactggccaactgtatgtatatgagtttgcttggaaacctagctggtgcttttgggatagtaaccatcttttgtttagtcaggtcacgcagctggggccgaatgagctcaaataggcgttctgtgtcagaaaaaaaaaagattgtagcgcccgttccgtcgtggcgcctagcgggaaaattatctcttcaaaaccctaattgcgaaatttgattctttgcttgttgtctagagtccgtgccatctcaagatctcaaatccccgatctatcgtctagttcaattccgactccaaatccttccaaatcaaagtccctccgcaaaagtctattttgcctcccccgggttcgatgggccgaatctctctcggcccatctccccctccctcccggcgctctctctctctctctctcgctctctccctctctcccaccccctccgctccgccgcgcgccgcgcgcgcgagcgcgtgagccgcgccgacccgagccctcctctccgctccctcgctcccgctccccgtgcgtcgttcgcgcgcgcgcccgcgtggtcgtcgcccgcatcgtgcctgcgctgtctgcgccgcccggccccgctgcccggccgcgcctgtcgccgcttggcccggcagccagtgcgcgtgcccgagccgcgccactcaatccgccgcgcctcccgttgcatcccgcgcgcgcgtgccgtggtagccgaccgcctggtcgccgccgccatcaccctctgccgcgcctgcccgcgcctgtcgcccgtgtcgccgctccgctccaaaccgccccgccgtcatcgccgtcgtcatcgcctcgaccccgccactccgcgcgcaagccgccaagggacggaggcagagcccccctccctctgccgcgtcgcccccgctcccctcctccttttccccaaagaggcaagggggcaagcccccttttctctccctcttttccttttcccctccccgccggcgtcatccgcctctgtcaccgttttggccgcgagcgccgagcgccagctcgcgccttgaccgcccaaggtcggtttccaaaccgacatcgtcgtcctataaaccaaggcgccctcccatcgatttccccctcccgtttcgctcgccgccaccgcgccattgccgccgccttccgtgctctgtctcgcctccgccgttcatcaccaagcaccgggagaaccggtgcgttcgtggacgcggaaggggactccgggcgcgccctctccttcctcttccccggcccgaggccggagagattactcccgcgccgtcggcctctcgtcactgcgccccgtccgcacggtagtgcctccctccgttcttcctcctcgctccatctctcccccttagttttcggtagtagcatgtgtagcctccccgtagctagtcggcgccgccccgaccgttgccgccgctcgccatgtgctcgccgccgtcgccgcccgtgctccatagcacccgctcgtcgccggcctcgctcggcgtagcgccgcccaatccgacgctagggacggattcccgtagccgcgtagatgctctcaccgccggggattggcccctcgtgacctcgtcgccttttccctcttccctccccgccggttgctgccgccgcaatccgccgtcgacgcactccctccggcgaatccgagccgttggctcgtctcccctagtcctgagcaaccactcggtgtactcgctttcgcctgtaacgccatggttcgctccgccgctcgccgctgtcgtccgccgtccgttacggccggcgtcgtcgtctacctcccgccagcccgcgtggcagccacgtaggcaccacgtcggcgccagctcggccgagattggcccgggccgaccccggtcagcccctcccgtgcgcgcgttccaccgcgagccgtgaggctgcgcgtgggcccgccgcatccgttccaccgtgtccctcccccgtccgcgcgcgtgcgccgcgtgctcgctccgcacggtaaaccaagtcaccgacaagcgggtcccacccgggaccacgcgtggtgagcccggtccaccggctctctccctcctccctcccgcgcgcgcgcgccctgggccgccttgggccgtcttgggccggccagcccatttagctcggccggaccgccccatctctctcgggccgcgccctagccgcccgaggaaaagtctaatttccctccttcttttcttttcttctctattcttttttcaaaaaggatttaattaaatccttttcctttagaccaaaaatccaataatcttagaaattcaatatcttcccaaccgtaaatccatttgactccgttcaacttccaaaattcctcaaatctcgagatctatctaatggcatgcttagaggtcattaatagggctttattttcgctgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaatattatgcattgataggatcgcacttaatctgttgtcccgtctgcaaggcagattggcggacctacctaatttgttgcatttgatccttcctttgttaattgttatatcatgttcccttgtaaccatctagttgcgcctcgatattcgtgcactctgtgcgagtatcgacggtcgccttcaaacttaaaatctgagtaacaacttgggtaaaacttgggttttacaaaagacttggaaaacccgatacctgggtcggtgcttgtgaactaaatgaatttccaaaaccgcagaccggggaacgtaccgggtgtacggttttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctcgcacagtatggtctgggacctaacctgttgttggtctgggacccctctcgtcagcatatggtaaacctgtgtcggctttggaaatgccttgtcatgaaagcttggaggtcttccgacgtggctgatccccacgggctgggtgatccgggttagtaatgtcgtgtgggtaaagtgtaccccctctgcagaggttaacaaactgttcgaacagccgtgcccacggttatgggcggatgtgaggtgattcctagcgtagttttgtttgactactgcttgtgaaattgctgttgtggaaaggggttcgctgtttgaaaaatctgcagctgatgggatcagctaggcccgggtggccgtttgaaagttgttggccggggtggccatttgaaaagctgttggccgggtgccaaccttgattcaagtctaaagactgatacattgcacatactccgaccgggcaagacgcactgtctcaaccgtgtcgtttgagaagcactcacttagttgtttttagaaaagagttcaaataaaatcatctgcaaaaacaacagcctttccttgaagcctgcattaaacacttatttcccttggcttgctgagtactcccgtactcatccttgctctatataaataatcccccctagttgctgaagaagatgaagcggatcctgctgatgaggagttcttccaggagcaagccggctacgatgagttttagggtttcggcctagttcccaagtcacgcctgtgttggttggtcctagtcctggcttccgtttcctttttgtaatgcagttgtgagctcgggatctatccgtagcccaacatgactgtatctctactctataataaagagaccgttgttgctgtgatattctgtctccctgtgataccagcactgtttcctgggactggtatcgatcaacaggttaatttggagcgtcacgggctagttccggtcgggattagttcggggcgtgataagagatggtatcagagcacaggcttggccctagggcgaaacccgacgtttaggacgaccctaaggatactaaattcaaaactacttgcgaaaagctaaggattcttttgttttctttattttcaatagtttgtttctaaaatggttactgatctttctccctctttcaaaattgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactgtgagctctctatgtacctttacccttgtggaggtatacacagagctggccttcgcccacaccacttcactgtggccaggcccactctccagatcgcgtaccaggacctctcctggactgcgcttcgtcgcctggcccacaactacagccaccgtctcgggggctccgccttccggcagcttccacgccttccttctggccacgcagacgccaggtacccttgtccgtacagcgagtctcagccagtgctgactcgcatggttgagctttcggaggctcaggccactcagcacgacctactccttgaggcttaccgctcccttgccctccgctacgccgccttggaggcccgtctggccgaggagggtgtcacctcagttgacactatctcttgggactcaggtcgcctctatcacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccctagttgcttcctcccgccgtggcccacgctttatccgcactgcgcggaagcgtgttgttggttcttctaccgtgttccgattccactacccagctcccccaccgccagcggcccgtgctgctgccggccctcgacaggttccgccggtcccttcgcgtcaaccgatcgacgtttcttcgactgaggagccgaccacaggaggcagccaggccgacgaggagtagaggaggcagtcttcagcagccgtccgtgtgttaggcccttttgttccgccgccaactcttttggagtcgtggcgaggtagtgcgtgcgtgtgtttgatgtgggtgttgattggtagtctggttctcctaggtggtgtgcgcacagtcaagctcagcgtagctctgtgacttgtccacacccgttgtatcaggtgtttttatgatttgaaaaatccagtttatgcctagtgtgtgctatctgacttgctatttactttgctccttgccctcctaagtgcttgtctgactcttacctcgccctcttctgggagtttagatggctagccgcccccgccgtgcagctcgtgcaccagcccgcttcggttttgaagaaggtagagttgagccagaagaaaatcatgagtcagctaatgagcagtctcaccacagcaaccgttcgcaccgtactgcttcccgcaacgcagaagttgagcaaccccgccgcagcaaccgcttgcatcgcacagtttcccgtaatgcagagatggaacagtctcaccgctctcaccgcactgccagtcacaattctggagaagaacgcctcccttccccacctcatgtggaaaacaacatgcagcacctgatggcggttcagacacaaatcttgcaaggattagccgcagccgtagccagttttcagcataatgcgcatggaaatggccaccctcacatgagcaacaatagatccaagctgacagattttctgaggtctcgtccggcagagttctctcagaccgtcgagcccgtcgaggctgaaagatgttgatagaaaactcaacttagtacagtgtactcctgttgagaagacgctctacgcctctcaccagctaagaggacctgctacagattggtgggagaattactgcaatgcacaccctgaacccactaacattgcttgggatgagtttgcgacggctttccgtgcagctcatgtacctgaaagcaccattgatatgaagaaagaggaatttaacaggcttaagcaaggcaacaacagtgtcaatgagtacctaagtcagttcaacaaattggctcggtatgcccctgaggaagtggacacagacaagaagaagatcaagaagttcttgaagggaatcgcagttggaatgagactccagttgcttgctcatgacttccccacttttcaacatatgatcaataaggcacttctacttgaggatgccagaaaagaggctaccgaagaatacaagaaacgcaagtctaaccatcagggaaattcttcccgaggcgcacctcgccctcgctatggtcaacccatgcaatatcaccaatcggtcactcaggctaaccgccagccaggctacgcccctcgtcctcagatgaaccgtccggcaccccagccacagcagtgtgcccctagtggcaatactgcgccaaacagtgttacctctttcaagtcaccgcagggaccgtcagcagttcagtgtttccggtgcaaccagatgggtcactatgctagacagtgccctcagaatcctaccaacaccaactcagggcatgctaatggcagcactgccaggactcctactccagcggcagctcagtctcgtcctagctctcaggcaagtggacaaggttcacgtgcttccaacaactttggtcgaggccgggtgaaccacattcaagctgagaccgctcaggatgctccagacgttgtgatgggtatgttctctgtcaactccgtacccgcaatagttctgtttgattcgggagcttcccattctttcatatcacaagcttttgtgaaaagaaatggttggaaaacccaaaatttacgtgtaccaatgatagtactttcccctgggaggaatataagggcgactcgaatatgcccggaagttaaccatagaattgaggaagttgacttcctagccaaaccgatagtcctagactcacaaagcttggacatcatcctagggatggattggttggctaagcacaaaggacagatagatcgtgccgaaaagtccatcaccttgcaaggacctggaggaaagcaagtccgctttacctctaacacccctaccgcaagtcggtctatcctaacctgtttacaagtcaccaccttggagtcggtgcccatagtctgtgaatatcccgacgtatttccagaagaattaacgagtatgccaccagaccgagagattgagttcgccatagaactggcgccaagcactgcaccaattgcaaaaagaccataccgaatggcagctaatgagttagcagaagttaaaagacaaatcgaagagttggagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttgttcgatcaacttaaaggagcaagagttttctctaaaattgacttgagatcaggttaccaccaactgaaaatcagaactgaagatatcccgaagaccgctttctcaacgcgttatggtctatacgagttcacagtgatgtccttcggactcaccaatgccccagcattcttcatgaacttaatgaacaaaatctttatggaatacctggaccagtttgtcgtggtgttcatcgatgacatcctgatatactccaagaatgaggaagaacatgttgaacacctgaggctgataatggaaaagctcagagatcatcaactattcgctaaattctcgaaatgcgaattctggttagaccgagtagcatttcttggactcgtgatctccttcaacggtgtcgaagtagatcccagcaaggttgaagctgtacttgcttggaacccgcccaagaatgtgtcagagattcgcagcttccttggcttaactggatattatcgaagattcattgaaggattctctaagctagccagacctatgaccgagctgttaaagaaggaaaagaaatttcactggtctgcagcctgtgaagacagttttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagcttaggcctcatgaagtcaattatcccacccatgatctcgagttggcagccgtggttcatgctcttaagatctggaggcactatttaatcgggaacagatgtgaagtatacaccgatcacaaaagttttaagtacatcttcactcagaccgagttaaatatgaggcagagaagatggttggaactaatcaaggattacgatcttggaattcataccaccccggtaaagctaatgtggtcgctgatgcgctaagtcgcaaggcctattgcaatgtagctcaaatacggcctgaccaagatcgcctgtgcagagaattggagaagttgaggctgatcatggtacagtcaggtgtccctgccagcttgacagtacagcctaccctagagtcgcaaatccgagaagctcagaaagacgacgaagggataaaggagttaacaaaaagaatacaagagaagaaagacaccgatttgtccatagacgaccaaggcacagtttggtgcggtccacgcatctgtgtaccggccaaaaaggagttaagagatctcatcctaaaagaagctcatgagtccgcctactccattcatccaggaagtacgaagatgtaccaagatatcaaggcatacttctggtgggctggaatgaagcgagatgtcgcagaatacgtagccttgtgtgacatttgccaaagagttaaggcagaacatcagaggccagctggtctgctgcaacccctaccgattcccgagtggaaatgggaagagatcggaatggatttcatcaccggtttgccaagaacccctagcgggtacgactccatctgggtaatcgtggaccgactcacaaaatcagctcatttcgtaccagtgaaaaccacctttgatggaaagaaactagcagaactctaaatgacccatgtcgtatgtagatttggctgtcccaagaaaattgtgtcagaccgaggcactcagttcacctcaaggttctggaagcagttgcatgaagccctcggaaccgatctaaattttagtacggcctaccatccgcagaccgatggttagacagaaagggtaaaccaaatcctagaagacatgctacgtgcatgtgccctggatttcgaaggcacttgggatcgttgtttgccgtatgctgagttctcatacaacaacagttatcaggccagcattcagatgtcgccaaatgaggcaatgttcggaagaaagtgccgcactccctagtgctggaatgaggtgggcgaagcgctggtattcggtcctgacatactcaagtcagcagaagaacaagttaagctaatccgagaacgtttaaagacagcgcagaaccgtcagaaaaattacgctgacaatcggaggcgtgaccttgagttcgaaaaaggagatcatgtatacctgcgggtatcacccctccgtggtatgaggaggtttgggatgtccggcaagttagcaccccgctacattggcccctacctcataactgccagacgtggcgaagtggcttatcagctcgagttacctgaaggtctcgcagatgtgcacaacgtgttccacgtatcccagttaaagaaatgtcttcgagttccagaagagcaagtcctcctgggtaatatcgagctggaaaagaatctgacctacaaggaaagaccgatcaaggttcttgaagaggcagaacgtcagactcgaaggaagaccaccaagttctacaaagtccaatggagcaaccattctgaagatgaggcaacctgggagcgagaagatcttctccgtgcagagttcccggagctgctcccctaggtgctgaatctcggggtcgagattcttgttaggggggttggtctgtagcgcccgttccgtcgtggcgcctagcgggaaaattatctcttgaaaaccctaattgcgaaatttgattctttgcttgttgtctagagtccgtgccatctcaagatctcaaatccccgatctatcgtcgagttcaattctgactccaaatccttccaaatcaaagtccctccgtaaaagtctattttacctctcccgggttcgatgggccg

SEQ ID NO: 67110 - DNA, 1358 bp, Oryza sativa
gttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcacactccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatttcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgggttgacctcctccacagaagtctcgtttacttcagcacttggtccctcgccatcatccatgttcatctgcacacttggatccttcgggtgaacaaacggaaccaaagctagaggccacccgcgttgcaatgcattttccaaataccatctccacactcgagagttttgaactggcattagttccgaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggcccataacggacgtttcctggtccatggtaaacttgaaatatttgtttgttcgacatatctgtcaacgaaataactagatcatattactctttcatgcaataaacatctacaacgtaatatcttcttgtgtaagccaatgcaacggtaatgaattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaattagcgtctgaatccggcagggcttcgccccttcttctcttctcctcccctctcttcttttttttttcactggaattgaggagagaagaatgagggctgggggctgg

SEQ ID NO: 67111 - DNA, 12326 bp, Oryza sativa
tttataaaactggaactcaggaaggctttatttcctcaattgcatcaaatactcgtcttcaagaaacactagaaggatgattcttttcagtagaacatgaggttagtagtactatgttttctcctttagtattaataatatgtgtataaaataacacattcaagttatatagttgattgaaaatatgctttgtttatattagttatatgaaatttccaaaatttagggcgtatttctttcaggggccgcaaattcctggagacggccctgatgagtgcatctgtgctggatgagaatgacacgttcatatccattggatttccatgaacccttgccatgtcatcatttcagatagattcggatcggatcgaattgtatattttccgaaatttattagctcttctatgttacgatgacatggacaatggtaattaatagctgtctaaaaaactggcaatcctaccaatctgttgatgtgaaggacttaacaaatatttattgtgagcactcctagcacaagttaaaattgaatattgatgtacgatggcaaggatgaaagaaattgtagaaaaatgatttagtcaattattgttttaaaggaatatcctctagacgatgtatattccaaggtgtgacttgccattagtaatttagtatcttttactgtatgtctgtatagttcatgcgcacaaacttggtgaatgagttaaacgggaccaaacaactttaagcagagcaaatgcatgcatgttctgttgacagcatattacatgcattgtgcttttcatgaatcgcagaggagtgaatgcatttgatgcagctctctgtgttgacatcatcctttggtgtaagctatgagcctcacaatgagacacagatactgtaattagataagtagcagttagaaaccacaaatggattgccagatgacggagcacacatccacaattttttagggtataactggcgggtattatcagggaaatcgcttgagttgcttacatacgtggcgctgcctagtaggaatggaaggaatcaggcatatctccttgtgctatcttggacgtcacagtgcatccgagctgaaatcggcaagaacaagcatcgcatgggtctctaatgtagttagattcattgtcttttacacctatcccgagaggatatcagaagaatcaagatcgaccatagttgttggtgcattagttgaaggtgtatttatttatgtgaaatcagattactttgagaatggaactaaactttcaccacttgaaaattatattgttttgaatgtggaattcttacatgtctacatgttacaatacagtttcaccccaagagcagatggacaatatataatacatgggccatatgggcagtaccattgaccaaactatgacacgaggtataaaatttgttgaacctggataaatcaatccatgctatacaactacttgcacagcttctcggactgggagacagcaggaacgactctatccaagagtgcagaacatgaaagtggtgctgctcatgcactagtgctatgggatatctggtgatcggtctgcctctgccctcgatctgctttcagttaccttcagaagctagcaacttaattctgctagaaatatggcacctcccaaaagttgggttgttgtcgtgctttggggcgaggaattgaaccagaccatagaaacgtctagctgcagcctgtattgaagtgcagtagagatggattacatcaaatatgtatgcaaggattaattgatgaaatcactatgttcccccaactacagtaccgtgttataactgtttagtcactcttaaagattacgcagtagtatatgtatatattatctgcgaacgaccaaatatttagcaacatggatgcatttcggctacattagttttcatgtatttgctgctgattctttactaaccattccaaaaccgtgatagctgacaataaatttctgttgttaaatatgtagcatgcacctatttgagcccatcagacttagctagtagagtgcactgcgacacaaaccatgcatcactatgcaagttagctttaaaaggtggagcccaggagcaacagagtgcaactgcatacctgttcttaattatgtggaaggccctacacttgcaaagcaatcaatgaatctgaaatattttagttagtgttataaaactagtatgaaatcaccatcggaaaacaaacgcaagagaaataccataggatatccaaacatgatgatgacaccgaggcacaatatttgttaacgaggttcagccgaaacttgcatctctggggcactggttacaggcagtcctcccggaccagcatattacaatgtattagagtcacaatgactcgttgtcggacaccgccggctgtcgctccctctcgctatgctaagtcgccatatggttataacaagtccacccctatatttaagagatattctaagatggagtccgctctttctctagtcctactacctgttacaactctaggtgctaaattgtaaccgactttgtatacatattcgacacaaactctagcatagattcgtgagagggttgcacgacaacaggatgatataaattgcttgatgaattagtagatattcaaccaatgtatactgcaacacttgcctggcttctcggaatggaaggcatctgggatttgagatgcagtacacaactcttccatcaaccatcaacctgagcagcggcagcttgtacccatcactatgtaagaagagctaaccaaaaatatggtcttcctcttcgtccatcagatcaagagcttgaaacatgagtgagtccaccctctcgttatctctctataccaccagaagctgaggtgagaaagctgcagacggaaaactgcatgaagtgtggcacaaagtggataattagaccaaaatttacatgtaatggttgatggtctcagcttctttcgacgaactcttaggctatgcaaaaaatgactaacgatcgttagcaatattgagcagaccactagggccaatccatttcacgatctcctcaactgttattatgcacgcctggtagttttttttaaaataaaaatgaaccacacgtgatggtgcaatgtgtcatattgatatagcagaaaaaattataagactgtgacacatcgcccattgcgagagatggacaaaaatatggcattccacgacgctcgaaaccatccaatttgtttacgagggagagggcaagagagaaggatatatccacaccccgtgtgtagtcctgccagcgtggtttgtggtggatagaaaagcaccaccgcaggagttaacagactgctagagaagaggtttgtgggggaggaccttcaaacgacacctccaaccaggatgtgacgctgaaggcactgccgttgtctaaatagaagccaggacaaagttttctctacaacgatttctcggaagggaagaagacaccacgatgacgcctccaaggaggttgcagcgcctgaaagtgctgcccctgctggccctgaaacggactaggccttcgcccggagaaactcatgccctcccgtgcaacatccacatcgcccccaacagccaccactatccaagactagtttgacgtgtgttaccattgcaccagcaccacaccactaactggccaccatgctggaggttcctttctgaggaagggccggtgtccggcacgccatcactgtagcactgccattccccaccaccacctacaccggagcccggagccatcgccatagaggaaagttgccacaatcaacaccacacaagtgagcactacagccacaccctcccaacagcataggccactgtcgtcgtcccgtcagcaagagaggaaggttgtgggggtggggcgaggactgccaccttgccaccacacctggacggcactccagcggcccctcacccctcccccaccaccattgtgcatattcgtcgagctgatcgctgcggaacgccggatccaagctaccttgtatgaggagagtggccaccgtcgctgccacacacggaagtgttgcagccgctcctccaaacccacgatcattggagatgaccacgtcacgccatgccatcatcgctgctcctcgatgtttgttgtctgtagaagtcgttgccgagccgaaactggcacaggaaagtgctggatgcagtctcgaggtcactggattcagcagcccctgccgccacgtccacatcctccactctgctgctccatacatcgcaacctccaccttgcgctggccagcctctcctctacccagccacctttgcctatcttttctccgtatcgctgtatgccggtccagctaggggtggcctagatctgggtggcacttcttcccccttcctggtagccttatcgctcggtctagtatggcatcgttagggaaggaagaaccctccactgccaaccttgcagccccgtggcttgatgtcgggccattcgggcggcaacgaggtggaggagaggattgggggtagggtgcggcgcttgctgagcggagtatagcttggtggctgctatactggggtgagattaggtgttgtcaggattacaagtccgctaactacactaactaactaacttccagcccattaagcctgccttagcatgctttcttcactcttatagtgtgagagctgagaacccattgttaatgaatctgatgtacctactcctgctgaaccagctctgattatgactgggttgtgctttttcttaccgagagaaagtgctcttcaataagtagcaggcaaccatttggggccatcagtctgcagcaactccatagagcgcaggacattgcaaccagacacctaatacagcccaaaataatgtctcccctagtttacgttcacgatgacagcggttccactgaccacatctgatacaaccaaaaattatgtcactggcattcaaatctgcgctagtataaacacattcagttgctatatcatctatgtttggaaagttctacgagtctagttttcaacacaacaaatggtatatcatttgtactcccgagtaaggagttatcatttgtatttccaccaactacaatacggtgttaaaaccgtttagtcactcttaatgaataagtatagtagtatatatatctatatcttcgaataaccaagtatttagcaacatggatatacatttctgctacattttttttcatgtatctgttgctgattttacttatcatcaaaaatccttgatagctgacaagacattctgttgttaatttcagtgtcattatcgttaaagtaatactacgagtcgaaatattaagtgtccagcaggagaggaggtaccaaaatcatgtacgcccattggaacccatccgacggctgacgaacgtcggtaccgcgaggtaccgtaatgccgatgggcggtacctcccctccatccgtgttgtgctgattaagtggaagggcaaatctggaatttcgcatcgtacatccgtttctgaagctcgctccttcagatccatctacgccagtcctacaccgcggtggcgtcgcggcccttcctccacctccactctccccctgcgtccccactccccaagtccccaggccagatccggccgccatcgactttggggcagcgtatctggacaaggacggcgacgggaatatctcctcgagctcgtgggcaggcaaacaacgaccacaacgaagatgcggcgccaaggcggcgagctcagccggcgtatgcggcggacccctgggtgacagtgacctcggggtggtgggctgatgtgggggatgcggcaacctctcagatggcggcggtggcggcgatcgggcagaacctcttgaccaccctcccctggtccccccactactagaatagtgaatgtcaacgaccaaaaattaacgatggctgcataatcttggtcgttgatactgctttgggtcgatttctggtatccgacgacgctagttttttgtggtcgctagtgcgtagtgggctgaggtcgttgttgttatttactcaggttggatgggcaattgcaaatggtcgttattactcagcgacctgtgtcctcagctctccggccattgccgccgccgccgccctcggcttcagccactgccgccgccgctgccctcggcttcggccaccgccttcgattcgctccacagctgcaagcctgcagctgctgcccgtgctccctataactttgctctttgctgctctttgccacacaaaggaggtagcggcacagcgggaggaagaatccccatcattggcataggaaaagtctatcagatcccctccaatccgctgctcccttccaattcctaaatcccctcttttccctaaacatatttcgccccaaatcaatatgaatcaacagtttttgattccaaatccgagatcccctctgctacccccacatatttcgccccaaatcagtataaatcatgaggttgagagatgagaggagtgttgattcaccgccatgtctcgcagccgcagtttatcaccggaggtgacaactaggggctgcatcgaatggcctacatggtctcctcagggctcccaaatgtcaatcctccccaccactgaacatcttgatgccaagctcctccatgagtacatctttccacctgatctgcccagccactctgttatttgttccagttcacttgggactcatcaatcgacgaaaatagtcacaacaggtattctccaatctcctaatgtaaacatttgcatatgatttgtgaaacatattgaattatgtgctaggttaaatgttaaatcttgccaggttaaagtgttggttgtattgtcctcttcgaaactaataaaagctgcaaagtttgcttggtggatactgattatttctatgctgccctcaacctgaaatgtttgatatggtcctgacaatttatttttgtggtagctatggcactttcattagcattaggctgtgtttagttggatccaaagtttggattttggttgaaattggagatgatgtgactgaaaagttgtgtgtgtatgacatgttgatgtgatggaaaaggactgaagtttggatccaaattttggatctaaacacagccttagtaatagaggaatgtaggcaatttgtttgtttgtaggcaagaacagcaagtgttctagctttattcatagaatgaattcataattatattttataaacagaaacattaggtgtgacttctgtgcaattaacaattatagttacatgtgcattagttcttcctaatttgacatatattcttctcctagactgtttttcatgatggtactactagtttgttgattttagttgtaatttgaaataattatagtatcagcagtgctttacttaaatggtgtacatctcttgttttcacctctgctataatgctagcaatacaagttatttctatttacttaaaattgagttctgcatccagctaactctatacatacttcaattgaagggtctaaagaccatagcttctccttggattcagttgggtccaaagaccatagctactcctttgtttcagttgttgaggacactatgggtgatgctgtcgaggacaagatgtaccaagttgtaaaggaagatgaaccaaaggaattacttaaagactccaaggttaattttatggcaaacgttgttgaagacaccatgaaagagaaagagattaatgaagatgaccatatgggttggtactccttagcttcagttgttgaggacaccatggatcagcaagtgggagcagacatcatggaccagcaggttgtagaagactccttggtaacagacaccatggaagagagtgatgaagatgaatacttgaaggcagaatatgaaaagggtgcattaatcttcgctagagatgaggcaaatgccttggaaagaaaagaagctgaagctcgttatgaaaaatcacttcaagagattagagatgaatttttgaaaatttatgtccctttgtattttactctaagaaaaaagtaaatttagttagatagataatatataaattcgatcagcatccagttcatggccagttatttgttagcaaagaataactcatgcatctgtaactctgctatcactttagtatcttcaatgaagactatatattgtcttattgtggggtctgacttgattgatctatgttcactgtgtgcattcttgtttcagtttatagtatcattctctgcagcagtaagatagtactttgctggacaatatacagtctgaaagtttcacttcaactggaactttaagttatgctagacaccacagggactgggactctgccaatgatttgtttgttctatcccttttaaactttgtatccattgtacagtgcaatatgatttgttcaacaaagttgtaaagtattcaactacaggtctagatgaagggtgctcgatttgttcaaggaagttgtacatgatttaagtgcagccggtacactgctatgtgtatttcaagggtatgctaatgctgtaagcctgtaaatctgtaagcataacatcgaaatatttttgtacatgagctatgctttacagctcagaaaatgcatcttaccttttttttctgctctaaacatgatgtgttcgattttctggtcgtccttttatttcagttagtatatgtataaagtagcaatacaataaaataaacatcaaactagcttttcccagttggatattgtgttgtaccttaagttagaaaggtgctggtgctgggttcgagtcccctgaacaaaagtttttctaatgattttactttcttttccatacgtttttctttaaaaaaaatacatctactatatgttccaaaatcatgctatgtgaacaagatattttttattaattacaatgttaacaccaaatttagtatagtttatggatttgtcgctatcctacgtatctttgttcttgggttaagaggtttagacaaccaatccaacacagtcgtctagttataaaagtgtactctttcgtataaggtcataaccgatccaacaccatcgggtgtatattcggcatagttcatcaaggcattaggcattagaggatcgaccgttcaaactagttattatagtagaagaaaacaaccattatatttctttcaaaaaagacaataaaatatatgccgtgaaatatattgtactaaaatagtgtatattgtaaatgaattttaaggtaaaaaagaacagagaaaatgtattgtccgattatgacaaaaatgagtatagttacaaagtttactccttcgtacaaggtcataaccgatccaacgccatcgggtatatcggcatagttcaagaagccattaggtgttagaggattgactgttccaacaagattattacaatagaagaagacaaccattatatatagtgcataaaactttgaataaacacaataaaatatattgtactaaaataatatatattgtaaatgaattttgagttaaaaagaacagagaaaatgtgttgtgagattatgaaaaaaatgagtctaaaaaaattattagtacagtttcacatcagggacattaaagaaaataagttgttgctttttaaaaaaatttcagatgcatggaaaaaattatggcgggtgattacataccttttttattttttttggcgctcaaaggaggagttttaggcatatgtccatgtacatatctcctcctccattcataatagacccaatatcttctcccctctcacatcccctccctcaccagattgagagaaccacggatggagcgctaatcattggtgccgatcggctgatcctctacttctccagcgcggcaccgtgccgcgcagcctcatcgcgctactgatccggtggttcccgtccgagtgcttcttcaatcaaaccctagaaagttctactacaggtcactacttctccctttgcattgaaatcatgtcgtttctgatctggtgcctgtcctctatccttaatcaatccatgatgtttggattctatccttaatcaatctgttgcatgtccgcatttgttagacatttctgaattgttgttttttgaatcaaacatattttatagcgctgggctgtcacttttttttgtgtatgaattatttcatctatagtcaactaaaaacagaatgcagtgcaattaatcatattgccaaataataatttatatgatatctatctagtcttgacattttacctaacagtgtattgtaactcttctttgacattaattatatatacagggttatataaaacttaatatcaactagcaattagaggggatggctccaagcaaggcatggatgggccttgtggatgattggctaaatcacgagtacttagagggtgtagagaagttcatagattatgcattcagtaaattagatggtgtccaggttatacgttgcccatgcatcaagtgctgcaatacatattctttgcctcgtcacatagtgtcttctcacctgaaagcgtatgaaatactgaggagctacacattttggtatcatcatggtgaagtcttagcagaacaagagaatgacatagaagttgatgagtatgattcacaggaatttaatggggaaggatataatggaatgcaagacctgatggaagatttatttcctcagtgcaacacccctggtggagacgaagcgacacatgaatctactgatcagggacctgaagaggagccaaacactgatgcggccaagttctatgctttgcttgacaaatacaaccaaccactgtatgaagggtccagaacctctaaattatctgccttagttaatttgcttcatgttaagaatttggggaaatggagtaataagtccttcaccgcattgttggaattgctgcgcaaggactttctacctcatgactctacactgccaaattcttattatgaagcaaaaaaaactattcgtgaactaggactaagttacataaaaattgatgcttgcaagaatgattgcatgctgtactggaaagaagatatagatgctgaatcctgcaaggtatgtggatcatctaggtggaaagaagaaaaacacacaggggaaattaagcactcttcagctgggaagaagattccacataaaactatgcggtactttcctacaaaacctagattgcagaggttatttatgtgtaggaaaacggccgcatatgctaagtggcacaaagagtgtagggttgatgatggagttatgcgacatcctgctgattcaaaagcatggaaggagtttgataaaatccattcatcatttgcatctgaacctcggaatgtgaggctttgtcttgctagcgatgggtttcagccgtttgctaacatgtgaacctcctattccatctggcctgtattccttgttcctcttaatttgcctccttggatgtgcgtgaagcaacaaaatgtaatgttgtcaatgctactaccaggacctgatggtcctggggatgcaatcgatgtttatctgcaaccattgatagaggaactgatagaactttgggaagatggagttgacacaatgattcatcaaccaagacaaatttcaagctacatgcagctcttctttggacagtgcatgacttccctgcttatggaaatatatcaggccatagcacaaagggaaagttggcatgtccagtttgtcataaagaaacaaattcaatgtggcttaagaaaggtcggaagttttgctacatgggtcatcggcgctttcttcgcaaaagtcacagatggagaaatgacagaacttcttttgatggtacaaaagagagccgaggaccatcaaaggagttatccggagatgatgtgctcaagcaagtgcaggatttacagggaattatattgtcaaaggatatgagtaagaagacaaaagtatcacgcagtgataggggagataactggaagaaaaggagcattttttttgagttaccatattttaaaactctattgctacgtcataatcttgatgtgatgcatataggaaaaaatatatgtgatagcattattggaacactaatgaatgtcaaagggaagaccaaggacaatattaatacccgtagtgacttaaaactcatgaacctgaggccagacttgcatccagtagatgatggaggaaaggtggttttgccacctgcgccttacacgttatttccagaccaaaaaaaagcactgcttagtttttttaaagaattgaaagttcttgatggattttcttcaaatataagtcgttgcgttaatatgaaagagcggaaaatgtcaggattgaa

SEQ ID NO: 67112 - DNA, 1567 bp, Oryza sativa
tttgatcgctatcagataacaattgttaattattttaacactagtgtagccttgtaggttgttgtgatgatttctggaaggtaggaagaaatagagtgtctgcactgcagaacaacaactcgaagttcattagtcctggactgcttcagcaacaagttgcaagatggacagcaccttcaacagctgatgatttatttgggtcaccagagaacatggtgtcagctacagctattgtgcaagaaggaaagagcaagcctgtctatgtaaggcagagcaatctaaagtaccagaaacacactgctatgccacaacctggtaattatccttcatgaatgtatattcaaaattaaataatatttaccaagtaacaatagaattaatatgcttcttttctgataatattgaacaaatagctagctagtatgcttattaaaactaatttcttgttttcttagagaggaggatgattcagacgaagagtcaatagacacatggcttcggagatccaggaatataacaattccaaaagttagaatattcccctctcaatatctactctacttatgccatatatatttttatatcaacagcattaacatgtattgtagacatgggcgatgcaaatgatgataccaccgaagaggatggcgtacataatagtaatcaagctgctaaaagaagacttcgtccgcaaactaattcacatgctccaagtgatggtacgacaagaatttattttattttctacataaagtacttagtataatttgtttttcaattgttttaggttctcaatcagttaagcgcagtagctgtggcaaaaacaaatgtgaggactgcatcatctcaaggagtaaactagtaacaaaatgaaatattgttaagttacttattttgtcctcgtatcaatttgttgtgtcatgtagatattagtaatagcaataatggatcccatgctttggatgatgcacataacagtatccttgctgcaaagagaagacgttctactcaacctaatttgcaagatacagaacaagatatattaaaacattcaatacaagtttttccattcaataaataaatttactataatagttgttttcttgacatatctgttagatactgagcaagatgtaattgaacgagtccaggtgcagagtttgaatggtaccttacaaaatggtatgcacgataattcaactatcatttgtttaattcatatctagagttcatatttttatgtttatctaatttgctaggtactaaaatggttcagcacaagggccgtggcaagaacaaatgtaaggaagttgccaaactcaaggagaaccaaaaaattaaagttgagttttacaacaattgtgctctttcgaatagtttttcacgtcatctgggtagaattgttcgtgatcggaacattactccgatcaaagtgaagaaatggtcagacattagtaacacagagcaggaacacatatttgcctcgattacggtacgcatctgtcttcctatgaaatgttctctcttgttttcaataaaactatgcttgcactgaatcatttgtttt

SEQ ID NO: 67113 - DNA, 4586 bp, Oryza sativa
taatgatagttcacgatggtcaatcgtgattggttaattaattacttgccaactaaaacttgataatagtgggttgtgagcacatggttttgagagtcgtgcttatgacaattaaggaccggttcgcgagctactattgtgaaacattaatcgtgccaaccacaagccagcgtgggcaacggctttaccttttgtataacatgattcattgcggagcaccagactgagaagtggcggagataagcccacgggggtcacttgggagtccatgccttgttttataaaggggtgattatgatccaggaatggtgcactgtggtgagttgtgttgtgcagagggtattgtcacagcctctattcgggtactttccagtatcgcgacgtatggtagacatgatgttgaggctgtgtcttgtgggtacagtggtacacctctggccagagtaaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaataatcaatcaacctcagttgaagacaagttgcgaaggagaagacgtttggcttataccccagttgagctgcctgtgggagtggagccggagctgcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaagttggtatcagagccatctcgactgtaggataagccaaatggtcaaaccttaaggactaattttccgaaaacatgatttgtgaaagtttctcctttcttccttatctagaattctttgcaaattgtttcattgtctacttccctctctctttcaacttgagtagttctgaaactagttgttgaaacttgaagacgccaatgtggtctacttatggaggttaagtcaagtggatcgatgaataagaaggtgatggtcgatctgaagtgcccagatgtcaagatggaatgaagtttggatcctaccttagaacctatgccgccaatctatccttgaagaatagttagtagggaagagcgtttgttgtttgctttgtttgtaggtatggttgcattcccatcattggagtagttcattgatgagtgtgtaactatactaggttgcttgcttaatcaacttgaacaatataatggtctacgcacaccagatcagtggtaacctggttaaggtcttgtctttagtgtaacctctctccttctatcttctctaatatgcaatagatggtgaacactcgcgccagtggaagtggaaacaataacaatgaagggaacccaactcttgctcaagtcctggctcaacagactcagttaatgaacatgatgatacagcagatgcagaaccagctcaaccaagggaacaacaatgctccaccgccgcagaacaagttaactgattttcttcgtgtaaggccacctaccttttctagcactaccaacccagtagaagcaggtgattggctacacgctgttgagaagaagttggaactgctccagtgtacggatcaggagaaagttgttttcgcttcacatcagttgcaaggacctgcatcagaatggtgggatcatttccggatgaacagagcagaaggacaaccaatcacttgggaagagtttactgaaggattcaagaagacacacatacctgtaggagttgttgctttgaagaagcgtgagtttagggccttgaagcaaaaggatcataccgtggcagagtatcttcatgaattcaatggcacgttatgctccagaagatgtgcgtactgacgaggaaaggcaggagaagttcttggaaggcttaaaggatgaactgtcagttacgttaatctcccatgactatgttgattttcagcagctggttgacaaagcaattcgacttgaagacaagaagaacaggatggataaccgtaaaaggaaaatgattgtattccaggaggcacaaggtagtagccagaggcagcgtatcaagccactccaaattggtgaatcttcttccgctggtcaaggacagtcgcaacagttgaatatcgctggtgagatcaaatcagagactaatgaaagcaatgaagttaacatcgagcaaataaatcagccgatgccagttcagcaggatcagtctcgggagaataacagtagtagaagggagcagcaggtatgtttcaactgttacaagccaggccactttgcaagagagtgtccgaagccgaagcatcagcagccgcaaggtcaggtcaacaacattgtcgtcacaggagccaatgcagtaccagttgtgtcttcaagagttgcatcttcaagtgttacagctcagccactagtttcaaagcggcagtagttttctataaagccttagaataattatcggagttatggaataagatagactgcagtttacctatgcctttttctttctagccgttccgaatctcgggacgagattctttgtaaggggggtagatctgtcacatcctgattttttcgttttaggatttataaattatttaataaattattaatagaatttatattaaatgttctttaatttacaagaaaagttaaatgtgggaaataaaatttcctaaatataaagcatggatggatttaatttttattaaattctccatgattaagtcaactctctgaaattttctcggatttttcggagctcaattcctaaatgatacaaagaacagttcagtaattatttgatcattaatgatctaattatttttgttaagagcttttcttgtttaaaaatccttaaattataaattgttgtttaaaaggaattgttagaaatgattttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgtatttcatgaataatttaaattgaaaaaggtttttaaaagtctcttttggctttgggccgaaagtcagcccaagtcggcccagtccgccgagccgccgctctcctctctctctcagccgctgacaggtgggtcccacttgtcagggtcgtcgtcctcctcgcgccgccgccgccgcctgaaaccctagcgcgagccgccgccgtctccttccaaattcggccgatcctttacttctccggccgaatctttagaggggaaatgatccttgagatctcctcttccttttctcttttggaatcatcggctaaaatcgtttggaaattcgtggattcgagttcgattcggatcagcctctttcctccgaatccccgatctttccatcccaccgccggtcgccgtgggccttcgccgtcgccttccaacccctttaaaaggacccccggtgtctcctctacccgccgcctctctcgccttcgcctaccgtcgtgtgtagcaccctagcctcgtgagcttttgcgccgccgtcgtcgccgctgctccagccgtgtgccgccgccgtttcagctatcgccgtcgctcgggaaggtcgtcatcgtggtcgccgtcgggatcgccaagtcgtcgccgtcctcgtccgcccctttgccgccgccggagaccgctggagcaccgtcgccgccgtcgacccgatcttctccgccgctttgacctcgtcgccgtcgccgtccgttggtcttccgccgctcctttggtcaccggtgagttcgtcgtgccgtccgcttcgtcccggtgccttccgttcacgccgtcgcgccgtcgttcgccggcgagcgtgcgccgtccgagctgccgagccgcccgagccgccgccgccggtggtgacgtcatcgctgacgtcatcgtcgctgtctcccgtgagccgccgtggacccgatcgatctcggccgtccgttttggatagggttgatctcggccgtccgttcccgtgaaccgtcgtcgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcatttgaactcagtttaatgtggtttgatgaactacttgca

SEQ ID NO: 67114 - DNA, 9290 bp, Oryza sativa
tgggacggtggtcggaaacggtactggaaagggctgacggaagccgaactgtcgcatcacgcggaaaggggcgtgaggctcaacgcagatgtcgaagaccatcggaaccgtagtcatccagtacgccttgtccctggtgcagagtgtggatagacccaatggcgcacgagcttgggtagccgcggcactgtagggctcccacacgacgtcagtcggcagaaggcggtcgaactccataacaaactcaggatacgaccgcctaacctgaacgtgagcccatcggcgctgcaattcgagacgatcgatgtgatgtacaatgaacttagcaattaacttaacaatacgataagatcgatgcaatgtacctgacgacggcaccacagagtacccatcgtagggtagtcgacctctggtcgctcctcgtacagtgactcgtacgcgtgctggtccacctcagggcggccgatcacaatcctctcagctgcccagatagaaagaaagagagggcacccaccaaaggtcgcgctgggatccgtcttcgtgcaagcctcacaaagtgcacggtacagagccgccaacaacgcggaaccccagctccactgaggcacctcgcctaccgtagcgtcggcgatgctcctggcgtagtgcacgagtcccttgtcgaccgcgtgcccgtgaccgccacagaacatcacccagccaaaaagctagagcaagtacgcctccaaacagtggctgtaggagtactcgtcggcctccgcctgtagctgctcgacctgcaagccgtcgataaaatgttaggcaccttaactgtggactaaatatgtaatacgcttgtcatttcggtacaaaaacactcacggtgaactgaagcagccacctcttcgtaggtccggtgttgcggtggtgtgccaacggctcgagcgggaggtgcggtgcgcgctgtactagtgcgaaacgtgccgtcatatcatcctgccagtccacagccgtggtcactggcccaacagtgtctctcgcgagtggtagccccaacaagtacgatacgtcctgtagggtaggggctacctcaccgcacggcaagtgaaaagtgtgcgtctttggcctccatcggtcgaccaaagctgctaggagggacctgtccacagtccatcgtctggccgggtccgcgtcgccggcggcagcctccaccagccgacacatcggtaggaggccgacctcatgcagcctgcaataacaaattaatatgtcattataaaaaatattacagcgcaactaacttatagtaatacattgttcgtacctctcgacaaaggagtcgtgaaccgtgagtagctcaccgcacgtccgtgcccggaacgtcccaagctgagccccctgcactgcagtaaggtgagaccggtgtcggtgatctatcgccgggtccaacaactgaggtgtatcctgacgtgccatctctgaaaaatatagtgtttcgtgttagaacaattcagcaagtagtaatataaaacaaaagataacttgcaaaattatgaaatagtaataaaatcatgagaataattacgtacaacaagagtacaggatatttaaatatagcaaacgttactaatggtacataacgatgacgtgcaatttaacatatatgtagagctcgataatataacataacattacgtgtcgaaatccgacatacatcagcatacctaaagacgttaggcgccttagtctgacgttacatcacgagaccaaaagacatgacatgccgaagtctgacattacacgacgaaacataaacacatcgataagttctaaacgaattacaagcaaagccacatgccaacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctcccactagtccatatcgttgcggatgcgacgagtcctcctccttccagccttgcctcggagcttcgatgggtcaggaatattgagtacttcattgttagtctctgtgaactccccagctatgccgaacccataaatctcgccgctccatgtatgatatattgcttgcttactgaagtactgtgacacatatactgcatctggtatgccacactccgctgcggcagcaatgacatggatacatggcctgtggagcagcttcggctttgcacaagagcaatgacatgtgccgtcggctttgagaacacactcctgcttcactgtcttgcggtagatacccctgcctgccttatcttgacatagtatcttaaacctgtgctgttgggtaccttgcactagagctcgatgtttcatggcctttttacgcaagtcctctagctttttctgcatgaaagttccaaacaaaatgctgttgttcgacatagagggaagaactgcctggaaccgatccctaaaatacctgcatgtctgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatggttttataaaaagaaaagctctaaaaagtcctttttcccccttccccctcttgggccggctcggcccatctccctcccctctccctcctctccccgcggcccactcggcctctccccgcgcgcgcgccgctgacgggcgggcccgcccgccaccctcgctgacgggtggggcccacccgtcatcccctacctcccgccgctcccgccgactccgccgagccctaacgccgtcgccttcgctaataccgccgctcccgtccgtcccgcgtgcaatcaataggggggaaatattccccgtgattccctccctctttccccccatttttccctccctctctccctcggattcgtttggaaactcctcccctaacctcgccggcgcatcaatggcggccggatcttccgcggccgtttccccctcatccggccgctctctccccctcccaaccctatataaacgctccccgtgcctccctccaccgtttccgccactcgtcgctctctctccccgccggaatcgagctcgcgccgtcgctctctctctgcgccgtcgccgccgagctccggtccgccgccgtcgtcgccccagaccttctcccgtttcggcgtcgccttcttcgggttcgccgcgacctcgccgacctcgtccacctctccgtttcggtcgccgaccgccggaacgccgccgtccccgtctacccgagccgcgccgccgccttcctccgctccggtcgccgttcccgtcgccgccgtcgacccggggtgagccgtggaccgccgtttcgcttcccccttccctcccctctctcgggcgccgctccgccgcgccggtggtcaccggcggcgaccatcggggcgcgggtgcgccgcctcccgtcggctgtgccggcgtggccgccttcgggcgcgccccgcggctgccatgtggggcccggtcgtcagccgcccgcgccctcgggtgcggctgacgcatgggacccacggcgccggccggtgtgagccgcgtgcacccggtccaccgtggaccgtggggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggcaataacttggccatttgaactcggaattggaccgttcaagtctctaatttttccttaagaagtcaagaacccatttttgtgttttgtttctacttgttatatggagtttagtagagtaaaagccgtttctttcccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatctagccatgcctatttacctttgttatgaccttaatatttttattgttattatttccttgttcaccctagaataaacaaaaccccaactagtggacactctactcatgggaccactagtatgaatttaggtagatgcttcgctgattaaataggacaacattaggtggtttttataactttagactttgggaattctcatatcatttggacactatggaatggttggcttatggtggaattggacatacacctctcttcctctttcaaaacccctaaaacctgttttccggtggggtttgagtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctgggggctcattcctgcctacctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtcttataaaatggctttgggcaactaagtgacttttaaatgctgttttctgcaaagcttaacccctatattatcaccccttgtacccccttacattaatcatgcatctgccggtatggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttatatcatgtttgtgtggtgtaccccggcttttcctgggacggggattaatacactagcgttcgggaaaaggcaattttctcggtcgcgacaagctggtatcagagccatctcgactgtaggataagcccagtggataaaaacctaaggacatattttataaatgaaactatttgcgaaagttcctgtttcctcctttacctaatgctatttgcaaaatgtttattctcttcttcctccttcggattttcaactagtactagatggtcagctttgcgaagaagaagatgtcgtcaattgtctgccgaagctctggaagactattggatctgctagcgaagtggaggaagcagcgaagccagatgtgaagcaggagtgaagatcttggagaacccgtcgcagaacctaagccaccctctagggtagagtcgttagtcgtgtgtttccttgcttgtgtgtgtagcgcgtggttttcatcagtggggtgtgatgtaaccatgctaggttgtttgcttaatcaacttgcagaataagtgaaacaaataacacatcaacaagaagagttagttcctttaaggtcctgtctctagttctggtctattctttcctagctggtttcctctcttcacctcaatccctgtaacagatgtttaacagagaaaaagaaaagaatgtcagcgggtatgcctccagtaactcaagttttcaactcaatccaccactagcctcaagagagttaacaagggtacacccttggtccattccgagcatgctgcttggttcacagctaccattggttggaagtcaagaccaaaatcagtatgtgtttgatcgagcacttgccacccaggtcaatgagcttccaatgccagaagaggatgtccccttttgtcacgattgtagagagcaaggacactatgccctgaattatccatgggtatatgtcaaagaagccccttcctttggtttagcagggcagacatcgctaaaccagcctcctcacaccaagtcaagcttgcagcctagtgtgcaaagtagagagcccaatggagagaatccattgaatcctgggaaatgctttcctcctagcctttcgtaccacgtggggtcacgtactaagcaagccaaaggcaagaagagtaagaatcagaagaaaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggcggcagagtatttgatagtgaagggtcagatcaagtctcctcggattatgaagatgagtctctccgacatctcggcgaggaagagatggaatcaaaagcatgccctcgttgtggagaaattggacacgttgctagcatgtgtctcacactttgccctcattgtgaggaagaccatccaccaggtggatgtcccacccgcaaggtcacatgttttctatgcgaaggtacaaaccatgtgcccaaggattgccaactcagtgtgttgttgaccaagaccgcagaaatccaacgaacaaccctacgattgtctcgtcagttagtcagctccaacagcaacatcgacgatatcatccacagcaccaatgctcctcttgctgcacctgactctgcaataaatcatagcaataataccttcagcaccaaccattctctgcaccgacggcctcagcaaagaattgtcgtcgatggaagaagttgtgtctctccccgacctactccaggccgagcgaagggcaatcaacctcaggaggatgataccaagcagaagaccgttattcgcttcaaccagcaatcagaaggaagcttctcctgtgaatgatagcaaaatgcagtcctatcacatcatcacagaaccaatcaaggatgcagtcactagaacaatgccagctatatctctccagaatcaaaatgagcatccatgtttgtggttttcagttcgctacttatcattgtgtaatcgaaagtttgcagcaatcatgtaatacataaatatattcatgtctataaacagtgagcttgctatgcttatggatgattcatgttgaggatacaatgtaccgatgttaagcaccttccctttttgtttaaggcagtgcctcgtattcatgtaatatgggagaaatgtgtaataaaaacaagttctatgaggactctttcagaagatgctgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtctttttcggatcaaaggcaatggcagtcagtatagcttttggcgaaatacttcaaggattcactgaaaggcagcagaccaaaggacctcatcgccaccagaagtgtccgcaacccacattaaagagtaccacctgttagagataggccgaaagatgattgataaaagagattggcaaagaggttctctagcaggaaagatgtaggccgaaaggtgattgataaaggataatcaaaaacatgctctgcatcactcaaggaagacccctgatagtaatcgccctgcaacagtcaccttgtcattgagagaaaaaaaaagtcgtgagtaagcaagatgacctaggtaaaagtgtttctatgaaggcaaggagtgaaatcttcaactcagtatcagatgctacagggagtgaaaactgcaagcaccggttaccaggcaatgccatgtcttgggagatgatccaatgggaaggaactcatcaaggtcaaaggagtaaaggaatacgttgaatgctaaataatgacaacctgaagataatagtgggaagtaaactgaatgtaaataaccaagtgatatgttcgaagatagtctacagaggtcagattaaaatcacatctaacaacgaagcttcagatttggcaggataacgatcaaacaataagaagttcagcagtaaagtcatttgggaagacgtcaaagcatgtctagtgggataatttggttcccttgggaaacataattcaaaggcaaagttatcgaccctcacattgaatagaggaaatatctagcaccggagaccaggaaagctaatatgagacaattagtggcaagttgtcaatcatggtattcttagtaagcgggatatcatagtctaaagcatatggtggtaagttagaagtaaatgacaagcatggtattctcatgatgacaagcatggtatcctagtaatgacaagctgatatcggcgcaaaacgtgaagtgggtaacttgtatgaggttgacgccaaagatatgaattatgagaagttctggaactgaagccccatcttccaatgccgcagcccagtcgaagtcagctaaaggttcaaccagggacaagtcaggtgaagagaagattccatctgcaacaagggatcgagacaagcagcctagagtggagaagtttttctaggcaagtttgttataaaagacgcgacggaagaagtcagacaagaagag

SEQ ID NO: 67115 - DNA, 2713 bp, Oryza sativa
cctatattatcaccccttgtacccccttacattaatcatgcatctgccggtatggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttatatcatgtttgtgtggtgtaccccggcttttcctgggacggggattaatacactagcgttcgggaaaaggcaattttctcggtcgcgacaatgtcccatgtaaaatgaactccattatgccaactagtggcagtccacggacaccgcgcatcacccagttgtaaacttctgccaaatttgttgtcattattccatatttagcaccacctgtgtcatacgccttggcccatttctcttttggttcatgcagaatccactgagaaaatttcccaatctccaatccagttcttctaaccaatgttggactatccgttgggagaggtccaagagcttgaggagggtcagcaacggcggtcgatggagccgctgcacgctgatcactgcatttggctatcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacactggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgtcatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcataagttccaatacttggcatagctaatagtatacttgtatgtctcttcgatgtgttggattattgaccttggttcatatgtgagattatcgattacatgcgcatacatctcagatgcaacaaatgcacatgtaatgttcctgtggtatttctgaacaccaggtagaaaacatgtatgcttggtaacgactgacactgtccaataatccttccatttccccttatacgcgtgcactctccagggataaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacttggttgaatgcccactggagctactacgcccccgtcctctcgtgcgttgacctcctctacagaagtctcatttacttcagcacttggtccctcgccatcatccatgttcatctgcacacctggatccttcgggtgaacaaacggaaccaaagctagaggccactcgcgttgcaatgcattttccaaataccatatccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaattaactctgacagatctaccccagttgggcccataacggacgtttcctggtccatggtaaaacttggagtatttgtttggtcgacaatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctacaaatataatgcatttattcaaaccaaattttaaaaaatacacactatttaactcaatagtcacatataggatctatgaatattacctgaaatcggcgtctgaatccggcagggcttcgccccttcttctcttctcctcccctctcttttttttcactggaattgaggggggaggaatgagggctgggggct

SEQ ID NO: 67116 - DNA, 3355 bp, Oryza sativa
aatcgcttttgttgtccttaaacgattgtttcttagcaagtttggcagcaaactccaacagagccacttcttcctgatccgtcgatacatgtgtgcttgctgcctttgcttcacgattctatatatcaaaaacagagtcagtaaagaggcaatgcatacactttgttttcttttagcaggataaaacagtaaagtcgaaaaaaaggaacaaactttcttccccatcctcagctaactgggaacaattgaagaacaggatccgctgaagctctgactcgtttgatgaatctgtcacaattttacatacctggaaggcagaagaaagcactggaacccctagtgctaagtttactaaattggtgcacgtttattattctgtattgtatatttttcttgaatggcgcaggagagctgtgtgtcatttcattaagaagacaataaaaacaatgaacaagtaaccaaaaacaggactcttagcgccgcatactaagaaaatcaagtgtccactgcccaaaaaacacttaagcagctataggtagcatcctagtaagaagctgttgcagagccttagctccagccccaacaccacaacaaatgctcttccgtaactacagcttcaactctttggacacaaggactagcaccctcaaatattcattgttatcaacgattcaattcttagttttgttgaatttctcatattcatttggcttttgttgccccaaacccaaccaactgttgggatggatgctgactggcttatggttcagccgctctgatattacaatcatacatgtttaaacttgctgatcaggtcaactatgaaaaatgtacaatcaaatggcatatcattcctaatcaaattacctacatgaaaattttcttctgatataagagagaactataatttaatctatagtaaacatttaatctgtagaacctagttgcttcacatgtaaagcctgtgcaggaccaacctcctcgttggctagattttgtcttcagataacccactgtatgcatctcttattcctgatcactgtttgctgtgtcatctgctactctatctcattggctagttgagcataacactatgctactctctctttttgtttacttaagatcataccttgtcctcgtaggctcatacgctacatggctgttagttgtctcatttagttactgaacaccatgttactcttcattcagcaagcttttgatttaaagaattttctgatgctaaaataaaaaaaagaatttttaacttcttatatttcttatcggttcactaaagtcagtttgccaaataaagaatttgcaacagagagggtctcaagatttccaaacccacttccatttcagccttactccaagcacattgttgacggtcggtagcgatcagtttcgaccgtcaatattaccaaaatagaggagaactagttatgcttgcaatgcataaatatgttagaataataatattccactagtattaggttcactaaccttttgcggagaataaccataaagtggaggagaatcgacattgaatcagacgataaatcaatcggacgatgttgagaagtagacttatgtatgaatgggccaagaactcagaattgacacgatgaattaggccaaaattcacaagtctacgaaagagagcaatggaggaggccacctgctgtttttgggccaggttgggccgacgcaaggttcggtcgaaccattaggttcagccgaaccccccacaatgccgtttgatccaggtttctcctggacggctgagatgactccccaatgacggttggttggtattaccgacctttccaaccgtcacaaccgtcattctcaagctataaaaggagttctcatcatcacttcactcacacacctcaagcaagagctctctcatattctctcaagttagtttagtgttatcaagctagtggaataggaatagagtagaaatcaggagtccagaagtcttcggaagagttcgggtatggcttagtagctttccttttctcttttataagctttgtaataatattagaatattcttctttatacatttatggtattgaaatacttttggagtatatgaatgcctactttacattatgttcatgttattctgaatataccgctagcttatctgggagatgctttggcgcgggtataatgtttgcttatgcaattactctatgtcatgacgatgatattagagtagtatctggtagtttaggcatggtgtctagattatgagatatcattatttggggttatatgctgcggatgagaggtgggccgctgatggtgatagctcagtacgggtattcctccatgcgtgtatataatcctaagttaattccctggggagggtattcctccgtatttagccccggttgtatgatcatgacgggctgtcgtaaggaactcggcagtcaggggtggcttctcgaagtaccaggagggcatcggatagagggtattagctagtatgtcagatgactagaatgtatgtatactatgtatactagaagtatatgaatagattatgtttctcttttctttccacttagcttatataatttagtatgagaatgagtagcttaatgcttgtgtgtcactctactcttgaattatcttaacccctgtttaagatgtgattatcacaagtaatatataaattattagttaagttctctctacataatcttcctacgggttaaaataaatacggtacccttgtaatactctcggtgaaatgttacaatggtatatccgtgcgcttgcggatgattctgtaaccacaatataccaggagtatttctgcgccattgctggaaattatatttctaataatattgttaagaaataccaacacacatatgctacaatcactcagccactgatacgctaaaccctatcaatggccaaccacgcagcagaatcatcaccctatcaatgaccaatataaaatttgggaacctatacgctaaaccctagcaccccgagccagcgcggcagacacggtccggcgagcctaaactcggaaagattgaaaacatacctcgggttgcttgatgccggatttcgaagtgagcctgccgctccgtcgagccggttgcttcctcttcattttcgagtgacttgcttatgtattggggcgaattaactcaggcattggagagaaacaatggcgatttgacgcgcatagggaaccgcgattgagagtggagagaggagagaagaagagcgccggcggcggatgtaaaatgacagttgagccctgctcaacgcggcggtatgtccaccaaaggactttggcatatttggccatttggcactaaca

SEQ ID NO: 67117 - DNA, 2654 bp, Oryza sativa
tggatcatgaatattcttgctgcttgctaggtcatgaatcctcgtgctactgtatttcattttcatctccaaaaacaattctactcttcattagtcattaccatgcttcgatcacacatcactaatctgctgcagtgctaagccagtttcacgagttttgtttgcattgtttgaatgaactagtagagtgtcatacaaagaggtcaaattctatgttatgttgttttttctgctcaaacactgttatattttattgacatccctatgtgctacaacattgagtgcctgctttatgatttgcaatttgttgtgtaatcatttatagatatggacagcgacactgaggttgaggccttctctaggatttgcaggcgtaagaacatcattcaatgcacttatgttttaatgtagctgaccatatgcagccccatttctaatagcatcttatatttcatatgtttcagtccaagatgttgatgaaggaagggctgaaggtccatacttcacgtaccttcatatgtttcccgtttcctatcagcgttgttgagattcttttttcataaataggaggtcatcctatgagtgcaactgcgactgcccctactgctgtgagccaggctgtgagtgcatcatgtatcatgtaagtgcatacagttggcatacattgctttatatactgcaatttctaatgaacttttgctttttttcagccaaggtcaccttaatgaactgtgccttccttcctgcaactgaagctaatgaactgtgtgtatagtactggtgtagaggactaatgaactgtgtgtagagtactggtgtagaggactaatgaactgttatgttttagcagaaccaagctaggatccttctatgaaactgtcccataaattgtgtttggacttggtgatatttacttttgttatatcttgttatgaacccaaaattttaccttcctggaacttgtgattttaccatcgacgaccacgtgattgtcggcgcgatctgggccgattcagcggcccagcagttggttgctgggctccaggcccaagcgtgagcagtggtcgcgtcgttcttgttagaaataatttagtgtgtactttatatgtaccgatatcaccaccaaagagttcacattatagggcaccaagaattcatatgagatattagcgttcatcttgctaattatatatcgaatttcttacatttgaatttatttagcccccttcatttactcttatacgaggagcaatcccgtcattagggggagatttaaccactaaaatgctaggaatgaatgtatacacattcgctctcttcgaatgagagactactgagtggtatattgcaccagtttgcttcagtccctatgtgctctggaacacgttttgctgttaagaacaaccttgatgtgtgaacgtaaagaactgcagcagcagcagcaaagaactggagcacaaaggaacttttatcattttttacgtaaagaacttggattcaacaagttcatcaaactgcagcagcagctcataatgacacaatacaagtcaaacaatcacacataatagaacatggcagtagcccttcaattcaagtctttaaatagataaaaaaaaagttccagcgggtagcaccatagcacacccggcagtcccaacagcccttcaacatcacagattcaagtcttcatctccatctccatgactccatgaaccagcagtcccagcagaacctgaagatggtttgttgtcaacccctggcccctgcccatatctcagttagggatgactcacctgcacacgctatacatcttaaagattaaagataatataggacttttttttagaaaaatcatgtaggactgttgtattctttctatcttcttaatttctaataatgtacattacctatgcagtgtgctgtttttaagttgttgcataatgaatgtcatagggagcactacacatcagtaggaagagcaggaagtcacctggagacaacaagctcccttgatagcaggaagagcaggaactcaacatcactggaaatctgggggtagcaattctggatttatgccctccactgcaggtaccttcactattccttttttccacaaaccaatgaggtgttttctcttgtcttcatagcttttcatagcaagaaaccctttcagagcagctgggtcctccaatgcaactgtaaatatataatgctcaatgtccttgcaaccatgttctgccaaacacttaagtgaagaacctaggtctttgggtgtcgtgtacttcctcttcttcgatacactcggtgcacctgtaccggtggcttcactagccgtgaataatgaagtgaataagccgtcatggccaatgagacgggcacccgagcatgtaaactgggatgcaagacaaaacttctcatcaacaatctataatcagtcaaaacggcaaagaatgagtaggagtggggcaaataccatctgttgagatccagagcctttttctaaccatgatgtttcatatctacctagttttgacctaaccttggaattagtcaaaggaacatattgattgttgagatctagcggtataaaatgatcattcgtcatctttgcaagacgtttaaagaaatcgcttttgttgtgggctgcaggaatt

SEQ ID NO: 67118 - DNA, 8729 bp, Oryza sativa
gggagagacacaacttcttccatcgatgacaattctttgctgaggctgtcggtgcagagaatggttggtgctgaaggtattattgctatgatttattgcagagtcaggtgcagcaggaggagcattggtgctgtggatgatatcgtcgatgttgctgttggagctaactagctgatgagacaatcgtagggttgttcgttggatttctgcggtcttggtcaacaacacactgagttggcaatccttgggcacatggtttgtaccttcgcacagaaaacatgtgaccttgcgggtgggacattcacctggtggatggtcttccccacaatgagggcagagtgtgagacacatgctagcaatgtgtccaatttctccacaacggttgcatgcttttgattccatctcttcctcaccgagatgtcggggagactcatcttcataatccgaggagacttgatctgacccttcactatcatatactctgccaccatggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggcgcttttctcttctgattcttactcttcttgcctttggcttgcttagtgtgtgaccccacgtggtacgaaaggctagaaagaaagcaattcccgggattcaatggattctcttcattgggctctctgctttgcacactaggctgcaagcttgacttggtgcgaggaggctggcttagcgatgtctgccctgctaaaccaaaggaaggggcttctttagcatatacccatggacaattcagggcatagtgtccttgttctctacaatcatgacaaaaggggacatgctcttctggcatgggaagctcattggcctgggtggcaaatgctcgatcaaacacatacttattttggtcttgacttccaaccaatggtagctgtgaactaagccgcatacttggaatggaccaagggtgtgccctggttaactctcttgaggccagtggtggattgagttgaaaactggagttacttgaggcatacccgctgacattctttcctttttctctgttaaacatctgttacagggattgaggtgagagagaaaacaagccaggaaagaatagaccagaactagagacaggaccttaaaggaactaactcttcttgctgatgtgttgtttgtttcacttattctgcaagttgattaagcaaacaacctagcatggtcacatcacagcccaccgatgcaaaccacacactacacacacaagcaaggaaacacacgacaaacgaaacactagagggtggcttaggttctgcgacgagttcccaagatcttcactccttcacagctggcttcactgcttcctccacttcgctagcggaccctgcggtcttccggaccttcggcgaacaattggcgacatcttcttcttcgcaaaactaaccaactagtactagttgaaatctgaagaaggaagaagggagtaaaccttttgcaaatagcacaggggaaaggaggaaaaagggactttcggaaatagttttatgtataaaatatgtccttaggttttatccacttggcttatcctacagtcgagatggctctgataccagcttgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcgagccacaccggcagatgcatgattaatgcaagggggtacaaggggtaataatatataggggttaagttttgcagaaaacagcatttaaaagtcacttagttgcccaaagccattttaaaaagacgatcctagagttacacagtattattaatcagggtcgtgaacccgcacgagcctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactagcatgcacccaaaccccaccgaaaaacaggttttaggggctttgaaagaggaagagaggggtatgtccaattccacaataagccaaccattccatagtatccaagtgatatgagaattccccaagtctaaagttataaaaccacctaatgttgcctaattaaacagcgaagcatctacctaaattcatactagtggaaccatgaatagagtgtccactagttggggttttgtttattctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaaaggcttttactctactaaactccatataacaagcagaaacaaagcacaaaaatgggttcttggcttcttaaggaaaaattagagacttgaacggtccaattccgagttcaaatggccaagttatggccatttgaagtttatatgctctttaaatggatatttacgaatttctttatttaaattttaatttaaaatcggatttattgcgtcagccgaggggaggggcgcgcggaccgggtccacgggagtggggcccacgcggcagcctctcggtccacgatggaccgggtgcacgcggcttacgccggccggcgccgtgggtcccacgcgtcagccgcacccgagggcgcgggcggctgacggccgggccccacatggcagccgcggggcgcgcccgaaggcggcctcgccggcacagccgacgggaggcggcgcgcccgcgccccgatggtcgccgccggcgaccaccggcgcggcggagcggcgcccgagagaggggagggaagggggaaacgaaatgggcggtccacggctcaccccgggtcgacggcgacgacgggaacggcgaccggagcggaggaaggcggcggcgcggctcgggttgacgaggacggcggcgttccggcggtcggcgggcgaaacggaagggtggacgaggtcggcgaggacgcggcgaagccgaaggaggcgacgccgaggcgggaggcggtccggggtgacgatggcggtggaccggagctcggcggcgacggcggagagagagagagcgacgtcgcgagctgaaatccggcgaggaggaagggcggcgagaggcggaaccggacggaggaggtgcggggagggtttaaatagtgccggggcgagagagggtggccggggaagggaggaaaccagcgcgggaggtcggccgccatcaatggcgccggcgagattaggggagcggtttccaaccgaattcgagggacagagggtgggaaaaatggggggaaagagagagggaaacacggggagtgatttccccctctttattgcgcgcggggacggcgggaggcggcgggattcgcggcggcggcggcgctagggcacgggcgaggcggtgggagcggcgggaggatagggatgacaggtgggccccacccgtcagcgagggtggcgggcgggcccgcccgtcagcggcgcgcgcgtggggagaggccgagtgggccgcggggaggaggagagagagggagggagatgggccgagccggcccaagagggggaagggggggggggaaaaagactttttagagcttttctttttataaaaccattttaactttgtttatttcttaataattattatttgtgctctaaaaattccactaaaatttgagggctccttttagaccaaggagaatttaacaaaaattctccgggccacatttgaatttttcttgtacgtattttagtgtttgccaatttcttttcgaattttaattaattctattattccttttagagaatgatttttatttcgggatgaatttatcaggacgtgacagttgtttgggatctgtgtgacttgccttgctggccttggaactcttcaaactcttctccggcgaaaacggactctccggaaacgacggaatctaagcagaaaagagcaaaaacaccaaaacaacacataaacaagcatgaacagtacatgtggatatttttaacatgtagatctcgattttagaaaaatttagagacttgaaccaactaaatccgagctaagatgaattagttatgaatttttgaagatttaatcggattaaaacacttatattgattttaattgaattatgacgcaataatgaattatttttgaaaaggaaaagaggatttattgcgtcagcggatagggtttgcggtggaccgggcgcacggcggcggctcacgggaacgaacggccgagattgatccatccaaaacggacggccgagatcgatcggtccacgaccggctcacgggagagggcgacgatgacgtcggcggtgacgtcaccaccggcggcgacggctcggcggctcgacagctcggacggcgcacgctcgccggcgaacggctgcactacggcacgaacggagggcaccaacgggtagagggcgacgcggcgaactcaccggcgaccagaagagcggcggaagatcaacggacggcgacggcggcgaggttgaaacggcggcggtcttcgagtcgacggcggcgacggtgctccggtgatcttcggcgacggcgaaggggcggacgaggacggcggcgacttggcgaccacgacggcggtcttcccgagcgacgacgacggctggaacggcggcggcgcacggctggagcggcggcggcgacggcggcgctaggttacacggcgctagggcgctacggacgacgagaggcgaaggcgaaggtggcgacgggtagaggagacaccggggagccttttaaaggggctaggaggcagcggcgaaggcccacggcggccggcgacgagaaggaaagatcggggtttgaaggaaagagaccgatccgattcgaactcgaatcaaacacattccaaaccgatttagccgatgtttccaaaggagaaaaggtagaggagatcccgaagattgtttcccctcaatcaatttcaccggaaacggaaaggaacggccggatttggaaaggaacggcggcggcgcgaaactagggtttcgggcggcggcggccggaggtcgacgacgaccctgacaggtgggccccacctgtcagcgggcggacgcgcgcgcgcggcggactgggccggactgggccgaggagagagagaaaggttttgggccgactttcggcccaaagccaaaagagactttttaaaacctttttcaatttaaattattcatgaaatgaaattccatttattaaaaatacttccttagctcaaataaatcccagaaaaatctaggaattatagaattaagcaaagtatttaatgaaattttatctggccccattttatattggaatttattaattaaaattagatcttctcttctaggcttttttaaaaataaattctaataattccaattaaacaacaatttataaattttgaattttcagggtgtgacatatgttgataggtctactttgactttggattcgctttacacaaaactcaaaacacatgagatgaatattctttctcgaagagttgattctaagtctagtgcttaggtttcttcctcgacttctttggatgttggtgcctcttcatcgaagtcttttattcttgctttaattaatggcatatccgatgaacaactcgaataattcgaggaggatttggttttggttactaacaagttttctcgagctatgaataatgttaggtacaggaaaagaggtggtccaaattgttgctttgaatgtggttctcttgatcaccttcgtttgcattgtccaaagcttggaagaggcaagatggaagataatggtggagagaagaccaatgacaacaagccgaagagcacattcaaagggaagaagaagaaggagactctcaagaaggcttttgatcaagtctatgctgcttttgagccactaagtgatgtagatggtgaaagtgaagatgaagataagggaaagaacatttccggtgtttgcttcatggcacgtggtgaatcggattcggagtgtgaagacaatgaggtacgttcttttgagaaagctattcttattttaagtgcaaaaaataagaagtgtgagaagatgtatagaaaacaggagtttattattgaatctcttaattctgaagttgctagattaaaatatcttattcccaatgattgtgattgcaaaagttgtgaggttttaatgaatgaaatttcaaaaattagagatgtcaatgctgcacatgatttgaaaaatagatcttctctagatcttggatttgccttgcgcacacacactttggatgagttgtttttgactaaaaagttgttgcaaaaatatcaaattgcttttcgtgctagtttgatgtttaacataatttgagccaaaaagttaaaataaccacatgatgttttggattgctcaacatgtacattaaacaagatgaaactaaaagatgctttaggtcgtgttgagtcaatggaagatgttgtgaaaactaatgaagtgatttcttgctccaaatatcgtaaaagcaaaggtgtcatggtaaattgtgaaaattgtgctaatttggaaaaagaggtttcttatttgaaaaattctttgcaaagattttctgatggtaagaaacaacttaacatgattttggatcaatctaaagtgactagttacaatagggtgttggttttgatgttcatgactatttcaccaaaaatcaaccaaatgttttgagtgtgactgaacatggtgaaattttgacaaaaccaagtgctaagaaaatagtttttaagtctgctagaattttgccttctctttctgctacactaaaagaaaaaaaacaaatctttcaaaaccatcttcttttaaagaaaagtacacttgttcttttttgtggtaaagatggacatcttgttggttagattagctcgtaaacagaaaaaaggagagataaattgcttttgcaaaatcaaagtggcaaaaatctggttttccctcgaggaaaccggtcagaccgcagtgggtcccgcggtcagaccggctactgagcggcggtcagaccggtggtacagaagcggttagaccggcccccggtaagaccggctactgtactacggtcaaaccggcctcggagaaatttttctgaaaattctcaaactgtttttgcacgtggatatatgcctattggatctactggtcgtgtgtcctagattcctaaatttgtattatctaaccccagtcctgaggcttcaacatcttcatgtgtgtaggctttggtggcgaggaaggagaacgtgtggatcgtggattccggttgttcgcggcacatgaccggtgataaaaattggttctcctccctcaaacaggcatccaagactgaatcgattatctttggtgatgcttctactagtgcagttctcgctacaggtttgctcaaggtaaatgacagattgaattgaaaaacgtagctttagttgaggatttaaagtacaatttgctttcagttttacaaattgttgatgaaaattttgaggttcattttaagaaaactgaaagtaaagtatttgattcttgtggtgattctgtactgaatatttctcgctatggaagagtgtttaaagctgattttcgaaatcctgtttcacctgtgataacatgtttggtcgctaagtttgataaggatgtgatgttttggcatcgtagacttggacatgtttgttttgatcatc

SEQ ID NO: 67119 - DNA, 1371 bp, Oryza sativa
cgccgaccgcctttgattcccccattgtcgtccttgtcttcagcctcatcaccactattctccccctccttctcggacgacgggtcctcatcaaaatccaccttcaatgatgacccgttctaccaccactcattatctctacccaactcgttgcctggtgatgatggcggtgttaaggagagttgcttcttgtcggtgttcaatggccttctcctcctcttcgacagtggtcatgtactatggttggcgcggcgagcccaacatggccaaagataaagcagaacgcaaagagaggaagagtgcagtgataaaacccacattacctactttttactggaaaatagatggagagtgagaggtgatgaggcgcagtgtggccagaggatgtaaccggagtccggcgcttagacttcagaggagcccgcatgatcaccaaaggaactacaggtagtggaagtagtgacacaatgaagatgaagagataagtcataggcaagcaattaagagctctacctcggagatgcacatttacccagacgggcttaacgccaccgaatgtgaaaatacttcaattttcttagatgttaccttatgtggtccgcctatattgttagacattaatgcgggcaattgcctaagacgagtgcttgtgtaaatcattgtatttatgtaggcggccatcatatcccgccgcctatgataattggtttacacaaacccgtgaccctctctccccttggtagatataatgcatagagagagagatagagagtgagagagagagagagagatctacaatactaagcttcaatcttctcctatatccttacttcaaacttcctctatccttgtgcagcaacaacctttaaatcgctagtctaagtagaatcttttgatgttaattttttttaccaggaaatggttatatgctgctttgaccttatttattctccagaatgctagcaagtctaatagtctccatttgttcttcttaatttaagaatgatgaccaccatacttcttattcaataaccctttgtttgaggagggcatacatccctgaggaggggagtgtggccgagcggtcaaaagcgacatgccgtaaatctggtgaagattttatacgcaggttcaaatcatgcctatcccacttgttgtagacttaagagttaagagaagagaaataggaagaagcccaggagggccaatcaagcgaggttttttctccctttttttcccgtgccatgaagtgtaattttattatatgcgttttagagaggtttgtcaaaaaagatgatctataaagattcctcatctatatttgatcatgaatagtccacttgtattgtgtgaatcatttacaaagtttta

SEQ ID NO: 67120 - DNA, 1689 bp, Oryza sativa
  unsure (1)..(1689): unsure at all n locations
tattttaggttcttctccctctgccatccttatttgatgatgtctttcccttaagtctaatttagagaaccgttgggatccagccaactcacccagcaactcttcaataatgggcactgggtacttgccttttatggtgattgcattcagttgcctatagtcaatgcataatctctatttcagctacttgtttttcaaactcatttttaagggctggtttatgcctatagggtcttaaattcactggtttgtctccttcaatcaggggaatatggtgatcacaagctcttggaggaggtaatccagcgtgggttcttcgaacagctcctggaattcctgcacaattggttgaacagattctgagattttaggtttaatttactccttagctggttacaattgtatcacacatacaacactgttttagccattccattaagctggtgaagtgaggttgcttcacacaaatccagtttgggtattaagccttgtagccttatcaattattattattattactattataattatttttgtgcctgacatgtgggtcccactaacacgtaggtgtcatcgtggtatgccacatcagcgtacgaagtgggttagagcccttttggacctacataacacccatgacatgttcagagacccgaaaatgcattttcatagtttagagacacccgcacaagtttaaggatcttcaacatggatgtacgacccaaaaatttcctagcctaagacccttgtaggaaaatatagtaaaaaaataaaaaaaaacccttgtcatgtgaagtgtgaaatcgaagtgtggtcatctcggtcccgtatcgtgttcgttttttcgctttctcgccatatcgtgttgntatagtaacagtcatcatgccagatgacaatacgagtccgagacaaaggcagcaaactggcaagcaaggacgcatcacgatgtcatagcagcagttaccacaacagacaacaattaggagtacgagatagggacaacaaactagcacggcaagggcgcatcgtgttgtcatagtagtagtcatcacgctagacggcaactaggaatccgagatggaggcagcaaactagcatgacaaggatgagaggttatcaagcagtcaagccgacatgccaacaagctggaaagggcaaatgccgtggcacgacgtccgcgcctctctagcggccagcggatagcaaggtggcaagggcggcgcatgatggtaagttggagcacccaaatctcaaatcctagatacatcactgatcatcagcatacatgactcttgtttttataacggtttaggagttgaagtccggcggttcgaaatggaaaattggaacgtccatgaccacaacgtaggtcattgacaacatcaacatgcacgtatagagcaggatgacccgtattcccatgcgactaggttggggttgttagccaaaatcagccaacacactatagcgatcacctgaaccacaacagaggaggacgaagtagcataggataataaaacggtgcaaaccacatgtgcagtgcaaacaaacctgaaaactacagcgtgatcttacaaatagacgtatgatatttatccacatcattataaaaacctttatactcttaaatttaaatgggctatttaggaaagggaaagaagaagagagaattacctatcattaaac

SEQ ID NO: 67121 - DNA, 20243 bp, Oryza sativa
tccttacctctccataaataaagatactgaaactaaggttacaagttggaataggattggaatctgaattgtttataagttctttgttttttcaacattttgaagaggtatagataattgtgttaatatagagctatatacccctagggaggtatatatataccttctcactaggactatgggctatatattcctttctacacattccaataactataaaagtctcaccattgccaatcataaacttatcttctaattggtttaaccaatttaatctgtttataaacctccccaaggaaggaataaaatctcacttcagtagtatgtaaaaactccaactacataattgatgaccagattatagtatatgtaataactagatgatgccacgtgtgttgcggcggactattcgttcgtgtaatgcagctataaaatttcaatgtatagacatgagaaatattataaacctataaagcacgttacatatgaaaatcgaatacttcttgtagtggtttttttatagcatactacactaagtggtgaatgaatattgggataccttataatcaatgaaaaatgttaattgtcaacatttaatgtctattggatggttgtcatgaagcatggaaattatctaatggctgttgttttgtgggtgatgtggctcaaagaatgtttagtttttggtgccaactatataggatatatagtttaccaattctgctcctaacagaaaatatcaatgcaacacacaaatattgcgccatcacaagagtaggtagtaaataactgggctggcatcaagcaattgaaaactctactttaatatatcaattcagaagatatttgaaacccttctccagcatctgatgtgcttgttggagtccctgcaccacatgcacgtttatcacagtactatggtatcagtagaacggataccatcatctcaatcgggcggtaacccccatctcaatcgagcatggcgttcgtcacagcttagaagtcactgatgtgaaaagttatctcaatcgggcaaacggccgtcacagatgaacctatctcaatcgggccataattaaagctcgtcaccgatagttttaacccagacgatcagtcaaactatagcccgtcacggatgacctatctcaatcgggccaaaaactatagcccgtcacaaatgacccttatctgtgacaggcattaactatagcccgtcacagatgagtcatctcaatcgggcctaagttaatgcccgtcacagatgagtcatcacaatcgggcctaaattaatgcctgtcacagatgagtataatcccaaaaaaataaattttatttttaggcatgccatctagcctctctgagatcggcttccagaagagtagttataacttgttggtatgagtattctattaatcctattaagccctaggccaggatgtcacaccccaacatccttcattcttatacattcattcacatacacaaccatcaaaaatcctaaacaacaaaattgtataactcaccgagatctacaactattgtatcggtcctttgtacaaataagttcatttgaacaattcaaatttttaattttcaaaatttgacaacttcgaacaaaagttagggttaataaatgatttcaaatggaaaagtcaccaaaaccaaagttgtagagctcatcgaggtgcaaattttttattttggtcatttctccatccaactctacttaaacaatttaaaatttgaaattcaaagtttgagaaattcaaacagaattttttgttagtgaacgacttcaactgaaaatgtcatcaacaacaaagttgtataactcatcaagatctataacttttattttagtcatttttctatataacattttttgaaccgtttgaatttgaatttaaaaatatgacaacttcaaacaacattttcaaatactaaatgatttcaactgaaaaagttatcaacaacaaagttgaataactcatcaagatctaaaacttttattttggtcattttttcatctgataaagtaatagtaacattgttcagaaaattgacatatctctgatctggctttataaactataacacatatatgtaaaatttgtgaacaatgttactaacattttatcagatgaagaaacgaccaaaataaaagttttagatcttgatgagttatttaactttgttgttgataactttttcagttgaaatcatttaatgtttgaaaatattgtttgaagttgtcatattttaaaattcaaattcaaactgttcaaaaattgttatatagaaaaatgaccaaaataaaagttatagatcttgatgagttatacaactttattgttgatgacttttccatttgatatcatttactacgcgtaaaattattttgactcataaattgaattattatactatagttcaacttataaatataaacatttcatatgaaaaatggaaaaatactcatcggtgacgggctttagttaatgcctgatagagattaagtcatgtcaactagggattagtatatagcccatcactgatgagtcttgtgtgatgggcctcaagttggtgcacgtcacggataatggtcatctgtgacgggccccaacttaaggcccgtttgagatatggaatattatctcaatcgggcctaaagttggggcccgtcacggatgatggtcatctgtgacgggccccaactttagccccgtttgagatatagaatgttatctctatcgggcctaaactacggcccgtcactgataggtgtcatccgtgacgggcttaagttttatgcccttctaatatgtctgtgcgaccatatctcaatcgggcactttttcggcccgattgagatgacttccttgtgacggcccgctatttccaggcatgttagaggccatcacagatagaaggatctgtactagtgtatttctcattacaaatatataccacataccatttttatgtttacacgctaagtaaaattatagtcagtggtacttaaatttcaaaagttctagactggatacatgttatttgaaaggatagtatttgataagaggtaatatatatgcagtgctaggggcataccgagtttcagctgaacgttatatatgtgtgcacaactaagcctgccaatgggttggcatccaccccgaatccaacccaacccaaagtgactatagcaaaattgtcactctaatccagaccaagaattccttgagctaaccccacccaacccaacccacaaagttgctcagtccaaattcaacacaatccatgggtggaatccattttccaacccatacccaatccacggcaggaagcagagcagagcagagcagccggcgaacactaacactgcatacagctactagcatacttacaaataacataagcaagatgcaaaaataatcaatcaacgctactagcatacttagaacttttgatgctttaagtagtgccatccaacaagttttggcaactaaatattacaattatcactagagattctactagagcaacaggctcaagagaaaatctccaacaaaaaaagctatcaagcattacaagcctcagaaccatgtataactgaacatcaacaatttcttcatgtctcaatctttagattaccttctaagataaccaaaaccaaaaacccttccaattctcagccacacattcttgcagatgacagtaacctgaaagaagtagatgtcatcaaaaatttatatccaggaataactagaaaattgtgacttcgttgcttaagaaagcaaatatacaaaattacaataacaatttaaataatgtgacctttgcagtgttatcaaaacaatgtgccaaattgattcaattggtaaataatgaatagtaacattttatatacaaacagaataggcaacaaagtggtaaactcaattttggaaaaatgcaggttcaagagaagtattccattccaaatttccaatacgccaaaggaaaagttgaatttaaagttgcatatatgtatatggaaagtcacctttccatcttcttcacttcaccacctgaataaatcaggacaaatttccacctgtaaatgatatatgatcactacttcatgattgaaatacacagaacatttatggaggaatcatttatcactattataccttcagcacctggaatattgatcaaaggatcgttggctttaattaaccaatctttcgcacaaatgagagcatcaagcatttcaggtgttaacgaacttcgtgtgtcaccaagtatcctgcccctacaactgaatgctgattcggaagatacagtgctgaggggtattgctaggaaatctttggccatagctgacaataccgggaatttttgagcttgtctcttccaccagtccaaaacatcgaaactctcactatcctcctcaacatcttcttctaaatatatggcaaattctgatttcatttgccatgcagtcctccttcgagacttgtataaagcaaactcttcctcgagttttcttttcccaagaacaggtgatccaacactgttgctgccttcatgagaatgtgaaagcatgtgttcatcatttcttcttataaacccttcatatttttcataataatccttcaaccaatcttcagcagaacccactttttcgacaatctctgtcacactgttagatgttttctcataaaagaaattcaaataatctccttttcttcttggatctaacattgtggcaatgacaagtgcagagttaaacccactgtcccaatatttgacaaactttgagagcatagctgcagccaatacctttaaaatatcactagtctaccaatcagggtcattcaatgcatgacgaatttgtagcaccaagggcaagaacctatgtgctgttggtttcctatctgctgacaccgataatgtggcttcttcaaaagctttaagaaaagcacaaattgattcaactttctgtcattctagttcagtaggtgcaacttcaccatgttgatttgcatagctatccaggatagatctgtacattaatccttctacaatcattttataggtggaattccatctagtcggtgtatcaaaagaaaaactcaacttcgaaggaagatttttcgagtttgccatagaattgaaatcttgcattcttgatactgaagaatctaaatgcttcaacaactcacgtagcttgtgtattgtaggtttaattatcttcataccatcctgaaccaaaatatttaggatatgggcacaacatctaacatgcaaatgctgactctcaaacatcaatgcattcttgtgattctttatcaactcttgacatgcagaattgttattactggcattatctaaagatatagtaaacagtttgcttctaatgccccaatatgtcaagcaactcattatagcttcttcaatggcgaatcccatgtggggatacttcaattccttaaagcttataattttcttcttaatgttaaactctctatcaatatagtgtgctgtgacaaccatgtagcctatattttgaattgaagtccacatatcggatgttagacatatgtgcaaatcaagattatgtaattcagcatgcaagtcttccctcattcgctcatacaagttaaaggcatcatcacgaagtgtttgacgccccacaactttgaaagttggctgcatggactccacccactccaaaaaataaggatcctcaattttcttgaatggcacctctgcatgaatgaagaatctgaccattagctcccggcttctcttgggaacaaacacgaaatcttccccagtctgtttcttaattgttgcaaggaagttgattctagcatcaccatcaataactggacatgattcggctatgtgattaataaggtgacttgttcctgactttttggtggctgtcaatcttaagctacaatatttgcattgagtcttggggacaccatctatcattacaacctcttgctgaaagtgttcccatactttagctctcttaagtgttcttgaagattgattattatttggactattagtacctgaactctctaacatttgtatgaacgtatttattattgagtttgttcaattgtctacatagaggaagaaatctaaaatcaagatagttgaaagaacatggtctataattatttttttcacacattgtacacgtgctacaatctaaaaattacacactaaaattcgattgaccatagaattaatttgcatctcaaaatcatatcatgactcaatctgtaatgatatgttaaataatttgcattgggagatgaagggaacctgcattcactatacctccttatcttcttcttgaaatcttagaactcctgcacataaacccatcgaagattgtaatcttgagcaagttaactcctcagtaaaaccaacaaaaaaaacaaaatcttatagaaactatcacaccaatcacactgttcacatacgtcatggtacatgggcttctcagggagattggcgacgcggccggaccgccggaggaggacatcctcgccagcgcccggcggcgcacgcaccttcctcttcttctgcttcacctgcacccgcaaccaccaagatcaggaagagacccaaaaaaaaaacacaaacaaaacaaccaggatatatcaaagaccgagaaaaaccagggaaaaagaaaagcaatggtggtgggggagggaatctgaccggtgacggcttggcggcggattcgcggacggtggcggagaggtggaggaggcgaagcaaggggagggagcggcggcggcggaaggagtggagccgtggacgactgatgacgctaggtttggagagtactggactgtctagtgcatccaaagaaatccatggactgaatccaatttggatccaaaaatcagaaaccaaaaaccaatccaatccaaaccgtttccacctccaccctaaccagtccagcccattaaactcctcaatccatttccatccatccaaactacacccaaagctgaaaccaatccattgggcccatttcaatccagcccattggcaggcttatgcacaaccataaacaattaaaaattaaatggagagcaaaccaaagtagaacaaatgcttcgtgctttcaatgaaccagtgaggaagatatgtgaaggtgtgcattttttcctcgggttagtgattggacggtgaacaatctacaagagagagactacaatcgcatcgttatcaaccagagcccgactccttgggatagatggcagagcacatatacagtttgacctacaacccgagatgataacacaatagaattcgcttgacttccttagactgatggtaatagctcataggaatggaaggcatccgggatgatagtcacgcagcgcctactgcttgttctataacttgttgtatggatggcagctgttccagagcattatgggtggaacactgcatagacaaatattagaagggtgttgatgtagttagatccattgtggtctacaattggcccgagcagtgtagcgatagtaatttttccactatcgtggagcatgagaaggctactgaaccagtacaggtccaggagcattttgactacacctcaaaaactggctgttggaaagtttgatccagggccatactgttggtgtcccatcctactagttggaacagagtcggcccaatgcccaaccatgccactcatcatcatcaccttctaactaggtccttactccttagggtagccaagaggcagagatgtcattgatgtcactaagatttctttacaccattggaacaggaaaaacgaccttgacctggccattggaacaagctattgaaatacgagtgtactatttttcaagtttcgtgtaacagaggacaatcgttaaaaaaaatatctaagttaaaatgttgaaaggactgtctcagaaataatgtatcacttccatgattattctcagacctagccatcccatctcacgacaacaaaaacgatattcctggccggagccctcgtttgattgcaggacggaccataactgattgcgtcttcaaaaatcgacctctattttcacatatggctccttaacaagcacgcaaaaatcaattttcacaggcgggcctcttaaaaaggcacatatgtgaaactatattttagcatgcgggcctcttaagcaacccacctgcaagtctaatactattcctctttccctctcaccttattaaaaatttgttaacttatctctttgtcgcatctctctcccttatctttttcttactacctctcctctcatcctcactttgactgcgggggccatggtggctgtgtgatagcgggtggcgacgacgatgacgatggcgacgcgctcggggagcagcggcaacgagcgggagctgcgggctagggagaggccggtcccggccgtgagctgcgtggcggcaagggtcgggagaagcggcggcggccagccacgggggcagcggtcttcggagctgctaggagcaacgacgggctcgcgtggaaggcggcgagggggaacggcagccagcccccgccaggatccggcagcagcaaccatacccaccccggccggtccggcgttggtggctgggcaggctcggcggcaagttggcacggaggccggtgggtggtcttccttttttgtgatttctagtttttccggatttttagttttgcgtgtggaccacataagcaccacacaagcgaaaatccgattttcgcgtgcaggtgcgccgcccacatataaaaatagcgattttcgcagatcatttagtgtgtgagggctatcctaccacacgagaaaacctcttttgggccatctgcaaaattcacttttgtagtagtgtctctccgcttggaataaccccgtttcacctaacattactgatctaattagtccctccgtttcagaatataataagttttggcattcaaaatttcttagcccaatgttacaacctaatacaacttttatcaccaacctaccgattctactcgtcatcattgttttcagcaaaaaaaaaaaaaagtactaggtcccacctccaacctgggggcccaccccaggaacgcacgttcccatccacccacggtaaagagccctccatcggcatccaccacgaagttgtcgtctccactttgatggcagcaaacaaactaccagtactgagttagtacaggaataatcataaaggtagtatggtctttttctactttccttaatactctcgttcatatggtccttgaacttagtacaggaacttagtacattctggtacagagaaagtactctcgttcatatggtccttgaaagtccagtattctctctggtttcatatttctaggcgttttggataaatgtatcgtcaaacttttataacttttactgtcaatacctttaaaaatatttactttaaagatactaaaaccacgtgaatagatttgtcttacaaagtagtacaataaaagtaaaaaatgtatttatttattatatatattataattgaaattaatagttggagacatatttttgagatcatatctttgtaaaaaatgttaataattatggaaccggagtgagtagatcttttgtataccatttattgccgacttaatttgacactagcatgcagcactcttctcccagactaacgggaataagaagggcacatatatagcacatgttttgttctcaagaaggagaacaaaccttgtacaaaatagcaaattaaatgaggcaagctgaacaagtcagttatacatgacatatatatatatatattgcaggttttattattgtaccctgtaacgtttatgggaaacaggaggaatcaagagtttgagctgttcattgtacatatatactgtttagttcgtcacctccagttttgcctacaatttgaccatttgagtattactcagaaagatagagccgacacccggcattgtaaaggatttagagactcactatggtgctctctaataggagtataaaacaatctgaaccattgatctcatttgatcgatgggtttgtatctatttataccaccaccttagttagtgatagtagaaacatgaagggtcattattgtcaaaataaaagcgttgaggggtataatcgtcatttagcaatttactagactttttttctttttttttgacatttcgatgaaatacgatctatactagcgcaatagatgatcatagatggatttagctaggaaaaacataaatgacaaaataactccaaatcatcatagttgtaaattactaatttgcctctaataatgctggtaatataataccagtagagagcaccgaagcatccctcaaggatttaggggtaggggtggggttgggggatcaggctcctctaccttcaaagacatgtgcctttgtcactaatatgtgggtccaataaaccatgggcccacctgccagtgacaaagacatggtgtgcctttaaaggtagaggatcttaattcagggtggggagcccggagtatcaatgcctaagtttacaaatgttggtctactggtctataaatacgaggcaacacaaatacagcagagcacgcagcaagacagcacgagccactgcacaatttagctttagaaagtgaaagctacaagcaagtataagcaaggccactgcaatgtgagatggttgcacaatgacacgagggaaattgcttcagcctcagtatatatgcaatattatccaatatatatgcagactagcacttgcctagcttctcggaatggaaggcattaggaacaggagatgcagcatgcgtgtctttacgctgtggatatcaaacataggcagctcagcacggtggcacacaagtgtgtcatggtactgctgaccatggagcacaaaaccgagaacttcgaacatggtaatcagtcgaccatcaagacatctgtgtactgattcatgctaatgacaatattgccggatgatatgctcctgtttgctgttcctgaccatgacgtccagacgtgagaaaacagttgcatgtaaggattgatataatcatcttatttccatcatctccagtaccatgcaacaactcagttgttgtaaattattcaagtagtaatacacactactacaatagacatttttccgtgcggtcagaaacaggttttcgcgtgcagttagccctaccgcaagcgccgaagggtctacaacaatcgccatgcatgcgggtgcgccacccgcacgtgaaaaatatgggtgcttatgttacccgcacgtaaacataaaaaatcaaaaaaaaaataaattcgaacgaatccaaaaccctaaccctaaccctagaagttgctgccaccgtcgtcgcccgcctcctctgccaaaccggccataaccgccaccggatccgagcaggggacagccaccgccgctgctacatccgggcagggggcagccgcctccgccggatatgggtggggggcggtcgctgtccccctcgtcgccttccacacgcggccgactccgcgcgcacgccagccgcctccgtccgccaagacgcccgctgccgctcccgaccgctttcctcgaaccctacgcagccgctcccgagcccgttgctcgccgccccggccgccgctgcttctcccgatcccgccggcgccattaccgcgcagccgttgccgtcgccgttgcactaccgtgaggataagagagcggataagtgagaatgagaggaggagaggataagcggtcagttatggtttactgtaacctaacgagggtctcgtacatgtgctatctgtgtaacagcccaatatgcagaagtcgagagtgttagtatcctctccataacagaatataagaagttttgaggttggacacgattattaacaaattgagtagagaattaaatgtagggaggttgtaattggttgataggtgaaggtaggtggggaaattgcatggtgcagagttaaaattagttgagaaaagaatgttggtggagaagttggtatattctgaggtaaattctgagtattagaagttgttatgttttgaaatggaggacttgtaaataacaaaccaggctgttcctaaacacctaaaccgttgcatagagtgataaacaacacttttaatacatcagttattgaagtttttgaaacccatctcctgcatccacttgcatgttaaaactcttgatagctgatacactactaaaaaatcgattttcgcagtcgaaaccccctccaaactctagacaggcataattacatccgcatgaaaaagtatttggatggggttcggttaaggtcacctgtgtggagattatggataccccatacctacacggcatgtatagtccgactgggtatggggtgccatgtatagatagaatatctttaagaggactcggattaaaatctaaacttgtatgtcaaggaaatatccgagatcctagtcggttacgattgtattttatctgtaactacatattccgttagggatatggactatattttgtaatacgaaccccttcccatatataaggaggcgtctgggtgcctctaggagcacgactttctcccagatcatatgatcaataatacactcggcagatcaatccccggacaggagtagggtattacttcttaattaagaaggcctgaacctgtataaaattccttgtctctaaactcatccacttttcctgcttgatagccaccccttttaatattgccgaaatcttgtttcaacagttggcgcgccaggtaggggtagcgtcaagttcttcgccgactagtgcgatgggtttcgtttccggcatcgatgacttcgtcttccctcccgggcaggtgtttcgtttcggcagcctcgacttcatcatcaatgacttcggcaagatttctctcctcgactcggattcgaaccagtcaggaagagagcagatctccgctctgttcggtatcctgaactcggccgaggtctaccccaagatcatctctgccgagttggcttcaaaccactcggatgagatccaatctacttcaacacgacccaaacaagacgatggggcctatccgccaatcctgatgaaactccccgatgatttggctgctgtcttcaccacaaggccgtcttctccccgtaggcctaggccagatccggcttcagccccggtccggcctagctctacggaagtcggcgtcatactccagacactcgtcacggtttcgacggaacaactggacggctacctcagctcccccggggtcgactcgcggccaacagagatcgtggagtacgatgacttcggctaccgctacgactaccgcaacctcgacgacttcgacgaaggctttgaagacaactacacgcctctctacttcggcatcttcagggctgacaatgagacagaagaacagcgcaaagcctgagaagcagaagagctacgcatacaacaagaagccgaacgatgccgactggaagaggagcgccaagtacaagagcgagaacggatgcagcatgagcaacaggaacgcgaacgggccgcaaaggaggctgaggaccggcgacaacaggccttggacgccgggcgacgagcacgagagttcatcgggcagcaagacgtcgacggaactgcggtttttcgcacccctcaacagaacgcggttgcagcgatcaccctcctcgacaccctcctcaaggaagacacactcaatcaagttaatcacgttgtcaacatcttgaaccagaccaagaccatgatcgccgcctcggtcccggttaactctgcaagcgtccgcatgccgactggcagccgagttccccatcttcgatctcaagactatcaccaaccgagcctcagcgtcgccggcgcgggatcctgtcgcaggaacaggggtcacgacgagcgatctgtgcattcgcctcccgaacgacacagggagcaccgagttgaacggccatgctccccacctcgtaggcgccccgtcgatctttgtgatacaatcaaccagcgtcgcgcggcacgaggctacgctccccaccattcaccagattgccacgaagacgacgtggatgaagtcgcttcctttacaagcgacctgcgtcgagtggattggccagctggcttcaagccgactggaatcgagaagtatgacgacaccactaacccggagtcttagctcaccgtctacggtctcgcaattcacacagcaggaggagatagcaaagccatggcaaactatttgcctgtggccctagcggattctacccggtcctggcttcatgggttaccccgcggcacaatcggatcatgggcgaaacttcgcgaccacttcatcgccaacttccagggtacctttgaacgccctggtacatattttgatctctacaacgtcattcagaagtctggagaatcccttcgagattacatctgaccattttccgagcaacgcaacaagatctccgacattaccgacgatgtcctcatcgtcgccttcactaagggaattcgtcacgaagacctagtcggcaagttcgggcggaagcctcccaagacggtcaagcagatgtttgaaaaagccaatgagtatgccaaagctgaagatgccattatcgcgtccaagcagtcgggcaccacttggaagccaaagaaagatacgccgactacaggaggaagtggaagtaccaatcacaaggatcgcaagtgtaagcccaaggaacttgtggcaactacaacaccatcctcccgacaacgttcgcgcgtcaacacttttgacaagatcatgaattcccaatgtccgcatcatcccaattctaatcacgcggcgaaagattgcttcgtctacaaacagtttgcagaacaatacgccaagaacgcacgtaaggcctctgatggagatcaaagcacgtaaaagaagaaggatgatgacgatcatgccccgactggttttcaagaccatcgcaaggaactcagccacatctttggtggacccctggcttatgaatctaagaaagcaaaagctgagcgaacgagagctcaacgctgttcagcccgatacgccccaatttcttcggtggtcggagacgacaattaagtttgaccgctcggatcatcctgaccgagtggtccacccggggcggtacccctaggtactagacccagtggttcgcaacgtcaagcttcgtagatccctcatcgatagtggcagtgcactcaacatccttttcgccaaaaccctagacgacatgcagatccctcgcgcggaattaaggccgagtaatgcgccctttcacggagtcatcccagggctatctgccacaccactcggccagatcactcttccgattacttttggtactcgggagaacttccgcatagaaaacgtttgcttcgaagttgctgatttcgagacagcgtatcatgccatactcggatgcccgacgttagccaagtttatggttgtcccacactatacctacatgatgatgaagatgtctggtcctcgaggagtcatatccctgcggagtgacatcaagcaagccgtcacatacgacaaggaaagctgcgagatggcccagacccgcgagatcacgctcgcccaagaagaaatccgactagctgcgtccacagcaagcgaaggagaagtgcttgcaaccaagatgccaaagagcgaagaaagcgacgccaagaccaagaaaattcctctagatccttctgatcctactaagactgctgtaataggcgctgagttagattgtaaataggaaagcacgctcatcacctttcttcaaaataataaagatatctttgcgtggaaaccatctgatatgcctggtattcctagagaggtgattgaacactttttacatgttaaggaagacactaaaccaatcaagcaacgactccgccgtttcgcacaggataggaaggacgcgatcaaggaggaattgaccaagctgttagcagcaggcttcatcaaggaagtccttcatcccgattggctggctaacccagtcctggttcggaagaagacgggacaatggcgcatgtgtgttgattacaccgacctcaacaagtcttgccccaaagatccctttgggttgcctcgcattgaccaggtagttgactcaacggccagctacgaactactcagttttttggattgctacttagaatatcatctgatccgactaaaggaatccgactgcttaaagacttcattcatcacgcctttcggggcctactgctacatcaccatgccctttggattaaagaacgcaggagcaacttatcaacgcatgatccagagatgtttttcaacccagatcggccgcaacgttgaagcttacgtggatgacgtagtcgtcaagaccaagcagaaggatgatttgatcacgaatctagaagaaacctttgcgagcatctgcactttcaggatgaaactaaaccctgaaaagtgcatcttcggagtatcgtcagggaagctgcttggatttatggtgtcccatagaggcatacaagccaacctagagaaaatcaatgctatcctcaacatgaaactgccaagctcccagaaagatgttcaaaagctgactggttgcatggcggcgcccagccggtttgtttcacgactcggtgagcgggggatgccctttttcaagctgttgaagaaaacagacaatttccagtggggacccgaagcacaaaaggcctttgaagacttcaaaaaacttctcactactccacaagagcttcaccacatccgcaagagcctctgttgttatatgtgccggcgacttcccaggttgtaagcacagtcctagttgttgagcgtgaagaagaaggccatgttgaaaaagtccaacgaccaatctatttcgttagcgaggttttggctgattccaagacaagatatcctcaggttcaaaagctattatatggtgttttaattaccgtcaggaaactatctcactacttctaaggtcactcggtcacggtggtcacatagtttccactcggggacatacttcataatcgtgaagcaaatgggcagatcgcaaagtaggccttagaaaatatgtccttggatatatccttcaagctgcgaacttcgatcaagtcccaagctttagccgactttgtcgtcgagtggactgagtgccaagaagacatgcccgaggagaagatggagtattggaccatgcattttgatgggtcgaagaggctttcaggcaatggagccagggttgttttaatttctccgactggagaaagattgagctatgtattatggatacgtttttctgcgtcccataacgtggcggaatatgaggtgctgcttcatggattaaggatcgcgatctccttgggaattcggcgtctgatagttcgtggagattctcagttggttgttaatcaagtcatgaaagagtggtcctgcctcgatgataacatgaccgcctaccgacaggaggtacgcaagttggaagacagattcgatggacttgaactcacccatgttcttcggcacaataacgaggtagccgacagactggctaatttcggttcaaagcgagaagcagccccttctgacatattcgttgagcatctctatgagccaaccataccaaggaaagaaataattcaggctatgaacactcaagacgtaagcatgattgaagccgactggagagagcccctcataagatttttgaccaaacaagaacttcctcaagataaagatgaagccgagcggatctccaggcacagcaggctctatgtcatccatgagactgaactgtacaagaaaagtccatcgggaatcctgcaacgctgtgtgtctttagaggaggggaggcaattgctaaaggtctcaggggctactgtggagattatggatacattcaggcatctgtggtaatcacactgctgcacgaaccattattggcaaggcttatcggcagggttttttctggcctatagctgtgaccgacgccgacaaaattgtgcgaacatgtgaaggttgtcaatttttcgcccgacaaactcatctgccagctcaggagttgcaaaccatcctgttgtcttggccgttcgcggtttgggggctcgacatggtcggcccgtttaagaaggttgtcggtggttatactcatctctttgtagccgttgacaaattttccaagtggatcgaagccaaaccagtcattacaatcaaggcagacaaggctagagattttttcatcaacattgtgcaccggtttggggtacctaatcagatcatcaatgataacggaactcaattcaccggcggaatatttaaagacttttgtgaagacttcggcattaaaatttgttatgcctccgtagcgcaccccatgagcaatggacaagttgaacgtgccaatggtatggtactctaaggaataaaagcacgagttttcgaccggctgcatccctatgccggcaagtgggtagaatagctaccgtctgtactcttgtccctgcgcaccactcccagtcgggctacgggccagtcgccgtttttcctggtctatggagcggaagcaatgttgccaagtgaggtggaatttgaatctctacgatttcgtaacttcagcgaggagcgctacggagaagaccgagtagatgacctcaaccgactggaagatgcccgtgaagcagccttaattcagtcggctcggtatttgcaagggatgagccgttatcacaatcgcaatgttcgatcacgagcctttttagtcggcgacctggttctgagaagaattcagactacacgggatcgccacaagttatctcccttatgggaaggaccattcataatttctgaagtcactcggccaggttcttaccgactcaagcgtgaagacggtactcctatcgacaactcttggaatatcgaacatcttcgtcgattttatggttaggcattacttttatatttccctctttgactgccaacatcaagttattccttgagttaccaatcgggggctactataataataatggagtgtgatttttatcaattcaatttgcttacttgatttatcattgccttgcttgattttttggcttagtcaacgaggactgaaagttttttaataacttttgcaggttttaggctcaataaggtttgaaaaaagctattaagaaatcaggagctaagtttgaaatatcaggcacagcataaattcatcagtactgtacaaattgtgcctccatcatcatcatcatcatcatcataatcattgttatcaatcagtatcagttttttcatcatcggaattatcagatccagtcggccgaaggtcgttatcctggaatctctcaactgtatcaatggctatcttatcggcggctttctacgcatcgttgatgaggtcaagggcggcctcttcgctcgtcccgtctacaaagccatcaatggcgtcaatgtcaatcttcgggtataaagacttggtcattgccaatgccaggcttgctcccatacttccagcttccttgatattcttaaagtatgtatccggagcaattctcagctagtcgaagatttcggaagcatcaaatgttctcggaccattgttattgaagaacatggcttggacgagtggggtagcagcgttggcgacttcatccctagcccttcaagcctcttgattttattgaccaagacatcaaattgagccttagatttaatcttgcaatctacacaaatagatttacattaacgagtgggcataaagaaaggaatgatttttgcaatatgggttacccgtaccttcaacatcttttagagccgaatccctttgtcttgccaattcggtcttgtcattctccagagcttggatccacttttccagctcggatatcttggcagcttgcactgcattgcttcttgttggttgatatcacatgcatggcagcataagtaagttagacggagattgtattaccttttgacgaaccgctcagttcgaagttggagtcttgaagctcggcgatccgatccctcagatcatgctcagttttccttgcaagctccttagcttcgtgcagctggtttctggtggcctcaagggttccaagatggggaactaacctctcaagagtcgcagtcttcgcctcgttcctgaaatggattctctgcaatgcgaatttatcggcatttgagcaaagtggcaaacaa

SEQ ID NO: 67122 - DNA, 9300 bp, Oryza sativa
aattccctgaggttgcatgtcatcatcccaccacttgactagaatgggtgggcgagaatcctcagctgattgtatccgaagaacctcttcctcatcaccggtcatcggaccttacatggttatggataatgagtgaggtagttgaagaaagtttgttggatcaagatgggtttggaggatgtttttacctgtgataatttccggtcgggaacaagtacgtccttgtactttaacaggagagctggaccctggatcggcactggcatcctttttaggagggctggcggcttgagcttctacttcaggaatatccttatttggttctgtacccgactggtttctagtcgggggcttctgatcagcattggctccagcttcggcaagttattgatttctacattgtcggttgccggctagttgtcactcgggcgattttctacagtcggcccggttccttttgaagaatccgtctccacatttgtcaattcagcgtcctttcctacgagtttgagttatgctatcaacgctatttcaatagtgggtgagtagcaatacaaagaagatggccatatgatttgtacctggaagattttctgatttttggcataggacgactggaagttttcttcttcggattagtttgccttggtagttttccagtcgcttctttgttgctagtcttctcagcatcgtcgccctcatcatcactcagaaccaatttcctcttacgagagtctgactggctagttgatttcgaggtgtttggttgagtatcagaccgaatttttggtcctccactcgcctgaccagcttgccggcggggtgatcggcgttaagcggttggaggatccgacttcatcaaagcaaattcctgggcatgatatttcaaactttcaattagcttaacagaagataaaggcatacttttgagaaaggatgaaatgtttgaatacataccggtggaggaggattgaaggcgttatatggcaccactggcagcaaatgcgaataactgaccacgatagcgtttgagaagattttgtacattctctcctttatgaccttaaaatcaagagggtatggatcttcacggtttgggtcatgcttgccgtcaaattcaaaggctgtacgggatctctctttaattagagctagccggctcttgataaaatgccgggtgatctgttctccttgcagaccttgctctttcagcttcagcatgcgatccatcaggacaagtgcctgggctgcttcctctcccattggaagtgagttccaagtgtcgtgataaaccggagaagacaggagtattcggggagcgcaggctcggggttttgtagatagaaccaatttgcatgccagcctttgtttgaggttttgaagggcatggaaaaatacttttggccatggaaaaacacttgctcacgacagtttagcctaatgctgttaaaatcctttttgacgcagttagataattctttggaattactacgatgcaaataaaaaggtgcccaacagaaaagtgttatactagttttgtaagtctttttaggctgcaaaagctgttcgggttttattgagatgactggtttttgaatagttattctctcggcatgttatatgcttattttgattatggcgtgagttatagtctaggctatttagactcgtcaattttcatgatatcacatttataccacatttgatggatctttttgagtttttactcggatttttgtcttatgtgttgatctatggaccgttagagtattttctactcgggcctctttatatcttcatttttggtatattacggctaaagcagttggatggatgttattgacaccttgactatatgtttagtttttaactaataacatagtcgggggctacacctaattaggtgcatcttgtcgatgcacccgattttttctattttcagcccttcacagtctttaattttggtactcgggagatcaatacagaagaaattgaagcactcggattatcattttacgttctgagagaaggttatctcgtcgactttaaaggtttcaggggctactgtggagattatggataccccatacctacacggcatgtatagtccaactgggtatggggtgccatgtatagatagaatatcttaaagaggacttgggttaaaatctaaacttgtatgtcaaggaaatatctgagatcctagtcggttacgattgtattttatctgtaactacatattccattagggatatagactgtattttgtaatacggaccacttccgctatacaaggaggggtctgggtgcctctaggggcacgattttctcccagatcatacgatcaataatacactcggcggacaatctccgaacaggagtagggtattacttcttaatttagaaggcctgaacctgtataaaaattccttgtctctaaacccatccacttttccagcttgatagccatcccttttagtattgccgaaatcttgtttcgacaacctgccaaaatgattttttgtcagtggagcgtaacggccgtccacccttcattattttccccccaaaaccgtgtgcccacacttccacaactcaccatttcaatcacactccctcctttctctctctgccactcatcactccgccaacatgctctctcccacggtcccctcaatacccccaccctactctctccccccatccccgtgccccatatcttccccaccctctactctctcccacactctctctatgtggcggtgcggcggtgtcaatggcctcagacggcaatggcaaccgtatcagcggcggatccacagccgaagagcttaggaagggcggatccgcctccagtggccttgggagcggtggatccacccttgcacgccatagagagaggaggtggaaaggtggtgcggcaatcacggcaatggtggcggctggctcataggctacggtggcggcacccaacaactgcgtgcgacctagggtattagacttattctatttttttctaaaaaaaatgttgcaagcggcttccttaggatgcctgtctacaaaaatggtttttcacatgcagttgtgatgcccccactcaaaaaataccaatttttgcagacatctggctctagacgtgtgctcctcctgcctgcggaaacaggttggccgcatgcaaagatcattttcgtagtagtgatattacatttcgttcaaataggacttcaaaatctactatgtcttccgtttaccattatttatacccggtttcattcaccattccgcaacgagcaacaatggaacgtacgctcttgcatataccttcttggaatggtaggcatgtgtgacttgagatgcactctggaggtctctggtctcgagccatcacccagtgtgggcagctcctgcatctggagattgagacgttggaacttcatgatctgtccagtatcaatctgtcattaccataagaacctaaccacgggatattctaatactctaataaggatagctcggactgctgctgacctggtgctgtagacctgcctcgaattgcagaaaaactggtttacattgaacatgggtgcaaggattaaattataaagtttgcattatctcggccaactccaatacgatgttaaaaaaagtttgttcatcattaatgattggacagtatatatattatctttgcaatgacgaaatattgagcaatcacgtgacaaagttgtcaaatgaatagttttatttttgtcatcttagaaacaagtactgattgtatagagtagtagtatttagttgaagagcgttgctatggtccggcagaaagtaccgctcggtactggtaccgcacggtaccagagcgaattcaatcggtgggcaagatgggaaatgtgttgcgcgcgtggttggaggacgaaaatcgagcggcgccgcaagggtttatcctctccgttccttccccgcagctcatcctcatctcgtctctttcgaattgccttgcatggcgccagcgtcctctccgtcttcgcatcgccttgcacggcgccggcgtctctctatcttcgttgcgccgcgccacggcaccgtcgtctctcccttcgccgtgccaccggcgtcgccctggacttcgccggagaagctccgccaagcacaccgcccttggctttgccggacaacctgcgccaagaacaaaacgaatcgctgctgcaacgctcggcttcagatcggatcagaaagagagccctaggatttctcctgcctcaaaccgaatcgatctctcatgatatgcgaagttacgcatttgcccttccacgtctccaccaactcgtggtacggctcacaatcaaccacggtacctcgcggtaccctcatttacagaccattcgatcctctcgaatggacggcccagatttcgtaccacaaggtaccgtgcctccctgcaggaccgtaaaaaagctcttagttgaaagtttctaatttgtgagaacagggaacgttaatgaaatatcgaaattaacaagttcagtggcacatttcattatttctagttatgaatctcctgaaagcgctttcccatatctccttgtggcatatcctccttagagcaaatactgctagctcttatccaagagtcctttgtacatgctcaagagaaatacattaaattgataagcgaaaaaaagtagagatgacattataactaatccactatacatgtttattgtgctaatcctatatatttataaagtttgtctctactaaatgtaattaatgttaattttcttttctctcgtgaagccacaccatctcaattatttttagcctttgcattattcatcaagggtacaaattatatcttttatccctcaaaagctacactatacaactaatcatttgaataatgatcaagttactaaatatataagcatataaagaaaaatcgtatagtacgatataaaactttacaactcatatctgttattttgtcacatacttctgcagcgatccacgcggtactcttctagtattagatgagcttatagccgatagttagctcaactattaaacttgcgcatataacatgacagtgcttctagtatagatgtattattatgaaaatatttaaagcagagcccacatggacgttaaagtctttaatagctgacattatatttcattcacatagtcctcgaaaatctggtttacttttcttgtgtcatttatggccgatcgattttatttaccattttaatttcatgccagttttacatttaagccgtccagattcagcagcttgattgcagattacaaagccacagcggatgcaccattacacaatctactagcttttaaatgtggaggccagctgaaggaaccggataaattaatttgcacaacaagttttactcctatccggcaacagctactggcttaagatcgagtaagctagaagtgcaaggtgcagagcaaaaaaactgaaacatccattttacacttgcacgtctgtctagcttctgggaatggaaggcatgatggatttgggatgcactacgcaaagagtccaatctccagccttcatccatggacacctcgtccattgattcctggacttcctcctctactcgcacgctgagaattcagaacatggctgatagtgatcagtccactgtcggcgcactggtgtgcgtatcaccggaagctggcctgaggattccacacaaaatgtggtgattcctcttcatgctcgttatgatggcctccttcggacaggctgcggtcaggttgatctggagaaatagcatgcgcgcgacactgctctctcagactactaactggatgaaggatgcatggcacatacgatacacgtctcattgccgagcagcagaactaaccttgagattacaagaaaggaagtgaggcaagctgaacaagccagttttaaatggcgtataatacagtgcttctaggtaccttagaatagttatgaggaacatgagacatctaggtaccttagaacacccttgtcgtgaacaaactaaaggatttgggggcaggagcagcttgcagcacgtgtgccacagtttagaatcaacatggttggcgattgacagcagcgctctgtcaggcttcactaaaaattgtggaaaagtaaataaagtgtattaatcttcaaaattacggatccccttggggtctacttatagtttttacagtgcaagtttatacagccctatgtctcccatgtattaggcaatttacatgaccgcgcttacgatagagacgtttacaagggtaattatagacaatcaacccatctaaccaccgtcaggtctctatagatcggtccagctaggcatcgacttgcttcgcctaatggcagaggttcttcgctgcgccccctcagcggggagtctgagcttcgccctcagcttgatgctttgcttcttcggtgcttcgcctcaaggctgggtaagctgtttcggcggggttggccgaaggccctcttgacatgcctccaagaaaaatcatgacggaagatcacacatccatgttgctttcctggtaggaaacgttggcgaagttgacgggaatggtagacctgtgtgagcttcatagatcatccatggtacactcgcacctacctatatttgattctcatactgccacatatacaggcttgcaacgaaaatgtggtaagcagagaacaaggtcgagctatcccgctggcatagaacattttttttgaagggatgaattcttagcactggatattcttcatgtacttgacatgcaaattagtcaaggtatcatgattcttttgccaaactcatctttaaaacctgatttctgatggttcagctgagaaaagttaaggagaacaaaatgtgcctgcaactattatatatcagtgtgctagaaattgaggaacaactacatcggtcggtgtgttcatcttctagtttccttctaagttgggctgtcgcagtgtaatacattttttttaatacatgcccctgtataatctaagtacttctaatacaacatcaatatttgaactatttgaatagcttctacttcagactcaacatgtttgttgaagtccttcagagctgacaatgtttttcattcatatagttctcgaaaatcaaatagatttttttttgctggttgcctattttactatcattgtaattctttgatagctgaccatacatttcttttgctgaatatgtagcacccacctatttgattctgagcagatcaaactccgctttgcagagcacacagccacacaaaccatcattcgttatgcaattttaggtggttgtgtacaactactttggatgtagaggctgagttttaatccactttctaaaaaataaaagcaatttagcatttaaaaggcggagcccaggagcaagtgcaactacatacctgttgttatatatgtggaaggctctacacttgcagataagagtaagctatgaatacacggcacagacaaaggaatctgcagttctttagtcagagtcatgagatggatgcacgacaataggaggccacaacaaagcactgtacatccagttcatatggatgcctagcttatcggaatggaaggcacgagggatttgagatgcactacacaagactccagtctccggccttcttccataagcagcacgcacctggcatgaagaactgagtcatggtcgtccccctcaacggtgatatcaagagcccatcctctcaataattctatcactattaagccactaagtagactagcagtccattaaggctgacatagcatgcattcgccataccatgcttcctttctttttcgtttttaatgattttctgagttaatgtttcctagcctcgcagagggagaaccatctcttagggtaatcccatcccatagtgtccgtaggtagtgtctagagaagaaagagggcaataaatatccatttaggcataatcttctccaatgtatagtgcccatggctgtgtttgtggagaaaacaaattaaatgcctttattatgcatgtgcaaggatcagctacggcaaaaatcctaaagatcagatatggaaaaggggtggacgacacaaaggtcaagatatctagaaaaatatctagggtaagaaacaactaatcacctccaacgctactttggctagtattcagggccttgatgcacacgccgatctagtttcctgcatgtgacattgtttcatcttttttcttgctctccgttctttaattaccatgccacatatgcatccgaattttgatcgggtggcatcccgataaattctatacacaccagcttacgtggtgggttgggactgccattaatggtacatttgaatctgctctttaaactgctttgtaatctttcttgcctagaacaagttctggtcaataagtggaaggcaaccatttgggtctatcagactgcagcaacagttttgcaatttagctcaaaaagtagagtcaaattcttcagggtgcagacttgttatttgcatgaatggctgtagtcgctaaccttagagtgtgtaatgtacataataagcaaaacgatcgcaatacacccgatgcatgtgtggagattataggcactaggtatctacatgatcaatatatctggctgctattaggagatggaccatgactgtgatatttgtaattgtacacattttaattgctagagtttccttgcctgtttggacatgaccctaggttctaactaggttatcttttgtaatactaaagaaagtttatgccgagttcggtcgggtttcctacttgtacccttaccttcttttttttagataatgatgtacccttacctcctaacctatataagggtggggagcccttgaagagtatatagcgaaacgcaccgagatcgtcaaatcaatacaataccaagcgaatataatcactaaacatgaatagggtattatctctcattgagagggtctaaatatgtctaaacctttgtctttgtatccatccggttttacaactcgtacactaccctttttattattgcccgtataaaacatcaataacatgattgcaccacaacgtcggtgaactccttcatccccccatcatataagatagtgtgcatatactgcttcatgccaagctcgttggaatgggaggcatgtgggacttgcgatccactatgcaactcttcgtgatccatccatcgtcctcatttggctctgttcgtgcgtgaaggactggagacaatccccgatgctgcacagtgcacacggagaatgg

SEQ ID NO: 67123 - DNA, 2653 bp, Oryza sativa
tatattattatgaacatatttaaagcagagcccacagggacgttaaagtgtttagttcatagctgacagtatatttcattcacatagtcctcgaaaacctggtatacttttcttgtgtcattttctgccgacatattttatttacaattttaatttcctggccgacatgacatttctaccgataaacaagcaccttatatatttaggccggccagattcatcagcttgattgcagagtgcaaagccacacgggatgcaccattacacaatctagcttttaaatgtgattaaatatggaggccagctgaaggaaccgaataaattaatttgcacaccaagttgtatccggcaacagctactggcttaagagagtatgctagaagtgcaactgtgcagaacaagcaaggcaatacatccatttgggaatggaaggcatgagggatttgggatgcactagacaagcgtccaggctccagccttcatccatcgacacctctgccattgattcgtagacttcctcttctagttgtgcaggggttgatggtgatcagtcgaccatgtggtgattcctcttcatgctcgttgtgatggcctcctttatacgggctgaggtcaggtcgatctagttagaaaatcgcctggtgaaaagcagcatgtgacactactctctcggagtactaactggaagaactaattggaagaagcagggcatataaggcacacgtcttgttgtcgagcagcagaagtaagcttgagaatacatgaaagctagtgagaggcaagctgaacaagccagttttaaatagcatatactccctccgtttcaggttataagatgttttgatttttgtcaaagtcaaactgcttcaagtttaaccaaatttgtagaaaaataataataatattttcaactcaatacagatttattatgaaaatattttcaattattaatttaataaaactaatttggtattagaaatattactatatttgttcataaacttagtccaatttaaagtagtttgactttaaccaaagtcaaaacgtcttataacctaaaacaaaaggagtattacagtgcttcgaggtaccctagaatagttatgaggaacatgagacatccggagtttcagctgttcgtcgaagtacacccttatgtcgtgaacaaactaagatatgatggctttccacatcaagacggaagaacgcacaaccatgtagctttccttataggaactgtgtgggcttcctagatgatccagggtacactagcaccttcctatatttgattctcatattgctgctactcatacaggcttgcaagtcgcaaggaaaatgttgtaagcagggaacatggtcgagcgatcccgatgtcataaaacctttttttttcgaagggatgaattcttagcactggatattctttcatgaactagacatgcaaattagtcaaggtatcatgattcttttgccagactcatctcgaagacctgctttctgatggttcagccgagaaaagttaaggagaacaaaatgtcccagcaactattatatatctgtgtgctagaaattgaggaacaactacatcagtcagtataggtcaacctgcatggacatgtttgcagtgtattgaaaatatcccacattcctacccctatcaaagccgtacatgtgtatgggtacactgttggagaaagggttttcacctacggttcgtaacccccttatataaagatgttaaaataaccggaactaaaagttcatctttattaccggttagtaacatcaaccgggattaaagaggtgaatctttattcccggtttggtattaccaagtccttcagagctaacaatgttttttgttcacataattaatgcaaatctagtagatttttttttgccggttacctattttactaatcattgtaaatattttgtatctgaccatacatttgtgttgctgaatatgtagcacctatctatttgattctgagccgatcaaactctgctttgcagagtgcacagccacacaaaccatccttccttatgcaattttagctggttctgtacaactactttggatgtagaggctgggttttaatccattttcttaaacataaaagcaatttaccatttaaaaggcggagcctaggagcaagtagtgcaactacatacctattgttatatatgtggaaggccttgcacttgcagataagagtaagctatgagtgcaaatcgcaaacaaaaaaatctgcagttccttagtcagagtcgtgagaaggatgcacaataacaggaggccataacaaaccaatatacatccaatttataaacatgtctagcttatcggaatggaaggcacgagggatttgagatgcactacacaagactccggactacggcgttcttccataagcagcacgctattggcgtgaagaactgagttatggtccttgtcctcaatggtgataacaggagcttggagcatgggcgagcccatcctctcaataactttatcatcattaagccattaagtagacaatgtgactagcagttcattaagcctgccatagcatgcattgccatacatgcatgtttcttttttcttgaaaaagggattgccgagttaatgtttcctagccttgtcgaggga

SEQ ID NO: 67124 - DNA, 19679 bp, Oryza sativa
ttcctgcagcccttcaatgtatagtgtccatagctgtgtctacagatgaaacaaattaaatatctttactgtgtatatgcaaggatcagctatagcaaaaatcctaaagatcagatatggcataggggaggacgacacaaagaatcaggatatctagaaaaatatcgagggtaagaaacaactaatcacccccaatgctgctttggttagtattcagggccttgatgcacacaccgatctagtttcgtgcatgtgatattgtttcctcttttttcttgctctcccttctttaattaccatgccacatccaaattttgatcaagtggcatcataagaaattctatacacatcagcttacgtggtgggttgtgactgccgttaatggtatatttgaatctgctctttaaactgctttgtaatctttcttccctagagcaagtgctggtcaataagtggcaggcaactcatttgggtgtatcataatgcaggaacagttttgcaatttagctcaaaagtagagtcaacttcttcagggttcagacttgttctttgcatgaatggctgtactcgctaaccttagagtgagtacattacatattaagcggaataattaattatttgtcactcttagagtggtgataaaagatttgccactgaatccacatatcatagacagaagagagtccacgtgtcatagacagtgagtggtaaataaacaattaccacatcttaaaagtggtaaaatttaaatgtcccataataagcaaaacgaccgcaatacacccgatgcatgtgtggagattatagacaccagatgtctacaaggtcaatatatatgactgctattagaagatggaccatggctgtggtatttgtatttatatacattttagttgctagagtttccttgccggttaggatatgaccctaggttctaaccaggtaatattttgtaatactaaagaaagtttatgccgagttcggtcgggttttctacttgtacccttagcttctttttttagataatgatgtacccttacctcctaacctatataagggtggggagcccttcaagaggatatagtgaaacacaccaagattgtcatatcaatacaacaccaagcaaatataatcactaaacagaagtagggtattatcgctactgagagggtctgaatatgtctaaagctttgtctttgtatccatccggttttacaccttgtgcactacccattttgttattgccggtataaaacatcgcgataacttgattgcaccacaacatcggtgaactgcttcattccccttcacataagacagtgtgcatatactgctacatgccaagctcgttggaatgggaggcatgtgggacatgcgatccactatgcaactctacgggatccatccatcgtccttgtttggctctgttcgttagtgaaggactggagacaatccccgacgctgcactcggagagtggaaacttggaacctggtggtgtgtgcgccctttgggtaccttcgaaacaccataagttagccaaggaaatgcacctgataaatccctctcgcatgcaggtcattgttgacagacccagggacgaccaaggggagaaccagatatgttgatgtgctcagcccatttcaaccagcttcagtgacaagctaaaattctcttaacattagtaaatgacaatatttttccagacaaatataaatatgccattatgatgttttcaaacttataataaacaacatggcagcgcacacagcgagacaactcagaccattgtgtaatttggctttaataagtggaggacccaagcaactgaaatacggagtaaatggcatcccctaaaaaaaactgaaataaaatttagacattgttgtttaggtggatagctctgctcagtatgcgaggagtgcacggagcagagagtaatcagtaagcaaggattataaagagcagagtaagcaacacgactgcaatgttagatgattgacaacataacatgcctagctgttcggaatgggaggtatgacgaacttcaggatttgagaaagttcgcaagtttgtagcatccagccttcacctatgggcagtttgaccaagttgtgaagaacagagtcgatcatggcccgtgtttagttctttggctaaattttttttacgtatacggacacacatttgaagtattaaatagactaataacaaaacaaattacagatttcgtctgtaaattgtgagacgaaactattaaacctaattaatccgtcattagcaaatatttactgtagcaccacatttgtcaaatcattgcgtaattaggctcaaaagatttgtctcgtaattgacatgcaaactctgtaattggtttttttttcgtccacatttaatgctacatacatatatccaaacatttgatgtgatggaattttcggaagtttgaagctaactaaacatggccatgatacccctcctggaggttaaactgaaaaatctcggaggtagtgagtccattctgtctgtgtcagcatagcagtacaagctggctgcaacataacagggtcaagttatttcgcccaagtccaatgacacgacgaaatcccctgtctaatgtttgtagtatttgtattaatattgagcaatcacgagggtaagcagaaaatgcggagtaactagcttggttggttgcaatccactggatagtgtgatgaacacactgatgtaaggcactaatccgaagttaccattttatttaaagaaaaattttaccatccaacattgataccttgaggtagtataaatttttggtaactcgagatactttttagtatacctcgaggtatcaatgtttgttgttaaaattgctcttatttaaaagtagttaatgtactccctccttacctaaatgtttgacgccgttgacttttttaaacatgtttgaccgttgtcttattcaaaaacttttgtgaaatgtgtaaagtatatctatacataaaagtatatttaacaatgaatcaaatgataggaaaagaattaataattacttaaattttttgaataagacgaacggtcaaacatttttaaaaaagtcaacggcgataaatattttgggatggaagcagtattaaagttactaggggtgcaagttacagagcaagcgagaaaactgcagatctctgcaacccaaagttgtgagacgattgcactaagacaggaggtaaattacttgaggctgcatacatccaacttatacaaattcacttgtctatctacttggaatggaaggcatcaaggatttcaactccaccagattagtctctccaagctgcacacttcacccaaagagtgggttgtcccggcagtggagaactgagtcatagacatcctcctgaaccatgttggctagaacttggactgtgtgatcagtccaacctctaagtatctccctacctgtaggaaggcatggatgaagtcggagggtaggaaagttaactaggagaaaacctgcatcagagtatggcaaaaaatttgtttgcattaaatttgtttgcaaggaatgatacattcagctttactgcgacaaactgcaagtgttttaagtaccacgtcagaaactgcttgaccgttgttattaaacataggaacagaacatgcagtattattcgtgcaacattcttcttgtttcgcataacaaatgacagtagttcaaaaagaataagaaaagtgattttttacggtccagcgctcggtaccaaaaattgaaccattgaatccaggatgggtaggatcgggacagaaaatgagcaagggtgaatgtgctcgtaaatcccggcactgcaggcagcggcatcatcgatccatgcggcggtgacattgaagtgttcaatcccagtggtgaggactcgtcgattccagcaatctaggcaaccgccgattgaagacgtcattcccggtggtggcggagttgaagtccaggcgttgaagttgtcgatctaggcggcggcgaggactcgtcgatcctggcggagtagaatcccagcgccgactggctgaagagtaggaatcccgacgccgatgggtggcaggagcaggagtcattctcggcgcatacgggcggagaaggaggctagatgcaaggcaggcggcggtggatcgcggtacattgttgcacacaaagttacatttttgccattccacctctgtcctccgagaggtaccgcattagggacacaattggtacctcaggataccaaactctaccagccgttggaattttggtacctctcaatattttacactcgaaaatgtggtaactcatagtatcttctcaacgatcataaaataaatccaagtacatacatgtggcagagcagaaggtgtaccagactgttaatgatgtaacacaatatgtacacaagtattttctttacaataagatagatggggaaatgacaagctatgttgaaggtagaaaaatacatcatgcaacaatttaacagcatgacaatcatagtttaccgtggaagacttccggataacataaattcttcctgcaggctatagcaacctggagatgctaaattagccatactgttgattccaatccccgtagcttgatgataatctacatgtccttctgattgtggagtttgcagctcatcgctatcttctggagaaactgtgcctgatctgaaacctttatttcttatagattgtaatgacatctctacttgcttcatagttggccgttcttcacctctaagcctcaagcatgcccgggcaattgaggcgacaatgttaatttcatcctcagttgcttcttcaagaacttcaggagcagctatctctgcaactggccttccttttagctcagaaaggaagtaaatagataaatttttctttgaaccagattcactgtcaaaaataggttgcttcctgagaagcagctctaaaagaacaacaccaaaactgtagacatcactcttctcatttagatgcccggtatggtagtactcaggatctaagtacccaaatgtgccttggatatttgtaaaaacatgggtttgatcattaggaatcagtcttgataccccaaaatctgataccttagcggtgtagttggcatccaaaagtatattcgaagatttcacgtcacgatgtaaaacagatactgatgctgcagagtggaggtaatataaagctcccgcagcttcggtggcaattctcaagcactgatcccaggacaatgtgaattctctcatacttggatcagcgtgaataatgcaatttagtgagccatttgggacaaagtcatacaccagtagagggacttcggtttcaagacaacatccaaatagttttacaatgttccgatgatttatctgcgatagtattgcaacttcgttgatgaactgactaatctcttcttccctaatgatgtttggtttttttatagctaccacacgctggtcggacaatatgcccttgtaaaccataccatgccctccactaccaagaacacgtgctggatcaaagttatttgttgcctctttcagctcttctagggtgaaaatttttgtgctatcagtagcgcattcatcagatgatataagttgctctagaagaaggccttgattttttcgaaaatatttcttccttaattgcttttggatatcattctttcttttacggacaaggaatgctacggttaagacaagaagaagaattccgaaaccaactcctaggccaattgcaatacctagaaaaacatatacacatgttagtttatttattttttcaattagatgtaacgacaagtaaaagtttcatgaggtaatttaaatgaaaccatacatctaagattagtttaatattcagtgaatattattttgtctacttgtttaatgctgtgaaagagaccggcattacaaaacccaagttattttaatttttttgaaatatttgtagaatgcaaaatacattgtgctacttcctttttaaatgattttaaggggcccaaatgcatttcatgtgaactttaaagcaaatattggctataaaaaatcttgcagtattctgaggatatgtgtttaccgaatgctagtggaaactcttttcggcatggtccaacagaagcatctcctcgagtacccgcagggcaaaaacaatcgaatcctccaagtttgttgatgcacttcccatagcaagggtacttattagaatcctcacactcgttaatatctacaatcatatttcacattgatgtcaaaatttatgatgttactcccaagaaaacaaatattgcttgatggcatgcagtaagctaaaaaaaagttgtatataacactattaacaagctttgtttcgattatggctaaagagtacagtttgaggtttagccacccagaatgttacagacatggatcaaaacatgggtgagttgctaacaccaaagtttacatgcatttaattattaataacacattcaaaattttgtgtctccatgatatgtgctggttctagaaccgacaccaagaaggaacaccgatgagagatggtcactagtgccagttctaaaacaaaaccaacacttacagtgctgtctgcgattttgattttgcttacatgtcatgttgaagatccattaaactgagcaattaatcttagcatgtggcagctatgataaattcattcttgcgccaagaagcatgcataccataactggaagttattaaaccatggtaaaattggaaagacgccatttcgaattagctatttagtcaaaaaaaaagcaagttacattaactctacttcttttaggattacattaactcttttttttgacctaagtcgctgtattttgaaaattattaacgaagatatgcaccgaatggttaaatttatagtattaatgattagtaaacataactcatgcaacgcacgggttggtgattagtaaacgcaatatctgtaaatcataggcgtagtgaaatattcaccttggcaaccatcatgaccctgaaggtaaggattcccctcaaatccttgagaacatttgcagaagtatcctggtccattgctcgagtcaatacacacgctgttgctgctagcacatgcatatgaatctaaatgttttcttgcttcggcgcaggtattgtttgctacaacccagtccaccacaaatggaggctcaccaccgaaagggttgctgaaattcgatgacgtggcataaatcgtggagaatttgaagctggcctcctccactaacgctccataactgcaacgggaccaattgtggatgactgatgtgttgaagtgtgtgtcaaaccaaaccttgtagtgcttgatccctttggggatggccgtctgacagcagcctatcccagagcatccttcaccattgatgcttaaaagatcatcaccctggccacaactggtggcacagccaattgttaggttactgcctacggcgctctgcccaccaggaccgaggtaaccaagcattcgacatccaaagaccgtgaacttgttggcactgttagagaatgtgaaaggacttcccgtcaagctcagatttgccttgtcgacgcagtccatgtcatgtttcgtcatgttgtagcattcgtatgacataggcatcctcatgcgagcctaaccttctggcaacgagatgttgagcagctccacattccggagaagcagcttgggtatgctgttaccggtactgttgcagatcagctcaaaaccaggcatggcgcagccagcctgacctttgatgccgaatggaaaagggatatctatgctaccacaacttctctggcaggtggatgctgcaactacagcaagaccacctgaagttgctatggtgagacatagtagagtagggaagatcaatgcctgaatcatctttgttgctggaaaaaataagattgctagctagatgttgtccacctttgtgtccaaggtctggtatatatagctccatatgagtgatataagtttattagctagcaattttagctttctcagttttttatgcaattttagctttcgctttttccatatttttcccagctaaaatgaaattactctcataaagtacaagtcctcacacccattaatatcagcaatcgtattctccgattttcatatctcgtatttccgatgtacttaaatgaaagacaccagaattatctgatatagatttataattgtcatacatttattgaaaaaaaaagatggagtattatctattagcttcatcagaatgcaccgctcgaaataccttgacttggactttttctaggtcttcctcacttattgctttaccaggaatttccatgactagttgttttcacaacaccaactctatttatgaatccaattaaataattcatttgcctgcatatccatggacatacatcacaccagcttgtcataacccgattcaatcgtatacagaagaaatgcatgggtatgaataattgtctagctttgcatccaatgaattctagctctaccagggagattcttttctattgcagtataatattttagataatggagagtctgatgtctgcacatcgcgcatccagctacctaaagttcgcaatgacaaaaatccaagactatgcacctgccaaattgggacaagagatcgttctctacccactccaactctgtagatccattgagcacattatccggacacggaaacgagccgatcggaaatataatctacaaagattataaatacagcaacaccgcacatggccaacatacagtgcaccagtcccatcaatattttgtaatggcatatatatatgcatcctccttaattaaatggcagatcggtttgtaattttcgattcaagccaatgcatcgagccagctttttgtttttttcattcctagaaccttaaaggtgcaggttcctaaacatcaccattgagtcctcctcaaaggcgccgcctgctagttgctggttcagaaatccaacacctatgaccagttcctaaccggcaccgatctccttctctgtagtagtgataattattccgtttataggaaaaaatggttataatgtcttgttaacttaacatctttcatttttttttctaaaagaaaggttttattttacatacttttaaaaaatataatctggacatttggaattcaatacgatgcatacttttctcgtatataatatccataaaaagaagtgattggccccacgtgatgttcccctgcctcttttttctcctatgaaatgatatcacttatgttagatatttactcactctgttgcaaaatactatgactttttgaaatttgacacaggtatcaaggagaaatgtaaactaaaattatggatgatttttgattggttaagatgaaaaagtaggcagataaatcaaattgaagatggttgtgatttgttgagaggaagaaaaggttgctatatttttaggaaaacatggaatgttaaaggtaactacatttgggatggaaggagtatttagcaaggggatgagggaggactaccttaagctgcatctcttttaaggagaattgaaagacactttcccactgaaacttatatttgcatgtacttcttatactcacttacctattcacctttcataatccttgcggtacaactctttctatactttttaacatcaggagcatttgaagaatttctaatgctccatcaatccaaaagtcattatattttattttatggttgtttcatttaccccccttaactatcacggtcattcgatttaccccccttaactacaaaaccaaacatttgacaccctcaattatttataccgaacaaattacccccctcaatagtattttgagcagttttaagttgagcgtgcacatgtcgggccaacgtggaaatccaatcagtaaaaaaaatgcttccccggcgcccacctgtcatacccctccctcaacccaatacttccccatcactctctctctcacacacacatacacacactcctctcacacacacacacacacacacacacacacacacacacacccgggcggctggctgtggaggaggaggcggactgggtggccggcgttgagaggctaacgaggagcttgcccgggcgactggcggcggaggcggagctcctctaggaggtccgacggtagagatggagatcgcccacgcggcggaggaggtggaccgggttgctggcggcagaggcggagaacacacgagcggctggtgactgaggcagagctcacacgggagacaagcggctgaggcggggatcgcccgggcggtgggcggcaggcagcggaggcggggctggtgccgcacgcggcagagagcttgctctcccatgacggccctccctgccgcgcccgccacccgcccttccccgccgtgacctccatttggaccaccgccgctgccttctctgcctggaccaccgccgccgcgctgcactgcaggaaaggggtgggcggcatgctaggagacggcggcaggctcgtcgccgccttcatgagagctacggctccaccgccgcagatcccaactggcggcgccgcgacggtaggtccaagcggcaccgtatcgacggcagtatccggatgcagaggcccgaggcagagaggttgaccctcgaggactcgcgtcgttgcttggccttcccgctcgtcaagatcgatgggtgagacacggccgagggagaggatgtggcggggacgctgccttccaccgcgtatgttactgccactgctgccgccgcctaatgcacgctgtcttcatccgctgtctcatggtggtcgtcgctgccttcctctacctccaaccgcttcgggttgattcgggggggtgattcatccaatatgtaatgctcgagatgtaaaatatctggttttgtagttaaggggataaatcaaatgaccgtggtagttcagggggaaaatccatactttttccttttcaaaaatgagatggtcgtaatggtagtctcgatgcatctaacacataattgaagatcttgcctttttgctagattatattgttgaccggaacctgagcagccatcttaagactcgttacagacctggatgcatgcatacaaaagaaacttctatgggataggttaatactcactgcatgcaggcaaaagtttagttacatgctgatgagttaatttgctgttggtcttcacaacaaaagatatacgccagggacttttgcatgccgtctgtatcccgttgattcatcttaattttagttgtaagaggaaataaccaaagtgtctcacattaataggaaaatagtattttcaacggtatatttgtttttaggggttgggaacccttcctgcctagccggcaaaacaaacactacagcatgacacaaaatccccaacggaaaatcggttagcaaagaccacattcaaagacaaactgtccgtcggcaaaagtatagatgaattatttccatatgattttggatgggaatgtttggacatggtgtagtgaagagatggaacagcatatgattatttattagctaaaaaactgaaaaagttgattaatatggtttttaaaaggaaattttaaatagaccctttatattaaagacacactatttagcagtctagcaagcgtgcacgtaaaaaacggtaaaaaacgaggtgatagaagtttggaaagaggagaaaagaacacacaccaatacctcttccatcccaaaatatgtagagatacctcttaccatttgtgccaaaattagtggatttatatctcctttcctacctcaatcgaggagttgatatatatatttaaaatctcttacatactatgctagtgagttgatatatggaacgaggtgatttttttccctacatacagatttgtatcccagtctctacaaactaacttcttttgagggatgaatgttaccgtgctctctaccagtagaaatgatgtgtggaccgttcattcctaaggtcatcttagtactcgactaactcaatgattagggtaagtttgccattagcttttttgttctcttgatcgctggcagattgctcacattcgataaaattaaaaaaaaaaaagttgctcacctcgctcgtgaaatcctctcgccgacggctccttcggtccttccgccggccactctcgttgttgattacatcattgccaacacgagcgccgcttgttccattccggccattgctgacagtgtcaatcatcaagcatgcaggagtctcctgtaatattattgttgatccatcccgcgatgcataagcagttgtttgcctgactcatattcttcttgacaataccaatgtgtgtgtgtgtatatatatatatatagacacacactgttgggatgcaaatacgcgtgcgagacaaaaatatatttggttgccatgggtgtgaaactactggggatgtctctgttcatcggcggcggccgtcagttcgtccaacggtggcagccgactgaggggaagactgtttcactcgatcggctagggttagtcagtgctaaatgatgatttcatcccaccgcacctatttttctttttttttgacaattatatccttttatgtttcttctgccgtctactgaggtggtaatagaaataaatctagctagacccttggatcaaaatagatacacggttccaatacttctcaacttttggacctagggtaacttcgaagctagaaataattaatcctagctttgtgaaaaaattttaacactcgatagtcattaaaacttttttacacattttaaacagtggaaatgtcttggtgagatgaagtaacgtgtatgcatctaaagtggtagtactttcctgcaaatgactaatcatatcgcactattgaagaattgatctttactgggtcatgcaaaattcacattagtcccggttcgagtaggaactaggactaaatacggtttaaaaacccacgggtacttttttgatatttagtcccagttggtaacaccaacggggactaaatatcaattagagaaagatggggggtccattagactaaatatcggagccttgtgtccttggattcaaaaacatgtcagacaccccattatctttagtcccggttggtgttatgaaccgggacgaaagatccacctttaatccttgttgtttttactaaccgagaccaaaattaaaaaatcgcgaacagctgccctgagaggggcgcagagccacgcgccttgtcctacccgcctccttatctcctcacacctcatcctccccgcctccctatctcctcatcctctcctcctcccctctcatgttctcaccctctcctcctccccttcccctctcctcctcctcctcccctgacgatggtgatgatggtgatagcgggcggcgccctggtggaagcggccatggcagcgcatgaggcggcaggcggacggtggcctcccctccactatatccggcgggaggagaggctgggcggtggaagcggtcgccgcggcgggctgccgagaggcagcggcagcggccgggaggcggcgcacggccgggtggcctcccctctgctagatccggcgttgaggggaggccaggcgtcaaaagcggccgcgacggcgtccgggaggcagtgtactgctgggcggctggcggcgccgaggctttcgtggtttttttttattttttgaatgatttgcaaattttgttgtagatttttttagatttgaggatgaatttgtgaatgactcgtggattgtagatgattttttggatgggcatgtgaattgtggatgatttgttgtggatttgggcgtgacaatataattgctagtagcaaaaaaataatggagaaaaaagatccatcttttgtcccggttattttatccgaggataaagatgtgtatctttagtcccggattagacgtcccagtttgcaacctggcactaaaaggggttgcaaaccgagactaaagagcccttccctagcagtgtcagaggtctgcgaaggagagtagttgcaattattgctggatcctctggagttgtaggttacagcacataaatataatgaattttggagggtgtgacgcatcttaatactacgaatttacataggtgtatatatcacatctcttcaaaatccaatatattgtgggacagagggagtgcatggtatgtagcttcatggggtcaattttccagattaaatgcatagaaaaggaacagtcaattcaggtcagttcaaatgcttggtggaatgattattaagcaagactcatttcaactggagtagttaacttgtctccttcgcccccattactacttcttcattgattatctggtgtaaccaccgtccattttttctttgatatttcacagcgaaaggtccactgaacttgaaaattttatttcggacaatctttcactcatggactttttttttatttactttatccattagttaaataggctactgtaggatttggaaaaatattgcatagagtaagtatcactaacaataggcgttgttttccatacatactcacaggttatgccaagcattatggtgtttgctaatttcaatggagtgtgtattattcaggatatgagctgaaaaacaggacagggggtggccattgtccagaaagcacatcagacacaaaggggctgttttaattttttttttgggtaaaacttggcttagtttaatttttttatctctcaactctttgagcaagctaacaaataaatggtagtatggataaatgcttatattgactattttacaaaactactgtcgtgggggcggatgttatctaacttcagaagataaagtgatgggctttattgtgttttgttgttgaggggaaaaaagggtctgagatgtggtaatagaaatttttttttcccttgagatcaatacttgtataaaaaaaatatagtaaaagtactatatcctccctccattccaaatataagcatttgtagaattcaaaattttatactaaaaattccaatacaggggaatttaagaatttttttcgccaatcatattgttaggagaggaatcgaagcaagtcaagatttataatttgagtactagaggggtgactaagactagaatggaatctttctctttttctcaatagttgagaaaaaacaagaaatgttatatttagtaatagaggattactatttaaggactatgaacgataaagacgccgtggtcagtttccacgtaatattgatgagatgtcataatcctcaagtcagtcaatcttagattcctaaggagcaacgaattgaccttaggaatccaagtgaaaatatcaaaaactggattaaggcacacacatgtccatgacatattaacagcttcttcaagtctcatgcatgactcagtcacaccatgtgacctacgctgatcacgcattgacagggagtgctgacactctgagtctaaatcacattgaattcgatgaaaatcctagtagatatttgtggttacctagtcagctaatctacaggttttgcgtacaatgccttggactactcatatctgtacgtgcttcataatttgttgaactgcataaaatggccgatgtaaaacacacagcttgaatttcttgaaattttatactatttatagcatagtatttttacggtatctccagcagcggagctagctcccgggcaggttgggcgtttgtccatgctttctccactacgaccgatagctatgggttactgtcgacgaaaaacgctatcagtcgctcgggttaacggcgtcgctgagtacctgttaagctatcaggaggtatggaacttcatattatagaatttgacgcctcttacaactcaggtatcgcaataactgtaaaatttgtttatttaaatatatttaatccatttggctggactagcataatagatttcagataaattacataaaattgttcctggtgttaaatttagcagttgaaccgtagaataaattacaccatctcgcctgtacctaaccaacggacattcaagagacaaaccggagtagacaacagcaatctttaacaaaaaggaaaagaaaaaaacgttgatagttacaacagggcgctgcaatatatgtgcacaaacgcccagtaactaattaggaatcaaccgcaataaaggaatgcatccttgttctaggtatttactcccaatacatagtttgctccagagagtgagaggcagagagttgcatagcagcataagtagcagccatcggcagacattggcagctcgatggcagagaacacaaaccatacccccacataagccatgtgttttggctagacaggttggacgatatctcaaagaacaaactcaccgagttgctcgcatagatgttggtggctaatcggaatggaaggcctttgggatatcgctcgtgcatcggtggattctcagattacaccgtaccttttctcgcatggatggtgcacctgcttctgcattcagggatcaaaacttcacggacaaacatacttgaaagtagctgctggagctgtgatgtgcgacgacagaggaagatacaagacagcggcagcccaattttgtacgcaaggcgagatgatggtggaagttatggcattgctgtagagcagctgaatttacagatccggatcctccctgcggtaattcataggaacactgtgtcaacagttcatcgtgtataccgctacaatgaagtgatgtaacactgtagcaaattagcttctctatagtttattcctcaatgcagaggatctcgatcctgaactgatagttaagctaggaggaacgaaagtcatcatcgaaacatatgctatggaattggcgaggatggtgtattttgaaacagtaggagctaaaccggtctatcattggaccatgatctaagaactaaagtcgaggctaagagttttctaggaattaaagataatctaggtttgaccctcgtccctcagtgaatatggtcgcgcataagttttctcatttcctccggtttttatttcatacttccttgatgatgattgtaagaaaccttaatgtggcttcaatagagtgctactactatcgtcccaaaataagttcatttctccaatacaaaacaaaaaaacaaaaaggattggaatgcatctactttatcaaatctcaaatctcagtacaattattcattgctttatcttttcccaatacatttattctctactttcacaaactctgatgcaatttggtggaaccgagttagtgatctcgcgggtattgtcatcaaaacaacggtctttaccaacatgatggaactcgacatctttgactcgatgccatatgaaaactgcagtgtcaccaatcctgtcatgtgacatgtggtcgatttagtgacatatcggtcgactctccaactctccagattttggaccctcacaattagttagcgtttcctccgaatttatgtttagacgcttctaagtgtactcctaccagacatacttgtacaaattaaggaaatagtgaatttaccattctacccttcatcccctcccatctctaccttatccatgccaagcttttgtacggggagatggcaaggagtgtcaaataaaaaaaagatgattcccgaatgacttgcgatgtcatgcaagaaaggatggagggagtagctttttcttctgcaattatatttgcacataaatatttgccccaattgtagattctatgcctatcacctactcgcggccaacataatactttagtattactattcatcaacattgtacatcaatttggtaggcattcacagaataccaagtttgaatcatattataattttgttacaacttttagtttactttatggatttccaaatatttataaagatatattgccagtaccattaagtgggaggggggggagaaacgatatgataacaagatttatgttgtgcacatattcttttcactgcaatatattcgtgtctaattcttgagtatatacattacttaaattcgtgttctgtcttagaccaagttctacgtgggacctaaatttcagttaatgatatctttgtgtgagacagtggctcactgaaatctcggttaactaggtgaaataccgcgcattgctgcgagagtttagtatgacaataataagtaaaaataatgcgtaagatagctaaataatattaacttacttaagttgatgtggtttatcataatttaaatttaaacactaaatagaatgatggttcaaatgtaaaaagtaaggtgacgtggctctctgagagaagaaaagtaatgagatagtttgaactttgaaccatagattaatcgtttaagacgacttgatgagagaagagagaaataacactacgtaaggataaactaaataggtatatatgataatataaaaaataacgatttaacatacttgtattttcaaactataaaatttaataaattataaaattatagataatatagcatgcttacatgatgtttaattaaatgtagtaattgctagtggctgatgattttgcatcttgttagtgtatgatgatacgacatctttgtctgttaagttttagaatttagtgtgttacaactttatactaagataggatatgactatgttggatctttgtcacgccccgaactaatcccgaccggaactagcccgtgacgctccaaattaacctgttgatcgataccagtcccaggaaacagtgctggtatcacagggagacagaatatcacagcaacagcggtctctttattatagagtagagatacagtcatgttgggctatggacagatcccgagctcacaactgcattacaaaagggaaacggaagccaggactaggaccaaccaacacaggcgtgacttgggaactaggccgaaaccctaaaactcatcgtagccggcttgctcctggaagaactcctcatcagcaggatccgttttatcttcttcagtaattggggggtatatttatatagagcaagggtgagtacgggagtactcagcaagccaagggaaataagtgtttaatgcaggcttcaaggaaaggctgttgtttttgcagttgattttatttgaactcttttctaaaaacaactaagtgagtgcttctcaaatgacacggttgagacagtgcgtcacgtccgctcggagtatgtgcaatgtatcagtctttagacttgaattaaggttggcacccggccaacagcttttcaaacggccacccgggccaacaactttcaaacggccacccgggcctagctgatcccatcagctgcagatttttcaaacagcgaacccctttccacaacagcaatttcacaagcagtagtcaaacaaaactacgctaggaatcacctcacatccgcccataaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccaacgagaggggtcccagaccaacaacaggttaggtcccagaccatactgtgccaggaagcccaggggtcctccccg

SEQ ID NO: 67125 - DNA, 6431 bp, Oryza sativa
tatgtctacttaaggttcctgttatagttttcaatatagctggacacttcaatctgttcctttcaacttctcgtgccatcccataatttccttgggtccaggaaagagcatcaaatacccgtccacacaagtttcgatgaatctcatgcttatccaagtgtgttcccagggtgaacctagcattctatgttccttaggttctcaaccttgacctatttgtgttgccttgtccatcttatttggcatgttcaaatatacccggttaatctcaaatgattctcaaatggttagttcaatctcatcgtggtttaacttatgattgtgtcctttcagcagtgatagctgattcattcagttgttaccacaggggaagaactcttctttctaactactctgctgcagagccaaagcttcctttcttttcaaatgcagtatgtccctatggtggatttttcttaccattgatcatgtgtatatgctctttgccaaattcttcaatcacaagaatttggtcgccttgtttggcatgctcaaatattcccagtcgattagttctatattgtgtcctttcaggagtgatgactgattccttctcatgattatgtcctttctgcagtgatggctgtttccttccattgttagtgtggggggatagttcctttttctaactgttctgtttcagaaccaaagcttcattttcttttcaaataccccatgtcctatgatgggtttttcatagctataatcgtttgtgtataatctttgccaacctcttcaatcacaatatgcagacagaatttctggtgttctgcatattgcttgcgattgtttccgctggatataaggactacgctaatatttaactttagaagttaattattttagtaaaactcacttagctgtcatctcctttgaacttccacttcaattcagattttagagccatggcctaccaaacaggccctacattttccagataggttccattgctcaatgtttttttggctcaaatttcttaatctcatcgttggcaggagcctttggcatgttctcagatttggtttgttatcaactgtgtattgtaggcaattttggtcatagcaacactgggtacaaacttgtactcaagcaagagttacaattgacaacatgagtacattgactagggcgtgcagtttttttagatggttagggcatgcagttgccactggtgcaacgtaatagttggagtctcctttgtaaatagaggatacgagattctgaatttttgtagcaaatagtcaatgattttttcacccttgtgtagatgagtggcattcgcatgttctgtattcttgaggataaatttcaacggttttcttctgaaatgcagaatatgtggtcttgttggtaaactgttgtcttggactagtccatgctatgcaattttgagcaattcgcatctggttgtaaaccgatatattctatgggttgtgtttacgaacgtgactattgttgagataatatgatgtcattatctttgtttatcttctgtggttcgaaccaaacattactaacagaactactccgtgatatgttatttgtgaaagcaatattcatagttgcaaacataagctagtgagatgcacagtaactagttatcaaaacgaaaaagaggctagctgactctgctcgtcatgcatgatatgtatgaatttttgtaggttactactgatatcagttcatcgatgctgcatcatgcatgaactgcaggttactactgatattgttttgggcattagcaggtttcagaattgaactttcgactgttgctgcgcgcacacaaaataaccttcactgcaaaaatttagtatgacgtatttgcaactactggtaaactcatattgtcacgttagcattatccgagacaaatctatgcttttcaggttaataagctaaatatttcagaaaacgtataataataacagttactccggtgattttggaaatttgactacggtgacgacttgttatcttgatcgaaatgagcgccgtatgaatcccttcttcggacttttgagtttacagagcagctgctgatggaagcaaacctgaggtaaatactgaggagctttgctctattggggatttgggggtggggtacatatccaaggaggtccagacaactggatttgatctatttctcctaaaatatactctctccggttccatattaattgatgttttggacaaggttgaggtcaaatttttataacttagactatcaataactttagaaatatttagtttaaagaaactataacaacatatatagatttgtcttttaaaatattataataaaagtaaacatagatttatttattatatatattataatagaaaaataaggtcaaagatgtatcttgtagaccgtgtcattgtccaaaacgtcaattaaaatgaaaccggagggagtaagttgtttgtgcttttattattattatttttaagaaaaagaagaaaatttatgctagccatggatttcagtctccttgctggataggataattgccagtggctgaaattacccagtcagaaagaaaataacttaccttatcttgtattgtcacaggctcagaatttatctatttccccccttgatagtaataataataccatctttggcagagaaacccagattcttaccttctgaagtcccctcattcctgatttggagtaaatatttgagtagcatctgaatgtgatgccctagctagtgaccatatattaacattcagttcttttagataatggattaaaacctggcctctatatccaaactcggatgtacatggccaaattaacatccagttcttcatccaccttcatatcagaacattccagaatacagattgcaatggcatccattggcaccacatgttttgactgattctttcactgtttcttgatatatttgttgatttttaatggtaaatagctcatctgtccaatcctggcaccacataatttcccctgttaaaacagtgccaacacaaatttactcatgtccactgaaaatccccagaggataacgttctggcactgccatatcaggaccggaccatacgcggcgcgccacgtggcgcgccggcggtcacacctgtgctggtgcaccctggcattatccccatccaccatcctgtgggtgactggccaccaaaggtttttggcgccacaattatattgagctgccattgcttctcacctctgctttgcatccatccatccatcagagatcaggtagaacagtgagagtgaggtgcagaaaaatttgagctgaagctgaggatggcaacatccatgatcacctcgccgctggtggcgccggcccgggccaagggccttccgtccatctcccgccggggatcctccttcgccatcgtctgcagcggtgggaagaagatcaagaccgacaagccctacggtctgaaactgaaactttcttcagaattcagacttcggaatgttttgctgattattgttgagtgggtttcagtggctgaatttgtgtggtttatcatttttctttttttttttttatctttgcagggattggaggtggcatgtcagtcgatattgatgcatctggcaggaagagcacggtcaggacttgtccccagctcctaaatttctcaatgtcagtcgaagtttttgctagttattcttcatggtggtggctagattttaaaaagaaagcaccataggtttcaaactttaaaacttgcaagaataattgccccatatttgtccaagtttcagtgacaatttcgcaggttttgttcattcaaagattccatctgtcagactatgcactgaataaactgacagatttttgtgatggatgcaggggaagggtgtgtaccaattcgttgacaagtacggcgcaaacgtcgacggctacaggtaaccaagatgagatataaaattaatattaaaagagtacttttacggtggtatctacttgttttagcaaaaattgtttggctcaatctgacaaactcctcgacgatttgcagcccaatctactcgccggaggaatggtctcccaccggtgacacctacgttggtggtaagtaaaccattcttttacagtccatttactatatatatgaaatactactatcataccagcaaagaagtcttggaataatttttagaaaaaggagagaaacaataagaggtatgctgtaagttagaataaccaaatctaatagatatatatatatatatatatatatatatatatatatatatatatatatatatatgcatatgttgagttagtccatcgtagttaactacttcatctattctaaaatataacgatttctagcatccagaatttgtctcaaaataaaacaactcttcactaacattatctttccatccaatcacaatcctccaccattcaccacaacttgcaccatttaattatatatactttcttaataattgtgtcttaactctaaaacttcttatattctgggacggaaatagtagtaggtacaaaatctgatagggtcttgtcagcaacctgtgatgtgatggagagttcttacaccctagaaatcataaaggcaaaatcttatcttgatcaatattattaagaaacttataattcttttgtatggtcaatcttatctgcctatatgcttgtacggttaattaattatatatctctgtattgtggtaattaatctgcaggaaccaccgggcttctgatctgggccgtgaccctcgccgggctcctcggcggcggcgccctcctcgtctacaacaccagcgccctcgccggctaaatttcacccaaatccagtctatgtatgtaacaccaagctgggtgtctgcatattcatctgtaatctaagatagccttcctctgaatgcgatgtgatgatgcccactgcttaatcaaactgcattgtgattaatctatgtaacactgtacttgcatgatgatgatatactacacttgatacttgaatttggagattaattgttgatactaaatacatagattacataaggttatcttgcattattgggccttctctctagtgcatatagttagctcaatgaacatgcaaattaaagtgagaagagtaaaatatccaatagctagttgactctcttacttattacggatcccaatttaaagctaaggactgaatttatttggattggtttatgtatggtccagtcaagtactcctacttcactccagatatgccaagggacaatacaggcatacagtgtgtggttcagtctatgtctagctatcttaggtgaaaacgatactactaccacatgaaattctaccagcagaggccgtagtacagagctgacgaaaatatgtggaccttcttgtcccgtgaatagttggatatttacgtggacggacaacccctgtcaaaacagttttcacaggcaaagtgagataaaagattgcctccaagtctacatgtcggtgagagatgaatatttttgagacaacatatagttgaaatcatgggctatattacataaaagttaaccatagattttcagcacaaaagataacaaccaaaagtaataattaactagttgggcctactacaacaaaaattagcaattagctacctataaaaaactacttccgatgaatctaagtgttttcatggggtcttaagatgcccgactaggtaaatattcatccccaggcgctgttcttaattgcctgcgtgtgacttgtttattgtctgctcattccactacttccactacatgtagttctatcatgatcatgcgggctcctctaaagtccaaccgctggactctagtcacgttctccattaccacgccgtgcctcatcatatctcactctccatctattttccagtaaaaagagggcaatgtgggttttcttagcactcttcctctctctgcattctcctttatctctgaccatgttgggctcgccacgccaaccgcagtacatgaccattggcgaagaggaaaaggtcatgttgaacaccgacgaggagcaaatctcctcaacgccgccaccgtcacttagtaatgtgtaggatagagatgatgagtggtggtagaacgggtcgtcgctaaaggtggattctccttagctatcatgctggtagctggcaaagctacagagaacacgctagtggtgcctcttctagatctctgtctttgcctctagctccgatggtgcctcctctgtgttgtccgccagctcaacctccgccaagtcacttgcctctcgtttatccatgctaggggccaggtaccttctccgtgttagccatcggctcgccctctgctacaaccgcgctagccacccccacgactacaccgactactattgctgccacgccgaccggggctgcaggaat

SEQ ID NO: 67126 - DNA, 2533 bp, Oryza sativa
actgtctgtggccgtcacccgggaggagccacgccggcacctgctgggaggaaggagtgaagggggagagggggatggagggggaggtctaaggaggagtgaggccttttttgcagccggatgtctttacattccacctgcaaaaattaattttcacatgcgtggtcttaagacgcccgcatataaaaataacccttattttgtaggcataccttttaaaaccatgtatgtgaaaatcgattttcgcagacaggactagttctattcaacctttagctatttttgtaaatggtgatttttgtagtccgtctggaaaaataaaatcatgatgttgggaaaaatagtttttctagtggtgtgattttggtttcacctgtgtggtaaatgcatgattaacatcttctagtcccacaagtcaaaaacccatgcagtgcacgagctagctactcctgaaccattgatctcatttgatcaagtgtttagatctatttatactaccacgctagttagcagtagcagaaacatggaggaacattactttttaaaaaaaggtgcggaggtgtcatgcccagaaattcgctaactcgaatttcaagtagaatgtgtattaaaatccctgtccaggaccagccagagtacacaaatgacaatttaataaacagatccacgtcttacaaaaacaataaaataaatcttacaaacgcaacggaaaaaacaaataaattagacttaatcttcacgaccaaaagcatagcttcctccataaaccacaagcaatcctcgacgttcggaacaagctcaatcctcgaagaactcaccatctaaaccaatctctgcctcggggggggggataaagcaagactatgtaccaatcaccgtactcaacaagtcataccagcaggaaggtatgatgcaagatattctcaaaggaatggctcattggatatttgcaataaaagcagcatttataaatcatattttaaataagtaaaacaatatatataattaagtagtattaaatcatcactgtcgaacgctaaagccacattgtgacaggcccaaccaaatcacctgaactacaccagttttacaagtcatattattatagtgagactaatcacggtgagctagttgaccgcctaataaccgcgggcacggctattcgaatagttttccacaagactcattccacacatgttaccatgcctcgaagtactgccacgatactgcaaagggggaaatcatgacaaaacccttcatataaccctccctaatcgaacatacccacctcaggtttcaccccctccttgtgccaagtcgtgcagtcccctctcatgcctaggtaaatccggaaacaacaaagattaatatccaggcccgaactacaccattgcctctacccttgccatggtatgtcagctaggttaagttatactctagatttagcctaaagcccatgctggttatcatcatataattaaggactaaattataatgaatcccattgtgaactagttgatctaagcatggctaagcattcctaaacatatcatctagtcaattataacccaagttatcaatagcataagatattcaacaggccgagtatgataggcatccatcccacacgacattctaaaacaatgcaatttaatagaaagcaggggattttataaaataggctcaacatgatcaatcctgtatgtatgacttgccttgctcttgtgctgatgaaacctcggcaaccacttcgaaataaactggatcaccgaaactgacagaatctaaacgacaaacaaagcatacaagaaatacaagcaataaggctaccgaaacagcaaaagaatccaattttaatggattctatacattttaacgagttcactgcacttgaatgggttaaaacacttgaatgggttaaaacagagctcagattatttagttatgaattttacaatatgagctgcgttattacaaataaccgaaaaaccttaatcatttattacgtattattgcccaaagataaatagatcaatggaaatatatctccggtaagcaagcctcacgaattagcgactccacaagccaatactttgtgacccgggaccatccaaacggtcaaccgaaccggcgaatggaaccagcggctcaaaacgactataaactaaagaacgactgaacgaactaatactttgacaacactacacgcgaacgaacggttagcggcttaacgaacggctgtggcaaaggcggcaactaagcactattagcggcaacgactcggtacagcaaacgataggccggtaggtatgggcagcgagaaaaccacaacgacgacgcgggaccgcggcagcggcacggctaggtggtggcggctcggctcggctcaggggcggcagcgacggctgcagcagcggctcggcgcgtggcaggggcaaggcgacggcggcgcggttgggcggctgcggctcagcagtgactagggcaacggcgcgcatggcagtggctacacacgacacggcgacacacgaaa

SEQ ID NO: 67127 - DNA, 1724 bp, Oryza sativa
tgaatgattcttgcacttctctggtggtttgggagagaaaggtgacaaggtggtggaacaagagtcccaagagctgataaatcccattgagatgctgacccaggaagatttagagggaactcagaatgattggctgacaatgggtgaaaaaaacttgttggatgatgagatggagaggtgtcaaattcccactgattctgacatagaaaggttgagggaggaagaaaatagagatgatgaatagagctttcaagaggtgtctcataagaagaaaagtagggggagaaaaactgaacctacaattacatccaggatgagcttaaggaatagggagttggctgatgttcctgtcaccaggagggctagaattctcactcagaagaagaacatggaaggtaatgcttcaaacccttttgctatttttcagctgctagattcagttgagttaaataaaattgctattgctgctaagatagatttgggtagtacttctactgagattgatactaatttagaatccttgaaatcaaaagagatagcccatgctaaactagctgaactaaactggaaaaaagagatggaaaattgaaaagtaaggagggtaatgtagaaaaatctgaggaggtgaatcaaaagttaggaaaagaggttgtggctaaaaaagtaagatgccattagaggaggtggctgctgaaaagagccctgagctgataaagagaggtggtgtgttcaaacaaaggaaaaaaaaatgattatcttgttctagaatattagagggttaggtagtgtagctagaggtggacaactgaaagagctgatcaaagaaaagagggtgtacattatctgtttacaagaaactaagaaagaggtgttcttagatagagagttgaattccttccaaggagggaggtcttttgtgtggtgctgaaagcatccagggggacttctggtggcattcttgtaggtgtgaattctgagatgtttgaggttatctctactcatgccggagcttatttcctatgttgtgttttgaaaaataagaaagatgactatctctaggaaatcataggtgtgtgtggtcctgtggacaatcacttgaagggtgggtttttagatgagttgaaatggcatattcagggtaatgattacccctttatattaggtggagactttaagttgtatagatttgcttgggaaaaatccaatgctaatgttgactctaggaatatgttgttgtttaactcttttattgctgatttagatttgagagagacttttaggaatggacctaagtatacttggactaataagcaagagtgccctgctcaggaagtcctagatagagttctaatgaatgatagttgggatattaagttcccctctgctctgctctcttccctccctagagtaggttctgaccatactcctcttcttcttgacactgatgaggaaagggaaagaagctgtagttactttaagttcgagtcagcctggcttgctgaaaatgggtttaaggagatggtttgtcataagatgttagaaagagatagttcctatattttagagttctggactagaaagcaatcagagatgagaaaatttttgacaggttgggtgtcgcgaccgagaaaattgcattttcccgaacgctagtgtattaatccccgtcccaggaaaagccggggtacaccatacaaacatgatataaaagacacatctttatt

SEQ ID NO: 67128 - DNA, 22860 bp, Oryza sativa
aatatttggatcagcaaatgatttgatcattagttattctgtgcagagatgcttttccaactttacagcgaagcatataattaccaataatcccatttttacccttttgatttatcctagttttctcatcagttataaagacttatgaatttctttgtatttattttctctgcaggttgggttaccaaatgttggcaaatccactttctttaacatagtaacaaagctgtctatcccagctgagaacttccctttctgtaccatcgacccaaatgaggcacgggtatatgttccagatgagagatttgattggctttgtcaactttacaagccaaagagtgaggtttgtttctttcctacactataatgtgcaacttcttttcttatgtttcaagacatatcatgtcttctgaatttctttgcaggtgtctgcatatctagaaatcaatgacatagccgggcttgttagaggagcccatgctggggagggtttgggcaatgccttcctatcccatatacgcgctgttgatggaatttttcatgtattgagtatgttcctgttacttatcattttgattggatcttgcatattgagtgtgtagtcatggacttgtgctattgtttcagtgtgaagcaaagtaaacgttgtgattgttctagtgaaagcattggtgctcagattcgaatcaattttctttgcttttttgtttaaccagtaatcacaaggtcatgcacttcatgaatgctgcttatgtttatcaggagcatttgaagacaaagaagttactcatattgatgattcagtggatcctgttagagatttggaaactattggtgaagagctgagactcaaggtttttatagggatgcttgatttgcacgtcagtaaatgctttggttaaaccttcttttaaatcctatcgcactttcttttgcaggacattgagtttgtgcagaacaaaattgatgaccttgagaaatcaatgaagagaagcaatgataagcagctgaaactcgagcatgaattatgtgagaaggtggggcacctgttacagccaacctctgtgttgctaaatttgtctgttagcagccttgcataatttcaaattgttattttcttgagtgagtggaagcttacttttggcttctcttcctaacaggtcaaagcccatcttgaagatggaaaggatgtccgctttggagattggaaaagtgctgacattgagatcttgaataccttccagctacttacagctaagccagttgtctatttggtacgtatttttgtcatctgtatgccagtttatttgagatgttataaagtagttttcatgatgaggtgttcagttgttctttgtgagatttcagttttgttattttcgtgcttctgcatttagagactcagtaataatgtcagtacgttgattcatggctatacatgcttttgaatttatacaatagtgcccatgaatagcgcatattgttttctattagcaagataaacttggaatagtgcaaaacttatcctgtggactttctgttgtgccctgtttgtctgtttcagtcttcctcctattatgtaatgtttattttgaggcatcaagcaatattctgaagcagtgaataatactttcttgttttatgtatgggaactctacctatatatcattttcagagcacacaatcaactataacccaaatagtcactaatcgtgtaattagctgtatacccacctaacctaacatggatattttagttgacctgtcagaaattgaaagggagatgctagtatgttacctttccttgcatatggtaatttttttttaataaaagtagagctatatattgtttaatgactgttttgtttttgcaggtgaacatgagtgagaaggactaccagaggaaaaagaacaagttcctacctaagatacatgcctggtattgttctctagtatatagtaactatttcttgaagggattaaggtgtaatggaaaataaggcaaactgttgttttttattttcagggttcaggaacatggtggtgaaactattattccttttagctgtgcttttgaaaggttgctagcggatatgcccccggatgaagctgctaaatattgtgctgaaaaccagattgcaaggcaagccatgtcacactcatataccattaaatgttctttatgtgtttagcttagttccaaaaaaaccaaaggtaaattgcttgatttggaatcaagcaaatcaagcaatactgtcacactcatatatgagtccttttacttggattttatttcctgagtgacgcaatagtgatgcctattttttggttgggtcactacgtgtctttgaggtgaattccatttggtcatactttctataagatacattatatgactatgattctataaacaccaatagaactatcaaaccagcaagagtctttttagttgcatgttgtttaccatatattgtagcttcttttttatatgattcaaaatttctgatctgtcattagttgcttgtccttaagcattctctattttttgctgcagtgtgatcccaaaaattatcaagactggttttgcagcaatccatcttatatactttttcactgctggccctgacgaggtatattttttctggtcatattatgcttatcttacactattacttgttgattttaatataatccatcttttacttcccatgttgctatatgacagtagcattgccctttaacaattgtgttgtgcaatttgctgcactttgttttaagtaatacgcagtactccctcctacaaaagttatacatattacttttaccaccatgaccaaggagaaattaaactcatcttgcatgtaacaaagataaggagtgtatgcacgcatgcaaccaatgagtattaagatggctcctcgggttttgatcaaacatttaatttacctatccatttaaatcttggatgcatacacactacaaataggaacaacttatttgggaaaactaaaatatgaaataggtctaattcttgtggatggagtactttctttagttcttattttttatgttcttaatagttcaaatgcaagcgatgtgaaaattttagttttatacattcttgtttaaatatatgtttgaaatacattttgctggattagtgacatagatggattttctgttcaggtaaagtgttggcagatcagacgtcaaactaaagcacctcaagctgctggtacaattcacactgattttgagagaggcttcatatgcgctgaggtactcatgcgatatactcaggcttcatatgagtagttagtatatgcatgctaatgtggttagatattattgcaaacaattgatctcatgtcactgttaagtagctggtctaattcactagttatactacctcattttgtacagttatccccaactccgcagtactcaatggacacattgatttagatgttttctgatgcgacttttctagtttgatatagttcttttatttgtaataattattctctttgttttatatatttggttgggcttgtctgtccagtagcattgttctttttagctttatgcacatttgaaacttatgtgaaatacatttttctgggattaggtaatgaagttcgacgatctaaaagaactgggtagtgaatctgctgtgaaggtatgcaaggcacctaacaaagttgatattgttcaagtgcctcttttcgatatatacttaatgaaaacgcccattattgcgaattgtaggctgctggaaaatacaggcaggaagggaagacctacgtggtacaggacggggatatcatcttctttaaatttaacgtgtctggaggtggaaagaagtgagtcaatgtttgaaggtgatagcgttccgacagagtggtgcattttactttaaacttctacacttagctctgtagcaataaacaagttatgattcgatattttgtaccatgaggctataaaattatccaaggattgtatgatgaggctttaaatcattgaagaaaaagtgtacggttttgcaatacaagcattcttggcatgtttgtcttgcctgggtctacatctgtaatattaatggataactgccgtgcatgtttggacaactcgctgtcatgcagtcaaatgtggttctttccccacggtaaaattagagccttccacgtacagctgatttctgcaattctatttttaagccatgcataaacagacacaaattaacaattaactggaatagcaagtcttaccacgcatacaattaccagagcaagataaccctacgaattactgctcaaatctagcggacctctacttctggtaacggcccgtttatgaaatatgaacacgagcatagcataattaattacccttccagtgggtaattaaatcaacttaattaaattagggcagcatgacactgacgtgcctatcaaatatccaattaatcgggatgctgatgggcttcttctgggccttgaccgccctctcatgggccttctccttcatcctccggatcttctgcggcagctcgcacacgtagtcccgcgcgcgccgcccttcgccggagagccccgccgcgagctcctccacgcgccactcccgcaccaggtgctcgacgatggagcagtagtccgacaccgtgtacgtcccggcctgctcggcgagggacacgacgcaggcgtagaggtcgtcgcggcggccgtcggagatgggcgaggtcggcatggcgacccctcgccgtagcatgcgcgccaccgcgcgcacgccggcgtccgggtcggcctcgaggagcctggagacgatgcgggtgtaggcggcctcgtgccgcttctcgtcggcggcgacggtgccgcagacgcgggcgagggcggcgtcgccgtgccctcgcgcgccgaccagccgcgccgtgttgccgtgggcgaccgccgtggcgcgctcctggaacgccgtgtagacgaaggcgtggtacgggctgcacggcgggtcgacggccatgccggagcggatgaggcggtgcacggcgcgctccacctcggccatgtcgaagcggccggagaggtacatgtaccggttgagcacgtcgccgtggcggttctcctcggcggaccacccgcggatccaccgcgcccacgccgtggcgtcggcgccggtgaggtcgccgacggcgcggacgcggttcagcgagctctggtacgtgggcagcgcctcctccgtcaccatgttcgccacgaggcacaccaggagcaggtccggcacgccggcggcgcgctcccgcagctcggcgcacgccgcgtggaacccctcgccgccgagcaccgccgggtccgggagcaggtccgacggctgccacgccgcctccaccggcttcagcagcggcagcacgtgctcctccacccacggctccatctgcgtcagcacctctagcttctccggcgacaggtagctcctcatctcctcgtcttcctcccgccgcacggcggcggcgacgtcggccgccgccgacatgatcgcgctgccactgacagcactacccctgcacatcctgcatgcatgagcacgacaacttgcaagttgcaactggtaatttatttctttctcaaccagctgaaaataaatttatgctttgatcaaatcgatgaaatttttggtaagtttgcaaacaatatgtcaagtaagggagtgcacatttgttcttcgatgcagagatcgagttttaatatattttctaaagggttatactttcttcatcatttttaatgtgacgttggttagttaaaaatgaactaatgaacgttatttatatataacattggaagtatgtctagtaaaaaaaaaaacaaaaacataccagcggctgctactgatcatggtgactcgtctaccaaatagtgttcttgatggtgaagaagagttggtgtttggtttgcaacgaagcctattagctaaaggcatcgccattgttgctgttgcagccatgctggaggagaagaagaagaagatgatgatcgtctatggatcgagttgaactattgtgtcttgagttgtgataggtttagtttcagctggtcgaagcctggtgctgcgttgttatatagagagcgagctaggagtatatttgttgcaattatatgacttcttccactttccttggcaccttagttggccacgtgccttcgtgtcagatcgagctcaattatgcgcattgcattaaaaacaaatgtaccactcccaaatttcaaattttaaaacttattttgacttgattttggagtttttttatattattgtaaataaattgctaagaacaaagttttatataaaaatagttttccaggtatttttttaataagccatcggctttagtttagatagattagtgatgaatgagacggagagagattttaatcacccagaggacgttcattgttacttgtttagggcatcttcaatgtataagtctcattggatcataagctgggcctaaattagctatatggtaattgttacaatgtatatggcaaaaaaaaaagaaagatattaagttgggttgcacacaattttaaaaaaaatcttactatatcataactagtactactgcttttttctggtgagagagtctgagggaagagagtcaaatacaaacggtttgttttttcccgatggcgcccaaacctcaagcttaatgtcacttgcgatatttctcataatgtatatggttgatttttggactaaagtccaccttatgtcctacatcatgtcgactaaacggttatgatatttttaaaagaattgataatatagattaatatgtaatatatatcattgtacaaacattaaacatgtaagtttaaatattcaattccaataaatggtaacaaaaataaaaaaaaactaaactaattaatcacctccctctttcagtctttcgtcctcttgcttcatagaggaagttcaataaaagttatcaaacaccttaaattcggttagtcccgatactactaaatcaacctattacggatatataagttaaattaataatgttgcagtgccacccactacagaaacacgcaaaacaaaaaagaacagcaaaatagatatcagaacaactaagaccggcatctatagttctttttccgcctaaggtgcacctccgcgaggtgcccaaggcaagaaccgacacatttgtgaaacataagtgccggttctaactaaaaccaataccagtagtattagtgctggtttttctataaaaaccaatacctatacttatattataggtgacggttttcacctattaaaaaaccgagccaaacccactggctctctctcttcccctttttattaccccttctctaccccttatcttctctcctctatcggtctccctgcatcatcctttctccctctcccatgcgccacggccggccagggatcagtggcgctccacaggtggcgtccccctcgatggcactcggcggccaatggtgtctctccttctctccgcccatcgcctcctttccctctcccccggcctcccaccaacggtgcgcggcctcctcctttccgttgccatatccaacgcctccacgagtttggggatggccagatctacaccctctgttgctccctcttggtcttcaccttgctatggcccgttggccaccgtgagctcggagttggatcctgccatccctactatggcggaggcaccgactactagatccacgtgtcatgatgatgaaggcgaccaccagcagcgtcgtggctccttcccgtgcgtggcaagaggatttttatggctttctttgttgatttcttacttgttgatattggttgtaaaaacgatattggttatcccttttatgctgaaatgggtatctagtgcttgggtagtagatgatcctttgtgataaaatttgtgattcacttagtgattttgatgttgaaaagcaatttatgactgattgagaacaatttgaggcttggacgttgggtttctctgctgctcgatgcattggcttgattcgagctgatgcattgagcctgttttttttattcctcgaaccataaaggtgttggttggaaccggcacctttgaggaggtgccacctgttgagtgccggttaaaatattcagtatctacggccggtttctaatcggcacagaagtgattttgtgtagaagtgccacttgtcttgcacaatataggcggcttccagctcactagacccattggcatatattgctggataacacatggtacgtccacctaggtatacttcttcacgcatgcagggtctagctagggttcaggccattgtttcacccaaagaaattgttgaattttattactatcacacttctatggtaaatttgagacaaaatagctgaacaagatttaatatcgaaaaaaattcacaatttagtttaaatttggagatggtgaaggaaaaaaagaaccaacaacgttctactattgccccgaagtaactcaacctaggaggataggatgtagacaataatattctaaaacaacggatctggacaaactctcgtccatattcgtcgtttcatgataggtcacatcctatcctatttattttggaaatgagggagtatattatcatgatcttggtatcttacataatacatacgttcactatatattgtgctgtaatttaatacacaataaagtttgtatataccctccgtgttttagatatgtttacccttcgtcttattaaaaaaatatatgtaaattttatttattctgttttgacttgttttatcactaacttatattatatactttaagaatgacttatatttttgttatatttgcactaatttttaaacaagacaaatgatcaaactatattcaaaaatcaatatcattatatatttaaaaatagaggtattatatatgtgtctgtatataggtaaaaacaatacaaattgtatataaaaaatagcgagggtaggtcaccagagctatgaggaaagagaggaggcagtctccgagcaccatggctgttgtagtgatgtggttggcccgataccctccttcctcaccaaggtgcattgctgcactgtgcttccctccgtccatggacctcgtctctcttcgccacgatgaaggctgcaatggccacgtcggcctggggatgacgacggtgataaataaaatgggcgaggacgaggtggattgggcaactttgttgtggagatggagcttgaccttgccaatggagtgatcgagctcaagctcttcgtgctacttatggcctcctccttgtcgccgctgcaccccgctccccttcttcctcaatgttgtgcctcccccggccccaccttcccctctagattccgcagcagtgaacagatcgatccgatcataggaaacaaggcaagatttgtggcttcaggacggaatggccgccattgccaccatcatgtgaagctattcgctgcttgggcgcgcggatgtcaatgcggcctacgaggtgctcctctttgcctaccctcggtctctagaactagtatggaggcgtgcgatgaagaagatggtggctgacagctgggccccactacaactaattaaaaatactagcttaggggatattcatacggtttgagaagttggggcatgtaaaatatctagcactaaagttttaggagggcaaatcgtacttttgtgataattgagagaggtaaatcaaacttaaccctaattatggagggcggtgcgacgggcatgcaatgctacggctaagttcttatcccagttttcctaactcatctctctcgttttccgtgggtatgctttttaaactgctaaacggtgtgttttttttaaaaaaattctatacgaaagttgttttaaaaaatcatatcaatccatttttttaaaaaatagtaaatatttaattaatcgtgcaataatacatgcttcgtttatagcttatctagccacatactgttactggtactatactgtagtatgcatgaattataatgtatacatccatatatatgaccacgtgaaacgcttcaaccagtgcagcaaccgtgccatatatacgtacgtacaatcatacttacatcaactgtacagtatatagttggattgatgagtcgtgtcatcgaatagagacccacgccaatgcaagtacatgcatgctgcatatggctgcattcaaggagcatatgttcgcacgtgctagctaaagtgaacagagatggcaggagatgacatgacgatatataattcatattaataattagttcaccaataccacgacaaagctaggcagatctcggttcttttctgattgagtaattaaagtgtaaccgtactttaattgttgatttgagcctaaaatgctgatataatttacttatgattgatttcacctagctatgtagcacaatgcagagagcgagatagcttgcttaattattttttaagataattgaagcttttattaaatttagtcaattactgtaggtaattaaaggtgatacaactgcacactcaggctgatctgcataaatttagatgcacacagtcaaagcttgcttaattcatagtataatataatttgctaatttcacaaagaaatgaagttgatgagatcgtatcctccttgcaattaataaattacttcctctggatctcgtttgcttgatgttttgatcatcgcgacgaacttaaatgtacatatgttccataattaaattttttataactttatgtttataaagttattgaaaatatatagttatatgaaatcatttttcataataaatctactaatattattttcctatattaaattataatatttttacatatattattgatttaaatttttgagttctctgacgagcagacaaccaactttccttctctttactgcatgcgttgaatgaactggaacaatctttacatcggtgtccgtcgttggctgggacatccacatatgacacatgtcagaagtgtttcttgtgtaatccattcaattcgatcgatcaatatatatatacgtctgcatggatgcatgtgttgtaggcacgtacagtccgtggatctgatcatgcactggtatcaagcacgttactcggggtgcgtgtttagttcacgttaaaattagaagtttgattgaaattagaatgatgtgatgaaaaaaattagaaatttatgtgtgtaggaaagttttgatgtgatggaaaagttagaaatttgaagaaaaagttgggaactagatcaggcctcggatcagcaatagctagcaagccttgttttgctagtagtagtactgctcctttcgtcccacaaaagactttatttttatatttctgtgaccaacgtttaatcgaccgtgttatttgaaaattttataaaaaaagttaaaaaaatcacacataaatttttatcatgttttatcatctaatataagaaaaatactaatcataaattttataaaataagataaataattaaatgttgtttctaaaatctgaaaaatagagttttgtgaggagggagtatcttttgcagcagtaaatttgataactcgctgaatgaatcatcaatgcatgcgttagttgcatctacggctgtagtactgtgtttactcctaccctacctaacaattcaacagattcaacccattgaatatctaatggatccgaacagttcttcatatgaattttattcacacgtactacatatactgccgcacacattttggtaaagtctgagttaccgacgcacgcattttacatttctatacctaactagaaaaaactcccgtgcattgcaacggctaaaaatatcttttttcattgatacaaccgctattaggaactaagcgataaattgaaatgttaggatcattatatgtacattataattggaaaagttaataaaaaatgttcctgagtttgggccgaaaacccttctttcctttcttttcagtcccaacctagtccgctacctccctctcatttgactctctccgatccagcccacagtggagctacaggtccagctcgcacagccaactgcactgactctctccgatctagccgactgccctgactctctccgacccaagccctcaagtagagctataggcccagctcgcacattcgactgtcgtagtcttgtgccaatatgccgagccgatcctccccatcaaatcctctggccgatttttttttaataaatcggttgagggtttttgatccactcgatctccttcttccgttttcccgaaatcagaacaaaaggctggccggctatcatcagcgactaagactaaatctagtgaattaaagccgaattaaaaggaaaattgtgagaaaaaaatgatgagggaggaatggggaatcaacttttgcaatcacttggaacaaaaaacgcatgagaatacatattgaagtggcgacggcactaaggtttggttaggcggtggcagcaacgtccaatggatctaatgagataaaataattggctaaaaaagggtatggaaaaaacaatgaaaaaaagcacctaaataaatggagaaaagaaaccgggtgaaaaaaagcaaaaaagaaaagaaaagaaaaaacgaatcggaataagaaaagcagtgaaaaaaagaaacggacaaaaatgatataaagataaaaataaaaaccaactcatgactatcaaaatcccggcaaaaacatctttaatttttataatagtagagaataaagttttttcatccctcggtttctggcttcaattcctaattgttgctgattcgcgtgatacaaattaaatccggacacatgacgcgaattatgacgtcccgcaaataaaacggaaaacaaaaaaaaaggaggaagctagctagcagcctagccaatgcagcggtagcccagcagccagctcacagagcaaaggagcagcagcccagtactgcacgacactgtaccaacgtgtcacggtactgtagcacaaataataccgtttattattcgtgcaaaccagggatcgaagaaaagattatgcaattttatagttaaaagaaagtaaaaaacaatgacatcctccttttgctccttgacatcattggcccatcaaaaaactactctcacaaatcgcattgtatttttttacattattggtccatccaaaatctacccccacaagtcactgtattgtaaaaaaagaaacatgtaatcaccaacaaattgaatcatgtttcctacgcaacgcaagacatcaagatttttttactccgcgttcggttctcaatttcttatgcacctatttttttttctttagaatttttacggtacaatatactctagtaatatataatatccggggacatctcctctgcgagtccctcctaccattgtgccgtcctttgtggcgccgtccgtgtggagctgggtggcgcgcggccctatggccttggacggagcaagctcgtttgttgtgggctccctctcttcattccatgtaggcagtaaggatggtgccgcgagcctgtagagctccgcggatagcatcggcgttttcttagagtccaactggatatccacctacgacggcgacaacgcacgccatgcggtggcttggagcacacaagagaggggcctctgcagggtagggaagcgaatttgagagaaggtggaagtgggagtggtttatggcaacaaaggagcaggatgccgagagaagcttgtcaggagccctagcactctccaacagcggtgctagcagtggtcacctcaaggtgctctgagccctggtgctctcccaaattaagagaatttttacggtacaatatactagtaatatatattaacattataaatgagggcacatttggaattcgctaccaaatttaaaggggtatttagtaattcgtgattcctcttcattccaatcgtcaaatcgatcttagatgcctatcgatctggagcggagagacgacccatggcattgaccgaacgacaaacatcggcggcggtgtgtaggcaacgacgggacggtggggaggccaggtacagcgggaggcgcggctgcggtggtgggcgtgttggccaacaggtgggcggcatagcacgtgccacgtactgctgctggcagcaagcagagcgcataaccatgaggctaagaagctcgcagttgaagccatttgcagctacaatctatgtcgttcgatcatttatactactagtatatatacttgtagtatattgtaccataaaagttctccaaattaaaggtgcagttgagttacttgttgttgcgctgcagaagctcatcggtgatgcgtccgcgctgccctgctcagctcggccctatctctgctgtcaccagccgcacgatgcgtcaccactaccgacaacctcggcccaagacactaccaccaccagctcacccttgccgcttaggtgctagtgaggccttctattttttctatgagatttacatgtgagtcccatgttggataaagactagccaagttgtcaagttagctaaaacgctttctaaatcaccgagggggtatagtttgcaccggttttgatagttgtgggagtcgatatacccagttttacgattgaagtgcacgaattagattcgatcaatagttgaggagtcgaagtacattttcctaaattttagggggggccgtgtacagtaggtatacacagacccatgccaacatgttcaattagctaggtggcatgggcttcattacctagatagatttcgtggatagtgtttggtttgtcgtctcgatcgatcctgtcgccgcttgattaattgcgccccataatgctaacacattctacactcatgtcctctgctttgctaaattatcatcgtaccaacgcgctctaatccctataaagtccagtgttattattacgttgtgtcgcagaccagcacagatcgatagagatatcaaagcatggcacaccatacacgccattgcccatcaaagcattcgaccaagcccatcttttcaataattattcttaattgtctcccaattttgttttgaattccaatatctactacaataattattaattgaacactctgtcacataaatttagagctccactccggtactctctacttgtatagtataaattaatctaagccattgaccatttttcatctaaaggacaagattaatttatactgtcacctttattaacggtagtagaaacgtgagaggatttaatcatcaataaaaatatatagaatgagaggtaaaattgtaatttgtatatcagttgaaaacccttggatggttggaccgtgctggcatgagaaaacggcgtgggggcagactttatctagagtttatttcttcgtccgtattttaatatatgacaccattaattttttttaccaacgtttaaccatttatattatttaaaaaattatgtaattattatttattttattgtgtcttgatttatcatcaaatatttttaagcatgacattttttaagcatgacattgatatttttagggaattgctagacggcagcctactaaaatttttttttgttgtcagctgaattttggtccgttcgatttctgcccaagatgcatgcaaccaacccatctctttcacgtgtccaacgccgcacattttggcccgacccatctgtctctctgtgggctgttccccgtggcccacgcagcacagtatacctagcccaacccacaacatgtgtcattccgacagctacacacgcgccccgtgcactgtttcaaaaaggaaaaagtacacccaaggtccctcaacttgtcatcgagatacaaaatcgtccctaaatcgcaaaaccagataccagacgtccctcaactaacaaaaccgttcactttaggtcccttggtggttttgaccccggttttgtctgacatggcggctgagtcagcgtaggacccacgtgggcctcccatgtcagactatccacgtcagcctcccctcttccccctcctctcccttcctcctctcttcctctctcctacactgctacacacacccagatgagtcgttcggctccgtcgacggcggcggcggtagcgcgtccgcgcgacggcggcggcggccgtagctcgtctgcccaggagcggctccgtcggctgcggcggcggctgtagtgcgtccgtgcgtctccgtcgttgccgccaccgccgccatcggcgacaacctcctggaactggcaccgtcgcgggcaccatagaaggagcggcgggagcggatggggacggcagaggcgacgcgggagaaggtgtcccgacgaaaaatcccaccacgaagctcgccggcctccctcggtggcaacgacacggcggcgaccacgcgggaggaggtcatcgggccgaggcgcgaggaggagggcggagcgacggcggcagttgcgcccgccgcactggcctgccggatgtcccactccccctactgagtcccagctccgccgcctcatcacggacgccgacctctccgcctcctcccaccatccacaaaatctcatttaatgaacgtgaatcatcttttcagttggtagattgcatattttcctcaaaaagtatcatttagaatacaatatcaaactcaagacatcaagaaagtaattaccagccagctctgttagcctttcagcatacatttgggtagaagcctctgtagcaagcatctcctcgcagatttctaccactttatcccactctgtgatgaatgccccaaaaccttcgctcacagacgccaagcagaaacaaacgtcaatcgagcggatgcaagaacctatcccgatccactcaatcgaagcaagaactcccatgaagctggatattttgtttggggggggacaccttgacgccgtggaggagggcggcgttgacccagcacggcagcgggagcgtgacagaggtagtgcgagaagtagacgaagacgtcgatgaggtgccagtgccagagcgcgtaggcgcccgggtcgtcgcccccctgcggcgccgcgtcgtcacggtacccgccccggaagtcgtggcacgcgaggatgtggcgccggggcgggagcggcgcggcccggcgcgaggaggcgagggccggcacggaggcgcggttgaaggggaggtggaagttgccgtcctcggagaggtaggcgcgggatgcgagcaccgcgagtgtggtgatggggtaggagatgggcggcgccggcaaggacgcgtcgaagggcggttcccacagccgccgctcgccgccccccggccgcccggcggccgcgcgcgcctaccagccgccctgcagcgagtgaacgaggagaaaagagagagaggaagggagagagagatatgatgtgcaccctgacatgtggggcctacgtgaggtcccacgctgactcagccgccacatagggtaaaaccgggatcaaaaccactgaaggacctattgtgaccggttttgattagttaagggacgccagatatctggttttgtggtttgaggacgtttttctaactcgatgacaagttcagggaccttcggtgtactttttcctttcaaaaaagaatccacatctttttctcctccgttctcatccgctcattcgagaagagaggcagaagcggagttctcggcgctatcaccgcagcttcgccgcgtcagcgctgctccaccgccgcgaaagatccccttggcagccagctctcccaagcttttctcgcgcgtctcagctgctgccgagggggaggggtgaaagcgggacggggcaaccccggcagccagtgaagcggtgaatttctcggggtcggcgacgggagatggctgctctcaagtttgtccgcaaggtagccacttccgtcagcgagcacccgacgaagtacttcgggcgtggcactgattcggctatggtggttctctctctctggtgggtaaggaccgtaaggtgaccaaccatctctccaacgggcgaggggaccaaccatgtgggggatctcgcagatggacctctgatccatgaactcaggttgaactctgttgacggctgttaagtacaaaattctcgccgtcaatatctgcataaaaccataaaagtaaaacatccaacatagtggtaggatttatttctaactatttccacgagtgttggtgtatatttatatgtaaatgcaacccaccaacgttgagatgaaatgtacatgaagaatataacttccatatccaaccctatggagttttgagcccacaaacccaataagatagatttattttggccaatctctagtagaaaatgtagtgggactcacatgttagaacaccagagaaaaggctgggctggatgggccagccagggttcggccgaatcagcagctagcctaatctagcccaacttcggtatggcggttgtaaccctcatcctatgacggttgtggccgttaataccgatggaaactgtcatcaaaagggacacatggcaaagggagaaggaagatgctctttagattccatggagaatatttcttagcatctccacactcccaagcaagctcacactataaataccactctcatctttcattccaacacacataaaagcttaagctgaattataagaggctctattgtactagattagagatagagtagagtagaagaagtcggattagttccggagttgtccgtaatactcttcttatttttttctgctctgttaattactctgattataatataaatatcttttgggtaatttagttttgcttggtgagaattaccttttggttagatcctaatcagcgtgcgggatcatcgttcactataatttagtaaaatatagtgattgctttagtgagttataaatactatagtagttattaattgcttaaacgcggtgtctaggtagttgatttccggtgtttgctccgtatcccacaataggtttgaggtgggtgtaaaggtggtgatagccctcaagatcacttaagtcctccatgtccgggcacgcagtagagcgatatctgggagcagtgggctggctagtgcccgaagtatcatgttaagattaaactaagctttccgtagatactgtttctaaacggtaaatcctctctatcctttgcctatccttagcttcgtgtccttggatgaacctgacgaggagttgagcacacacgttccctgtggattcgataccttggaatactactgggtggagtgctacatcggtatcttccgtgcgcttgcagattttatctgtgacattaagaaataccaacaaacttgtagtaagccatgagggcaaatcgaccaccaaggtgagcgagtataccttttttttcattttttcaaggcttttcatttgttgtaatttgtgttaattttttttaatttgttttcggaaacattcatctgcgagtcagatctgttaatgtggctaactgatctcgatcgccccagtgcaaaatctaagctgtatttgatttgtgcttagtgttgtgcttagcgcaaaatagttgcgcttagtgttgtctgacaaaaaaattaagcatgtggtgtgatattctcaagttgtaagtatttcagtttctgtttatagcatatgtgaagtatttttttctacccttgcacgtgtggaagtttatgctagctctagaaagtatttcagtataattcagtacatggtggcctgtatggtattcatcagtacatgtgaccataatttgttgttatatgcaaatgttttgtagcatgatcatcgtggaactataacttgtcatgctttgtggtgtatcttttggatttttgtagtatacattttgggccaattgcatatttgccactactttgaatcggtattgtgaatttgccattacaaaaaacataattgcatatttaccaccaaaaatgattggaacccagcatacctaccatcaaactcacaacatagactaacaccgttagaagtttggttttcatgaaagtgaggacaaggatgcccctccacaggaaattgcaatcctaccactggagcatacaacctaataaaatcgtgcagcataagaaaacaaacaacagtggaacaaacattgcaacgaagcatgtggaactgctgtaaaaggttttacaggtggagaatcgatcctataagaaaatgaaaatcagggcttcagaatgaaattgtcgttctaatgttattaatatccagaatcttttctaaatgagcaaatgtttattggacatatatactaccaaaatcaaattctagactaacaactcaaatatcaaggaaataccataacaacttcctctgctgctgttgttggtgtagtctgcccctgttgctgcagccgccgccgccccaagctgcttgttgctgttgctaccggtccgccgccgccgcataatgctgttgtcgcccaagcagcttgttgctgccagctgctgcccaagacgcttcttcaaattggactgccgcagctcccgtcgccaagcagcatgctcgccttgatgccataatcatcaaaatccatctccatgagcttttttactatcaccagctacttcatcgcgaccgatttctaactgatttgctcccgattcgaaggacgagagtatttgggatctagggttcctagagagagtgggggattggttcttctcttctcgcgtgtggtcagattgggagacgggcagtcgggcatggaggggattgaatctagccaagggcaaaaccgacttaccattgatttcttgttttcttgaattatttctatgcccttaattcctccaattcagacgggatggcaaacggaagcaagctggactgactttagtggcaattttgcaattcgtgcttttgtaatggctattccgagttagaggatgaaaacagtggtatatttgcaattctcccatacatttttgggatctccgctatacgtcactcatgaaaaacttgtaggcaattcttgctgcggatgtggcccttgagtttggcgtatcagttatcaagggtgcgatattttcttatgtgttggtttaacacacgaggcaagcaagttcgcccccattatgcatgtttatttgtcactggatacatggatatttgccggtagtcagttttgtttgaattctagttgcagctttgtcagtgcaaattgatgtaaactctgatcacaattgttttgaacctgacaagagatgatatttttcattaagatttgtcaggtacaatagggagaaatgcaaggaagaaccatttttacccgctgaagtctcattaaggactgctgatcatacatatccaccatttgagcaggtattactaataatcttctttatgtgagtctttcacccaacctgaaaaccacaacatgtaatatttgtgatttgttgtaatttatcagttttgtctcaagaaatcatgtcatgtaatatttctagaaatgttttgtgtgaagaagttatgtcgtgccagttttgttcacactctctgagtttgttttttatttttgtctttgtcttttgtctgttctttaaatttaatattaatcaagcttctagtacctaactaattaaagtttactggacttaaagttttttgtcagtttgtttttgtatttttgtcttatttgtctttgtgttcgtctttgtcccttttttaaatttaatattaatcaagccaatttcttagttttgtgaaattttcaggtagcaatgtttgattaggcacttcaagtacttaatacatttcagctagcagtattattcaatggctccttggttcaattcatggattcaaagggccttatgagtttcatgctatagttcaatgactccgtggcccagatcatggattcaaagggatgctatggtccctgcatttttttagtcaacaggttagtcttggcactatcaaacttaactgaacactgtacgatggtagatgttcagaaaccaaaactttctcaaaatgcaggagtgtaactctgctttgttagactaaagtgaaacattgaattaataaagatgcaactctgttatgcagttaaatttatatcatctcccacataataatgcagctcttttccattagctagggtgtaacagctaaagctttgagcatctaagagttgtcatgcaagtagtagtagtagagttcaacccataattaggtagataaatgaatttgtagttctgccagatgctacaaatatcagttaatgcacattggtgtttcagaaatgagcatagttttagaaatggtgtgtttttgtatttgttttgtcaattttttttcagttttgtaaattttgttaaaaaatttaaataattcttggctatagccagctgtgggcaatttgctcacaactgctctcccagccccgcgctctccaagccctatgtgcgccactgctgctgcccatagcttatatcgctaccgactacagtctcgctagtgagattcttcccccgctaaaacctaaaatttttttcttgcacttttatctctggatctcttctttcagtctgtagtacatgtacaagggttatgatgatatgcttgtgatgatgatagtgataatataagggttaattgtttgttttattttttttaagtgtcattgaactaattatcgataatcaacttctgttacaaactcctattaagctactgaaaatctgaaactaacatgacctgtagaaagaacaatccaactcatgtgacactttgctctccagacaactaatggaattagatagtttgcaattttcagttgttttcattgagaactgaacatctcagaggggctgcaggaat

SEQ ID NO: 67129 - DNA, 19861 bp, Oryza sativa
  unsure (1)..(19861): unsure at all n locations
cggttatgggcggtcaaccagattcaccgtgattagtctcaccctagtgtaatcttttgaaattggatagtttaggtggatggttgggcctgtcgcaacgtgggttagcgttgggcagtggatagttgatattaattaattattacaacggtttaatctttcaacttctgtttataaatgctcgctttatgcaaatgaaccgctctagctcttctttgataattccctgcatcatacccctattccggtatgacttgctgagtacagtgggtagtactcagtcttgctctacttttcccaacccagagttcgagtttgggtcagataaaggtttctctgaggagtaggcttcgtccgtgccgtcgaggatgcctgtggagtggtgttcccgctgcagtttagtcaaggcttagctcctgttgtctttcttttcttccgctgcatttatgtaagacttttatgatgtttgtaagacgtggatctgaatgtcaacattgtcgtttgtgtactgtcacatcctgatttttgtttcaggatttataaattatttaataaattattaatagaatttatattaaatgatctttaatttacaagggaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttctggtttaaaaatccttaaattataaattgttgtttaaaaggaattattagaaatgattttaaaagcctaaaagagaagatctaattttaatttgctaaatctcaatataaaattgggctagataaaattttattaaatactttgcttaattctataattcctagatttttctgggatttatttgagctaaggaagtatttttaataaatggaattgcatttcatgaataatttaaattgaaaaaggtttttaaaagtcttattttggctttgggccgaaagtcggcccaaaacccctctctctttctctctccctccccggcccagtcggcccagtcagcccgcgctccttccttttctctctcggtgtcgctgacaggtgggtcccacctgtcaggttcgtcttcctcgcgccgtcgccgccgcccgaaaccctagcgcaagccgccgccgtctccttccaaattcggccgcgcctttccttctccggccgaattgattgagggcaattgatccttgagatctcctcttccttttctcttttggaaacatcggctaattttctttggaaaccggtggatttgagttggattcggattcatctctctcctctaaccccgacctttccttctcgtcgccggcagccgtgggccttcactgccgcctccttgcccctttaaaaggacccccggtgtctccgctacccgccgcctctctcgccttcgcccgccgtcgtgtgtagcgccctagcctcgtgagcttttgcgccgccgtcgccgccgttcgtccagccgtgcgccgccgtcgctacggtcgtcgtcgtcactcgggaaggccaccgtcgggatcgccaagtcgtcgccgtccccgtccgccgcttcgccgtcgccgaagatcgccggagcaccgtcgccgccgtcgacccgatctccgccgccgcttcttcctcgtcgccgtcgccgtccgttgttcctccgccgcttctttggtcaccggtaagttcgccgcgccgcgctctacgtcctggtgccctccgttctcgttgtcgcgccgtcgttcgccggcgagcttgcgctcccgagccgccgccggtgctgacgtcatcgttgccgttccccgtgagccggtcgtggacccgtttgatctcggccgtccgttttggatagggttgatctcggccgtccgttcccgtgaaccgtcgtcgtgcacccggtccaccgcaaaccctagccgctgacgcaataatcctcttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaattagatttaattttgtaaaattcataataaattcatttgaagtcagaatgaggccgttcaagtctcataattcatctaaaattatgatctacatgtttgtttactttttatgtattatttctttggtttttattagtctttttcttcgttttgcgtgatagttagtcgtttccgtcgttgcgaaggttcgcgagtgcgccggaagtattcaagaagattaattgaagaccgattattgcaaggcaagtcacacagatcctaaacacaatcctttgagcatgttgatcctatgtttaaattctctatttatttcaactgtgcatttattttcgaatgtcattgggtggaattaacctattctttgttatggcccttttgttcttgattactttattccttgataccttgggatattataacttgactagttgagctttatatattggttcagctagatattagctatgattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatggacgagttgagcaatgtttttcgtgattagtctcacacctctcacaataattatggatgttataactggtaataatttgcttagctccggtttggaatggataattcctggtttggagattagatctgtacagccgggtatggttgtttcagaatggttgggcctgagcagcataggcatgttgttcagtgttgattaaaatttttgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagacaagttgcgaaggagaagacgtttggctcataccccagttgagctgcctgtgggagtggagccggagcttcgctagattttattttccgctgcagttttcttcttggtgaggacttagtgcctcttaagtaagtacttatcgttttagttaatttgatgaatctgtatattaaattgtcagtttgtgtacctcggctgattcctggacgaggattttatgcacaaataagtttggaaatcacttgtgaatttccgggcgtgacatgtaccccggctggtcctggacggggaatttaatgcacattctgcttgaaattctattcgggaatttctgggcgtgacaagttggtattagagccgaccttgaccgtaggacaagccaaatggaaaaacctaaaagccctctgaatccttttcattgcatatgttcttggcaattggatttgttccgggaaaattgggatccgttcttgtggttcaagggaaaaatcttggtcgctcgtttaagtgagatttgtcaaaacgagtcaatctagagttttagtaaaactcttgagatttattcgttagtcagttgggatttgatgggtgaaatgcattaggtcctagctcaggaacatgggttgcaaggtatttcagctcttattgttattattagtatgtatctaatttccccattattttatcgttatgtgagtctgtcttatttattcgcactcatgcaaaatgatctatgcataaaatttcgctcttattcgattctcttatttgagtcttttattgctttatttaaatttggatttgagcatgcattgatcctactcctttgtcttctctagatggccggacacccacccaaccaccgcggagaaggcatgattgattttgtggcagagttggcacgcatgacgctggtggtgggctaccccaacgcgccagagtagacgacggttccaccgctcagtggcgagcttcctcaccgtgttcgcttggaggtccatggctacgtgggtacctgcctagctaacatggtggttgaggcgtccggaggcacagcagatcacgcctgtcaggaggcagcatacctgatgatggccagactacgggagcgccacaactacatcttccatgacatggcataccgttttcaccctcgtcgagccagtggtgatgatgtcagcaccttccgtccgacaaccggccagaacgacaccacctttggtcacatgtgtgctgtgatgagtggattggataggatgcactcggacctgcacaaggcgaccaaggccttgaacgatgggaagctcatgaggatcgtcgctctgatggacgagatagcgcgcctgaagagggagaatgctcagttaaagggtcttcccgcgccaggaggagtccggatccgcaccacaccccgcaagacgacgacggcacccgtgcgcatccagcttgcgcccaggaacccacctccatcagcagctcccgcagcacctccagttccgcccgcagttcctgcagctccagctccagctcccgcgtccgctctctccttcgctccagcatcagccgccaggggtccagccagtggcaacggaggttggttgtctgctactcccagtggcagccgcgatctcagcagcagcagctccagtggctcagagtcgggcagcggcgagacttatctgccaggctccaggagtcgctcagagggacctggtgacgagcaggaggacgccttcgactccaccgaccgcaggagccgttccgagcattaggctcgttttccattagttaatcgactgtctagcttctgcttgttagtttgtgtgtttaggttgcttgcttggggtcagtcgacggtcgatatcatgtgcctatgatatggctgtcttaataaggattttcgcttgttttttttaagtgttttaattcagatcagaacaattgcagtttaaattcctttgtaataaagcttagtttctgagcttctgtttttcttcttttccccgtctgcttctccctccagatggtctacaccaggaatggtagccgcgcaacaggcgagggcagcaacggcgaagagcgcactgatggggcgcatccccacagcgattccggcaatggtccgccaccacttcccgagaatccgacgctagtccaagtaatggcacatcagacccagatgatggcagccatgatgcagcaccagcaccagcagatgcaccagcggatgctgcagcacgccgaacagcagcatcaacagtttggtccccctccccctcagtccaagttgccagagtttctacgtgtcaggccacccaccttctccagcaccaccaaccctatggaggcgaatgactggctccatgccatagagaagaagctgaatctcctgcaatgcaatgatcaggagaaggttgctttcgccacacaccagcttcaaggtcccgcgtcagcttggtgggacaatcacatggccacccgcccaccaggtactgaagtcacttgggtagagttctgccgtagcttcaggaaggcgcaggtgccagatggggttgtggcacaaaagaagagggaattccgggcactccatcagggcaacaggactgtgacagagtacctccacgagttcaatcgcctcgcgcgatatgcaccagaggatgtccgcaccgacgccgagaagcaggaaaagttcatggcgggtctggatgacgagctgaccaaccaactgatatctggggactacgctgacgttgagaggctggttgacaaggcaatccgtcaggaggatcaacgcaacaagatggacaggaagaggaaagccgcacagttcagggcacctcagggaagtcaccagaggccgcgcttcgctcccaggcagcagggtggacctaccaccatgatcgttcgtcagcaccgcccgttcaaccctagcaactttccccagggcgccagtggcagtcagaaccaccatggaggtcagtccaaccgcggtgcagctccacgcccaccaatggcaccggcacagtcaggcccgcccgcgcaagccaagaaggagactggagcaaaaccagggtcctgcttcaactgtggtgagcttggccacttcgctgacaaatgcccgaagcctaggcgtgccgggccaaggtttatccaggctcgtgtcaaccacgcatctgcggaggaggcacaagcagcaccagaggttgtactgggtacgttttctattaactcaatccctgcaacagtactttttgattctggtgcaacgcattcgttcatttcaaagaagtttgttgggatgcatgggttaataagagaggaacttagcacaccgatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggggtcatcgattgtgcgaatcgcacagtcaccttgaccaacgagaagggagaaaccgtggtgtacaaatcactagtctcaccaaagcaaggggtctctttgaatcagattgaagcagaaatcccagtggacaccgtggagaagaatttgaggaaattggaagatatacccatagtctgcgagtatccggaagtgttcctcgaagacctcactaccatgccacccaagagagagattgattccggattgacttggcaccgggaaccgccccaatttacaagagaccgtacagaatggcggccaacgaattagccgaggtcaagaagcaggttgatgagcagctgcagaaagggtacattcgaccaagtacttcaccttggggtgctccggtcatttttgtagagaaaaaggataagacgaagaggatgtgcgttgattatcgcgcactcaacgaggtcaccatcaagaacaaatatcctttgccgcgaatcgatgatttgtttgatcaactgaaaggagctaaagtgttttctaagatagacctgcgatcaggctaccaccagttgagaattcgggaggaggatattccgaagacggccttcaccactcggtacgggctatatgagtgcacggttatgtcgttcggacttaccaacgcacccgcattcttcatgaatctgatgaacaaagtgttaatggaatttctggacaagtttgttgtggtgttcatcgacgacattcttatctattcaacgtccgaagaagaacatgaacaacatctccgtctagtactcgagaagttaaaggagcaccagctatacgccaagttcagcaagtgtgacttctggttgacggaagtcaaatttctgggccatgtcattacagctcagggtgtggcagttgatccatcaaacgtggagtcagttaccaaatggaccccgccgaagaccgtgtcgcagattcgaagttttcttggacttgcaggttattaccgccgattcatcgaaaacttctccagaatcgcccgacccatgactcagttgcttaagaaagatgagaagtttaaatggacaactgagtgcgataagagttttgaggagctcaaaaagaaattagtatccgcaccagttttgattctgcccgaccagatgaaagacttccaagtctattgcgatgcatcccgtcacggacttggatgtgtcctaatgcaagagggcatagtggttgcgtatgcctcgcggcagttacgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgcattaagccggaaaagttactgcactgccctatgcatcgagggcatgtgtgaggaattgtggcaggagtttgagcatctcaacgtgggaattgttgaacacgggtttgtagccgctctggaggcacggcctacgctcgtggatcaagtcagagcagctcaagtaaatgattctgaaatagcagagctgaaaaagaacatgagggtcggaaaagcccgggatttccacgaagatgagcatggcacaatctggttgggagaaagattgtgtgtacctgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccaacgagtgaaggcagagcaccaaagaccagcaggtttactccaacctcttcaaatcctggaatggaaatgggaggagattgggatggactttataacgggactgccccggacatcgtcgggtcacgactcgatctgggtagtcgtggatcgactcactaaggttgctcacttcataccagtacataccacgtatacgggcaaaaggttggcggagctttacctttcgagaatcatgtgcctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctctcgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgagcgtcaactgttcgggacagaggtattagcggaagcagaagagaaagtcagaatcatcagggaaaggttgaggattgcccagtctcgacagaagagctacgcggataaccgccgaagggagctcacttttgaggcaggagattacgtgtatcttcgtgtcactccgctccggggagtacaccgttttcagacgaaaggcaagttggcaccacgcttcgtgggaccatacaaaatcttggaacgaaggggagaagttgcttatcagttagaacttccatccaatatgatcggtatccatgacgtgttccacgtgtcccaattaaagaagtgcttaagggtacctgaagaacaggctgattcgaaacacattgatatccaggaggacctaacatacgtggagaagccgattcgtatacttgataccagcgaaagaagaaccagaaacaaggtcaacaggttttgccgagttcagtggagtcatcattcagaagaggaagcaacctgggaaagggaggatgagttgaaagccgcccatccgcacctcttcaccagctcctccgaatctcggggccgagattccgtttaaggggggtaggtttgtcacaccccgaagttctcctcccaggcctaaaatttaatttataaacgaccccccaagaaaatgcaggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttccttcttctttttctttttcctccctttttttttcctccttttttcgaatgggccgccggcccattctctccttcctccccctcctccctgctgggccggccgcaggccgaggcccagccaggccggccgcctccctcctctccccggggtcgccgacaggtggggcccacctgtcgggcccttccccaacctacggccactcgcccacgtnngccatncgccgcaccccgccttcttcggtccacatcggccacgcccgtgcgtgcgccgngccttncgcacccactcccccttttttttcngcgngcctcaaccgagatggccgggattcaaatttgaatcccgccgctctctctctctctctctcccccaccttcaacctcccacgtcgccgacgaaatcgggagcgcctcggccacatccgtctctcccgagcccctataaagcatgcccgcactcccctccaccttttttctttttccaccgctctctcccgtgccctccattgctcccgcgccgtgcgcccatccgccgccgcctctcccgctactccggccgcctctagccgccgcaccgcgccgtcgccgccgttgggttcgcgcagccgaggtccaccccgttcacccctcctccgtcgaggttcgtcgccggagccctcaccccctcgcactctggtgagcaccatctctaccgccgccttcggccatggtttccgcccgccgtggaccacccctctccctctaatctctctcttttcctttcttagggcatctcggagctcgtccgcccgccgacgtcgtcctcccgtggctcgtcgtcgccggtcgccgccgtccccttcggtgaggactcccacccctttcctttccttcccccgatcccccgtgcgtcgccgtcgcccgcgctcgccgtcgccttcggtcgctgccgccatccgttgccgccgtttccgcgtcgttttgcgccgtcgccccgccgccggatgcgccgccggcaacgcgttcgcgcgcgcgccgtcgccgcggccggtcggccggccttgagccaagccgagccgggtgccgccgccccttttctttccccccgccgctgaccagtgggccccgcgtgccggcgcccttcctctctctcccgagccgctgactggtgggccccgcatgtcggcgccgcttccccgtgctgatgtcagccctggaaaatattgcgcaataaattatttaagaatttttgttatagtaataaacacagtgaatcttctaaaattcataactaattcatccgagctccgtttaagcccattcaagtctcagtaaatcaagagtaatgtgtagaatccattaaaaatggttttgttccctgtttcagtagtcttatagcctgtttgcattgtttgctttgtatgtcgctagattccgactcctccgacgctccggtgtacttcgaaatagtcgccgaggttcctccagcagcagagcaaggcaagtcatgcttgtcacttgaacatgttgatcctatattgcaaatgctctattgttttctttcaaatattgcattgttttataatattactatgggatggttacctattgttacagctatgctttttggataccatgctcctttgttagcttggggttacaacatgattagagtttggactaggaattgcttagccatgcttagttcaactagttcacaatggggaaaatcctattaatgtttagactgttggttctaatggttttgttggattagtgccaccgctttggtgttggttaattaaaataaatcacatggtgggctgtgggtgcatggttttgctggtcgcacccatggcagttaaggaccggttcgcgggatgccctgaaagaacttatcgtacttaccacaagccagcgtgggcaacggctgggcttgtagtgtagctctcatctagtcgacgcatccaggcaagggtgggcgtgatggagcggggcgggccctgcgacggcctctgtcgtttccggattcacctaggcacgagaggggactgcccgttgcccgctggggacgggggtgaaacctgaggtgtggtgtgcttggctagagggggttatgcgaagggtcctgtcacggcctctttctgatatgtcgtggtggcatgtcggcgcatggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaaattggatagtttaggtggatggttgggcctgtcgcaacgtgggttagcgttgggcagtggatagttgatattaattaattattacaacggtttaatctttcaacttctgtttataaatgctcgctttatgcaaatgaactgctctagctcttctttgataattccctgcatcatacccctattccggtatgacttgctgagtacagtgggtagtactcagtcttgctctacttttcccaacccagagttcgagtttgggtcagatgaaggtttctctgaggagtaggcttcgtccgtgccgtcgaggatgcctgtggagtggtgttcccgctgcagtttagtcaaggcttagctcctgttgtctttcttttcttccgctgcatttatgtaagacttttatgatgtttgtaagacgtggatctgaatgtcaacattgtcgtttgtgtactgtcacatcctgatttttgtttcaggatttataaattatttaataaattattaatagaatttatattaaatgatctttaatttacaagggaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttctggtttaaaaatccttaaattataaattgttgtttaaaaggaattattagaaatgattttaaaagcctaaaagagaagatctaattttaatttgctaaatctcaatataaaattgggctagataaaattttattaaatactttgcttaattctataattcctagattcttctgggatttatttgagctaaggaagtatttttaataaatggaattgcatttcatgaataatttaaattgaaaaaggtttttaaaagtcttattttggctttgggccgaaagtcggcccaaaacccctctctctttctctctccctccccggcccagtcggcccagtcagcccgcgctccttccttttctctctcggtgtcgctgacaggtgggtcccacctgtcaggttcgtcttcctcgcgccgtcgccgccgcccgaaaccctagcgcaagccgccgccgtctccttccaaattcggccgcgcctttccttctccggccgaattgattgagggcaattgatccttgagatctcctcttccttttctcttttggaaacatcggctaattttctttggaaaccggtggatttgagttggattcggattcatctctctcctctaaccccgacctttccttctcgtcgccggcagccgtgggccttcactgccgcctccttgcccctttaaaaggacccccggtgtctccgctacccgccgcctctctcgccttcgcccgccgtcgtgtgtagcgccctagcctcgtgagcttttgcgccgccgtcgccgccgttcgtccagccgtgcgccgccgtcgctacggtcgtcgtcgtcactcgggaaggccaccgtcgggatcgccaagtcgtcgccgtccccgtccgccgcttcgccgtcgccgaagatcgccggagcaccgtcgccgccgtcgacccgatctccgccgccgcttcttcctcgtcgccgtcgccgtccgttgttcctccgccgcttctttggtcaccggtaagttcgccgcgccgcgctctacgtcctggtgccctccgttctcgttgtcgcgccgtcgttcgccggcgagcttgcgctcccgacccgccgccggtgctgacgtcatcgttgccgttccccgtgagccggtcgtggaccgtttgatctcggccttccgttttgaatagggttgatctcgaccgtccgttcccgtgaaccgtcgccgtgcacccggtccaccgcaaaccctagccgttgatgcaataaatcctttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcttgtaaaattcgtaataaattcatttgaagtcagaatgaggccgttcaagtctcataattcatctaaaattatgatcgacatgtttgtttattttttatgtattgtttaattggtttttattagtctttttcctcgttttgcgtgatagcttgtcgtttccgttgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgttttcattgattactttattccttgataccttgggtgattataattggactagttgagctttatatatattggttcaactagatattagatataattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctccggccagagtaaaaactattcgaatagccgtgcccgcggttatgggcgagttgagcaatgtttttcgtgattagtctcacacctctcacaataatttatggatattataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagacaagttgcgaaggagaagacgtttggctcataccccagttgagctgcctgtgggagtggagccggagcttcgctagattttattttccgctgcagttttcttcttggtgaggacttagtgcctcttaagtaagtacttatcgttttagttaatttgatgaatctgtatattaaattgtcagtttgtgtacctcggctgattcctggacgaggattttatgcacaaataagtttggaaatcacttgtgaatttccgggcgtgacatgtaccccggctggtcctggacggggaatttaatgcacattctgcttgaaattctattcgggaatttctgggcgtgacaagttggtattagagccgaccttgaccgtaggacaagccaaatggaaaaacctaaaagccctctgaatccttttcattgcatatgttcttggcaattggatttgttccgggaaaattgggatccgttcttgtggttcaagggaaaaatcttggtcgctcgtttaagtgagatttgtcaaaacgagtcaatctagagttttagtaaaactcttgagatttattcgttagtcagttgggatttgatgggtgaaatgcattaggtcctagctcaggaacatgggttgcaaggtatttcagctcttattgttattattagtatgtatctaatttccccattattttatcgttatgtgagtctgtcttatttattcgcactcatgcaaaatgatctatgcataaaatttcgctcttattcgattctcttatttgagtcttttattgctttatttaaatttggatttgagcatgcattgatcctactcctttgtcttctctagatggccggacacccacccaaccaccgcggagaaggcatgattgattttgtggcagagttggcacgcatgacgctggtggtgggctaccccaacgcgccagagtagacgacggttccaccgctcagtggcgagcttcctcaccgtgttcgcttggaggtccatggctacgtgggtacctgcctagctaacatggtggttgaggcgtccggaggcacagcagatcacgcctgtcaggaggcagcatacctgatgatggccagactacgggagcgccacaactacatcttccatgacatggcataccgttttcaccctcgtcgagccagtggtgatgatgtcagcaccttccgtccgacaaccggccagaacgacaccacctttggtcacatgtgtgctgtgatgagtggattggataggatgcactcggacctgcacaaggcgaccaaggccttgaacgatgggaagctcatgaggatcgtcgctctgatggacgagatagcgcgcctgaagagggagaatgctcagttaaagggtcttcccgcgccaggaggagtccggatccgcaccacaccccgcaagacgacgacggcacccgtgcgcatccagcttgcgcccaggaacccacctccatcagcagctcccgcagcacctccagttccgcccgcagttcctgcagctccagctccagctcccgcgtccgctctctccttcgctccagcatcagccgccaggggtccagccagtggcaacggaggttggttgtctgctactcccagtggcagccgcgatctcagcagcagcagctccagtggctcagagtcgggcagcggcgagacttatctgccaggctccaggagtcgctcagagggacctggtgacgagcaggaggacgccttcgactccaccgaccgcaggagccgttccgagcattaggctcgttttccattagttaatcgactgtctagcttctgcttgttagtttgtgtgtttaggttgcttgcttggggtcagtcgacggtcgatatcatgtgcctatgatatggctgtcttaataaggattttcgcttgttttttttaagtgttttaattcagatcagaacaattgcagtttaaattcctttgtaataaagcttagtttctgagcttctgtttttcttcttttccccgtctgcttctccctccagatggtctacaccaggaatggtagccgcgcaacaggcgagggcagcaacggcgaagagcgcactgatggggcgcatccccacagcgattccggcaatggtccgccaccacttcccgagaatccgacgctagtccaagtaatggcacatcagacccagatgatggcagccatgatgcagcaccagcaccagcagatgcaccagcggatgctgcagcacgccgaacagcagcatcaacagtttggtccccctccccctcagtccaagttgccagagtttctacgtgtcaggccacccaccttctccagcaccaccaaccctatggaggcgaatgactggctccatgccatagagaagaagctgaatctcctgcaatgcaatgatcaggagaaggttgctttcgccacacaccagcttcaaggtcccgcgtcagcttggtgggacaatcacatggccacccgcccaccaggtactgaagtcacttgggtagagttctgccgtagcttcaggaaggcgcaggtgccagatggggttgtggcacaaaagaagagggaattccgggcactccatcagggcaacaggactgtgacagagtacctccacgagttcaatcgcctcgcgcgatatgcaccagaggatgtccgcaccgacgccgagaagcaggaaaagttcatggcgggtctggatgacgagctgaccaaccaactgatatctggggactacgctgacgttgagaggctggttgacaaggcaatccgtcaggaggatcaacgcaacaagatggacaggaagaggaaagccgcacagttcagggcacctcagggaagtcaccagaggccgcgcttcgctcccaggcagcagggtggacctaccaccatgatcgttcgtcagcaccgcccgttcaaccctagcaactttccccagggcgccagtggcagtcagaaccaccatggaggtcagtccaaccgcggtgcagctccacgcccaccaatggcaccggcacagtcaggcccgcccgcgcaagccaagaaggagactggagcaaaaccagggtcctgcttcaactgtggtgagcttggccacttcgctgacaaatgcccgaagcctaggcgtgccgggccaaggtttatccaggctcgtgtcaaccacgcatctgcggaggaggcacaagcagcaccagaggttgtactgggtacgttttctattaactcaatccctgcaacagtactttttgattctggtgcaacgcattcgttcatttcaaagaagtttgttgggatgcatgggttaataagagaggaacttagcacaccgatgcgggttcataccccagggaatagctccacttcggttcaattcagcccttctataacaatagaaattcaaagatcaccatttctagccaacctcattcttctcgaatccaaagacctagatgtcattcttgggatggatgggct

SEQ ID NO: 67130 - DNA, 26130 bp, Oryza sativa
tatataaaactagctgggacccgcgcattgccgcggacatattgaataatcaaatcaaaagttatacgattcttttgctaatcaatgaaatattctttatcattataatatagttaaaaaaaatgtatcaattgttccatgtacatgacctataattgtttatacaaacgaagcattggtgagttcaaatagtagacctgaaggctatcaaaatacaatgtacccaagcaattaactaagagttgttttgttatggatgaaattgagaaagctgcacagggtggcctctacaaaaaattaagctcaaatgcaatgcaagatgcataagtattattatacacagaattttgctcaactacagaatagaaatcaagcaaaacatgaatatatggtatatggctcaggggagcttgaacaaagttggcattttacatctgatggtgcaaatataattttgtcaaaaaaaatcttgtataaaaagataagtaagaataactaatcaggttgtctggtttaaaaagaactaaaatagtaataggaggatctctagtatagaagcccggtgaaggagatgtaacaatatattactgtaataccttcaaaggcctcggtaacaataattgtacacagcacccaacgaaagatccttgtgtgtcatgatatgatactctgcatggagattgaaggtcacatcaatacatctgcatttgcagagacatgaaaagcagcagcgcacagattaaatcatactccctccgtcccataatataagggattttgagtttttcttataatgtttaaccactcgtcttatttaaaattttttgaaattattatttattttaattgtgacttactttattatctacagtactataagcacaacttttcgttttttatatttgtaaaaaaaaattgaataagacgagtgatcaaatgttacaagcaaaaactcaaaatcccttatattgtgggacggagggagtagaagttagcagttgaggataaccatatgaagaatctcaaggacataatagattcacattttactgatagtatcttacccatcgcaattatcaagcagcgaggtacactgttaaactgaagctattgtcctaggcataacaatgtaaatatgagagaggaaaaaaggcacgcgatgaatttgaagtcatcattcttgaaggatatctcagggaatgtgctaggatcagaagaaaacaatcatgaacacatccactgcatagttgtttagcagagaaggtgcatacatcgttggataaaaatgcttcctgaattgagagaaaaatttcatgaccaaatcaacgtaatacatagcataacttggcttcaatgtgatatgagtatactgcaagcaacaaagagataacaccaacaaactttgtgctggcctataatacctgcaatagccatctttaagtgctctagaactgaaccatttgggacaaaatattatacagttaatagctgccatatcctttaaggcctgactcttatgtaactgaacgtgatgagaaatctaaaattaagtgacagcagtgtgtagttttgagtacttaactaataatgcataccgacgggctaagtccatcaagcatttcatcaagtatatgacatacacaaacatatatagtagacgagtgtatggttaatttaccttctatttcaaagagttgtaggcaatcaatttgaaacaatgattgagatcaaccatcttacctataagactgtaaagaaaatcaaatgaagctactgaagaattctgaaaatctgcaaatataattaaacaaaaggagaagagcacaacgtaccttggttctattaaactgagctgctcacaaagtcactgcaccatatatatcaaaacacagctgcaatggagtagaaggtgcatctaagcttatggcatggctataagaaaaatagctttcaagttatacaacgcagcagcaggccagtgaatctgacatactttggtcaagataagacaccacccaacattaaatttacattgtaaaccgtccatgaattttcctgtggatgaaacaatggccatggaaatcatctgttgtagagtaaacgatggcgaaaccaaccaattgacaacaaaatgaatagagtcagaccagataaagcgctgttgcggatgaaaatgcagatctgcaaggaaaagaatcaaatattagatattaatgcctaaaattaatgatgcttcagcagcagagaagtggcaaaactttatcctggacagggagcagttggaatagtgcaggcacgcatcggaatcaacatttatggcctaatccagagagaagataacagaggcatagaagcttacctatatccgcttgctggagctgactgtcccgtggaaggcaatgacggcagtggccggaacacacttactctactccgtactgaaaccctaaagaggagctcatgctccatggaacacgcgtggtggcggatgagcggaggcccgggaattcagacaactcgatgagaggcctaccggagcaccgctcccctgtactgaccacggcgaatcgatggatttgggggtcaatgtactgtggtggtattccatctagaagagaaaaaaatcccctaacaaacaaccaataacggctaacctaaaatacatttacagttcaacgtggagatgtacaggaaaaggtggtgcaaattcaatacctgagtggtcttgctgcttccggtttctccgacgaggatgagggtctggttgtcacggaggacggcgaggaaatcgtccttctgctgccacacggggagcgtgcggtgcttctagaggatctcgaggtaccttgccgagtagggcctccccgtccaccaattgatggacgggttggccgcggcggtggcggtgctgttggtggtgccggcgtggccgagcttggtagagacggagctctcatcgaccacgtcgaagaggctcaccatgcgcttccgctccgtccccatcacggctgcggcagcggcgaagcgggggtcgggtcggttcgcgcggtaaggaggaggaggcgggcgggggaggtgaaaccctagctcggttcccctctcgccccaatgcagcgatgcgtgggggaattgcgcagccgtgcgggatgggatccatcgatctgtttggtgggatgtggggccagcgaagcgacgcatacgatagaggaaggaagcatcgcggcttcgcccgccacaaggagacgacggacggatggatccaatcgagaggagcagatcgagcggcgcagaagcaaacaggaactgttgccctgtagcaacccaagacgcgctgagattcatcggcggactggttaaaaaactaaggatttgatatgatgtacgtgcacgcatgtgtgagtagctcaagagtttatcaaagcccgagtacgtgacttcaatttgaacagaattcatttgaagagctgttcgcctgttctggtatgtagatttgggtatttactactagaaaaaagatttttcatagcgttattctatcattttcgctgacggtcatacgagaaaactgctagcaaaaacgtaacaagaggtggagggctacggaccgccagtgaaaacagatttttgctggcggccgagttaagcgggccactagcgaagatgttgctattttccctgatgccgccaccgaaaatcagattaaagagcaccacggcgaaaaatccaccgcccacctattaaaatccgcgcccaccaatatattccacgtgcttctccgcctctctccctcctctctccgcctccacccaccgttctccctcctttctatgactctccatccggccgctggccaggccttgggagctgcgacgacgaagctcatggcgcacagtggcttggtcgacgggcggagcaccggcgacggcgactcgcggggcggcagatgcggcggcggtgactcgcggggcggcgaacaggggcggaggtaccttggttcctgggtattcccgggaatacctaaaatttttttatcaaaaaataagtatacttttaatatatacacatgtacacatattagtgcacctaaatcctcaactcttcgatccaaacacggcccaactggcctcttgcattgcctcctaccaacctgatccactccgtcatgacccatcagacatcagttgacctacttagccaccactcttccagacgacgccctctcgctctccctccgtgacctatccctccctggctcggctccctcgcgccgctccccatttgcaaaccctaggcggcggcgcggcgaggctaggtggcaaccggcggcgggagctagaccgtgctaccatggagggggagaccattgccgccgccgctggaggccagcacccgacactctgccaagctcaggcggtcaggctggttgggtggccggcggccacgaggggcagggatggccagcggtttagcacttagacagaaatacccaactttaaaatcttggctccgccactggcggcgaatgccacttttaagctctgtttttatttgtactatgtttttttttaaagctgatgatacatctattttatttgctgatagctaatgtcactttttgacccagttaactctcttgcccgtggcaacgcgcgggccgccaatagtatatagagatattatgcatatgcttgcgtgcataagctagctgactcgatcgtgcgcgttaactattgatcgatccatcaaccggtcgatatcaagctgtacctacgtacatgcaaattaactaattaatcacctagctagctatatatatagattccatgaataatgcttgtgcgtgtgcgcatgtgtgtgtctatatatatatatatatatatatatatatatatatatatatatatatatatgcatctaattaataataatctctcgctctgtctctctctttctttcggagatagcatgcatccgttgttaactggtactttatcctcctcatgcatccacatgcatgcatgtgaccaataaaagaattgcacagcaagtaagagaattaatcaatatatgtgaatatgtctgtgtagctgcgctgtacgtacctacatgcaaattaatcacttcacttagcttccatgaatatacatgtgcacgcatatgcatctaaataatgtcatctatatatatacggatctttaaaggagttttcttcacatgatcagtgttaactttcagtttccaccactactaaaataaacatatctacagtttggcactatcggtgttggaaatactaaaccggtacctataatgcttttcccgctccaaacgcgcatccatgggacaccatcggcctgaactggcaccttgctgaagacacatgtgccggttcgacaagtatcagttttttaaaagaatcgacacctataatatattataggtcctagtttattatcatccgagatgtgccaggaagatctagcatcaagttttggaatgacggacaatggtgaagtcagatctaagtatgaggggaccaacttaatttacaagtaattacactaagaaaaaatattataaaatgttacgaaaatagatgcacaacggaaacacaaattttacgtggaaaacccttgcggaaaaaaactacggacgccgaccggcaacgatcaatgtagaggagtttgatacaacgtgggggatacattgggctgttacactctcgccgtgtggcttacaagggacacaagggtggatctgaatgggggccttggccctacaccgaaggggggcaaaagaccccttacatttctttttcactttcatagtgtacctgtgcagtagacaccccttactccacctctcattctactcgttgtttctgctcgtttgtatatataagtaactactagttgatacctcgcactttgttgcaagatatgtgaatgaatgcatgttatacaatatagaaatggtagatgtatatattttaataatgtgaaaataatatggagataatgatttgacactttttgcatattgatttcttaaaatacaacaaaattataaatgatatggcatatttgcataatatttaaaaatactctagataatagttgttagtgagtgatgatgtgacacacttgtatgtgatttaaaatactctagataataatttctagggagtgatgatgcaacacacttatatattgagttttaagagttagtggatgtcaactttacactaagatatgataagtagaagtaattatatatcaattcactgttagaagccaatgttatccagcacttatgtgaggaagcacaaggcagttggtaagggccggagaaagaccagcacgctaccttaaagcaggtcatgactgcttcaaccaggcaatctagcttggtgatcaggaccagaaacaggaccgtccatgtgtgagctctgcgacttatgaaaaataaggaagaagaagaagttaggagcctagaaattgctccctctatcctagaaaaaaccaaactcgcactaggacgtgtcactactacaataaatttaaacatagagacatcttagtacgaggttggcttttatcgagacatgatatctagatcagatccccccttccccaaaaaaaaaatttactatttctgcttcacttaatcgggttgaacaaattattttttctcaactccgacaagtgttcgatggcaattataactacatccaagatctgtattacgttataacgaagcgagtatgcaatctaggtggtatgattctattttttttatttggttagaagaaaatgaattgttgcaatgattcttattctacttattcacaatgtcactacatatgttggtgagcttatttaatagtatagctctaagttgtcgttagttgcgaacgggtttttacttgttagataacataacataactaaagaaagaagtattagattgttgcgtacttccattgcatagttggaaggcaaaaaagattaagaaaaatgtagtggtattagagacccgtcctaatgcaatataaattatatataaccctgatctgtcatattgtcagtattttcaaaaagataggattttattttatatttcggaaatggacttaaattgttagggatggcccaaagatgatggatcaagtaacgccaattctttctgcagcaacaggctgccgtatttttacctcctgtcgctgccgatgccactggtgcgcactgcgcagctgatggccagcatcatcttgatctactagtgcgaagacgacgagactgcagctgaacgagccatgtctatcgtgtgttatacaacttattacaatgcaaggactgaactgtgtgcttttcagtccttgttagctagcttgtgctcttcggtagggcacccacaatggattcttaagccctctaagatacatatacattatgaatgaagatggtccttaattaattatatatgtcttttggatgagctactatatatcaacaataaagaccaaccacacaagcaacaaaacatgcagtgttcatctctattcccatagacgactctccttaatttctctctccaacgtagttgcttgccgccatggatgcatggatagggaatgagggcacctgcattgagcgtcgctaattctggccgcgagatgatgccgccactgtcgccggggcctcctcctctcgcgagcaccgctgctgtcgtgcggcctcctactacgagtggcgccgatgccaccatggcctcccgcgagccaccaccactgtcagagtctcctagatatcatatattcccgttcccataatcacatgctatcctttcctttccaaattccaactcactacaataaaagtgtaaaagtgtcttgtaaagacactttggtttaggtatcatgtactatgcctcgaaaaaccacttgagtggagtctaacggcattcattagaggtatttaataaactatcaaataaatagaatcttaagacatttattatctacatgtctagagacatgttactagttcattataaaacgcctctacacctatagatacatattgtaattgcatcaaaatagtgcccctacatttctttagacaaattgcagtgcctctatggaaatataataccacatatcttgtagagacattttacatattgccattataatcattgaggcaatttagatagtgtctctatagctaactagcgcaagaaaaaaaaagtgcctctacaaaccaattatgtcgcagtgactgcagcccaagccccatatgttactttttctgaacctatttttaccgttccaatcatctcctatttgatcgcaaccaagtagtgctccacctctggccctctgctaccatcctgcagtgagtgaggagagagctagaggcgagccaactgtgattggttgctcgctttgctttttttagcccaggatggctggataatgcagcagccagctagctgcacaccagcaaccatactcgatctctctcaaatatatacttccttcgtttcacgtaagatgttttaatttttggtcaaagtcaaactgcttcaaatttaactaagtttatagacaaatataataatatttatattaccaaattagtttaattaaattaataattaaatatatttttattataaatttatcttaggtcgaaaatattactattttacttgatcaaacttgaagtaaacatcagtacatctctttatatacgtcctttattactccctctcttccataatataaggattttgagttttgtttacattgtttgatcactcgtcttattcaaaaaatttgtacatatataaaaaacgaaaagttgtgcttaaagtattttggataataaagtaagtcaaaataaataaataataattctattttttttaataagacgagtggtcaaacagtgtaagtaaaaaactcaaaatcttatattatgagacggagggagtatctctctatttttcatggaaaaaagggcgacaactttcttttccacggaaagaaacacgccactctgaacgggatttttccaatacgagaggaccatatatatcgaaaaatgagggccgtgagggaatgcgttaagcccagtaccacaaggcccacctagaaacccaggcagttaattgcgctttgagtttttttttcttcccttttgcaaaagagagaagtgatccaaatttaaaggtatactaccaaaatgcatgtgccttgcattgagtgaagccaaaaagagtagtagtgagtgtgtggggagtataaagccaccaagtttaattgagttccttataagcaaatagaatcttcccggtgtaagaaagacgctcacatgatgtaattattttttctctaaatccattggcatgggtgattataagaaaactattaataccaccttaaaatgaaattatgtattacagactaaagtttgaaaccataatatgtacttttgtcatgtattattagagtcgattgcaatgcatggttattttttgagtaaattccctatgtacccctaaaaactcactcaactctttcatacccccgaaatttacccgattccttctatactcctgaaatttcaacatgattcattccatgcccctaccgttatattttctttcatttcactattacatttggttgcaaatgtctttttgcctttgatgctttaagtttgaatataagcttgaaaaataattgaaaattttgtttgagtgcacagtatgtgcattttatgaaactaataagactaaataattagtgcagaaaattttgacataaattttgaaaataaaacaaatgtaataaattaaaaaaatttatttgaaattttaataggacaatggattttttttatcgggagcattcaaaaaaaattattttcagcattggtagtcatatctttgtatggatgctcctaattttttatgaatttttttaaaaaataaatacatttttttatttcattatctaaagataaattttgtggtagataatgcatcacataacaaactcataactataatagtctcatgcaataaacttttatatttttaataatgtagttcataaatttatatgttcatccaaggagtaaaatggtcatttttatagaaattagatggtcaactgacgagagagataaggaagggatccgaatcatatttagggggtatacaaggaagtaagtaaaattcagggacatataagggattagctaaaattttaggggtatataagggattttctcttatttttttagtacttgatgttgataaaaaaattatatttttcatattgtaaagagtagccttagtagaataaatgttttgggctatatatcggatcaagctcactgcactccaatctagaattgatttcactctaaaaaaatcagaaagaaatcatacagtgaatggaaagaaagaaaaggaagtgatgtggtgtcctgttgagaaattgagagaaccgattgcgaaggaaaaaaatgagaactttttggtacaatatactgtaagtatatactagcagtataaatcatcgaacgatatagattgtagctgcaatggcttcaacggcgagcttcttagcctcatggctatgcgctcagctcgctgccagcagcagcacgtgctatgccgcccacctgttggccaacacgcccaccaccgcagccgcgcctcctgttgtacctggcctccctactatgccgtcgttgcctacacaccgtcaccgatgtttatcgttcagtcaatgccatgggtcgtctctccgctccggattgatagggatgacgttatctttgtcgggcctaagtgaaaacccgccaccaacaacattcatcggtgacgggcctaatagttatctcaatcaggtctcaagttggagctcgtcacggatgatggacatcggtgacaggtttctgttagggctcggtcaagatatcatcggttatctttgttgggcctgaagttagggcccgttactgataggtgtcattcgtgatgagctcgatttttatgcacatctaatatgtctgtgcgagtatatttttatcagcctctttttagatccgtttgagatgactttgttgtgacggactgtaaaacccaggcatgtgaggggccgtcatagatgagaggatctgtactagtgatgcatgcatgtacattttacgttggttatgttctgtccctagaaattcggagaccatgtgcgagccttaaatttatgtgacaaaatgttcaattgaaaattaattcagtagatattggactgcaaaacaaaattggtagacaagaataattattgaaaagatgggcttggtagaatgcttgatgggcaatggcgtgtatggtgtgccatgctttgatctgtgctggattgcgacacaacttataagtcgaaaagtctaattctaaacaaccaaacaactttttcttttcttttttaagtcatatataagtcactataacaataataagccgaaaactagatcaaagaagctttttttgtcttatgtaaagaagatatatgacttcatcactaaacttaaaatattaaatccaccgacttataaatcatacaagctaataaattgacttaaaagtctaaaccaataaccctcggggggcaaagtccgagagggattagagcgcattggcacacgcgatgattatttagcaagcagtggacatgaatgtagaatgtgttagcattatagggggcaattaataaagcggcaactggatcgatcgagacgacaaaccaaacactatccacgaaatctatcagggtgatatcgatgaagctcacctagctaattgaacatgttggcatggcgtgtatatacctaactgtacacggggccccatagaatttaggaaaatgtatactttgactcctcaactattgatcaaatctaattcgtacactttaacgtaaaactggatatgttgactcccacaacaatcaaaaccggtgcaaactatacgcctcggtaatttagaaagcggtttggcttatatgataacttggctagtatttatccaacatgggacccacatgtaaatctcatagaaaaaatagaaggcctcgctagcacctaagcgacgagggtgagctagcggtggtagtgtcttgggctgaggtggttggtagcggtgacacaccgtgtggctggcaactgccaagataggcccgagctgagcaggcagcgctgaggcatcaccggcgagcttctacggcagaacttcaagtaactcgaccacacctttaatttgggacagcgcctgggcttagagcatcttgaccactactagcactgctgttggcgagtgctagggctcttgatgagcttctctcggcatctgctctcttgctgccatgaaccacccccacttcccccttctcctctccaattcgctccccctgcagaagcccctctctcgcgtgctccaagccaccgcatggcgcgcattgtcatcgtcgtaggtggatctccagttggactctaagaaaacgccggtgctatccatcgagctctacaggctcgcggtgccgtgcgccatagggaaggaggagagggaactacaacaaatgagcttgctccgtccaaggccatagggcggcgcaccacccagctcctcactggacggcgccaaaagaataacagtgttgctactcccaacgttgactgagacatgtgaatgggataaattagaagaaaaattatgtttggcagcaggtatacagaaatagctaacttttatggtttataagaaaaaaaaaggaaacttatgatagcagataatgacttctaatgtaaacaagatatacatcgaacattagatgatgatggatggcttggatgtctactcgctgattgcgaagttgtacatttggagtcttacatgtttcaaaagactcacgtggctatgaaattaacagtattataacttactcgatcattctctttttaatatcctgttttggttgccaaaacatacatattgtccttattgtttaatatcattactaaatactactgtaacgttagtacggataaattactagtcatacactagtacaataacttggctagtacgtgcgaacttttgtcaaaaccttccatgcaggaaaaaattatctaacatggcatggcacacactgatgtataattattattaaccatcaaatttttcagtgacaaaatatgtaattattacttttagtatgtttctgagatatagacaaaagaaaaagcaatacagtttaaaatatcttattataaaaatagctttttttaaaaaaaaatctcaacgaatgatcccttgtcccttttcttcttactataacctcgtgtatactttaataccaatttgatcctaatactctactaatatcgttgtcaggtataatcttcgataacattatagattggttttgcttgcacgggtagtttttttttttctgcttgcatggatagtttgggcccaggtacggaataagcaacttgcatccactcttagttcatgtataccatgagcttaatttaaattaattaaacattactatatattttcttccacaccgaactgtttattatttcacattttaagagatttttttattacacggtaagcacatacgtgggcacacttctacacatgcacaccacactcactcacccgtgagtacgtacgctaacacatgcttacaattccgattgaaaacccatttacgtgtgtatatagtgtttttgagtaaatactgatgggtaaagtaatgcacccatccacgacttcaccatttgctccaactgtggctattttgccattcaaatattaagttagtatgtatgtaattcatgtacttacagaagcgctatacaatttattgatagttgaatgctacttaaaaactaatattatgggacgaaggtaataattaaactgtcctcgaaggcaccaataaaactacagcaacacaagtactatggttagcatccatgtaagattgctaacaatccatatagataaatacagttgtgaacatttggaacacgatttcatcaaactttaaaaaaaaaaacagtagatgaacaaccttactaggaacattacatcatttgattttatttagtttgaggtagataaatacaatgaacacaactttgggtaacacacaccaaaccactacaaccagaagctcaatacccaccatataattagcacaaaacaaagtaattaattagggcagcatgagatccacgggcttatcaaagatccagctaaatggaatggccgtgggccttttcctcatctgggccgctctgtcatgggccttctcctccatcctccggatcttctgcggcagcgcgcacacgtagtcccgcgcgcgccgcccctcgccggagagccccgcctccagctccgccacgcgccaccgccgtatcaggtgctcgaggattccccggtagtccgacgcggtgtacgtcccggcctgctgcgccgccgcggcgtagtgggcgaacaggtcggcgtcgcggccgtcgtccatgagcgcggcgggcatggtgatccggcggcgcatcatgtacgccagcgcgcgcacggtggtgtccgggtcggcctcgaggagcctctcgacgacgcgggtgtaggcggcctcatgacgcttctcgtcggaggcgatggcgccgcagatgcgggcgagcgcgtcgtcgccgtgggcgcggacgttgcgcgccgtgttgccgtgggagatggcggtggcgcgctcctggaacgcgacgtagatgaagccgtggtaggggctcgccggcgcgtgcatcgccatgccggagccgatcagccggtgcaccgtgcgctccacctggcgcatgtcgaggcggccggagaggtacatgtagcggttgagcacgtcgccgtggcggttctcctcggcggaccacccgcggatccaccgcgcccacgccgtcgcgtcggcgccggtgacgtcgcgcgccgactcgaaccggttcgccatgctctggtacgtggggagcgcctcctccgtcaccatgttccccaccaggcacaccaggtgcgcgtcgggcacgccggcggcgcgcccccggagctcgacgcacgccgcgtggaacccgtcggcgccgagcgccgccgcgtcgggcaccaggtccgccggctgccacgcctcctccgccggcttcagcagcggcagcacgtgcgcctccacccacggctccatctgctccagcacctcaagcctcgccggcgccaggcacctcctcacctcgtccgcctcctccgcctccgcctcccgccgtgacgtcgccaccgccgccgccgccgcgctccgcctgcaccgacactgccacgtcagcacacgtacagagagctcagcgaccagtggcggttaaaagcttaccagaatcggagagtggcagttgccggcggcttgaggtgacagttgcggtttggatacccaaacatggttactgctaaggtggaggtcgttgccgatgccgccatgatcgagcagtacgtggatctgatcggaggagggaggaagacgacggcgatggcgacggcggcggcggcggcggcggcggcgagaaggcttggaatatgagtggatgcgactacttagcgagctacccttgcagatgtacgtgtgggtatatatatgctacgatcgatgtgtgtagagcttgtgttaatttgattaattaattaattatatatactgttgcttaattaaaatgttttaattggttggtggctgctagctagctgactgcatgcctggctcgcggtatcgtgcgatgaccgtttttgcatgcagaatctgtaccttaaataagtatagtattaactaaatcaaatttagattacaaatatgttaaaagaatattatgcccttccttaaggaacagaagaaagtatttattcaattaccaaaaatgaggaaaaaatacaataatattggaaaagtatacgtaccgtcgactactctaaaactacactattttagcaatgaaattttaaagtaaagctgcaattttttaggtagggaattctagtgttgaaagttcaggttatatttttcttccgtttcgggagctaggatgctcggctaacatttggaaacgtggggttaaggttaccatccaaattaaggttttccaagaaggttaactattagtagcatcgacgtcaaattaatcaaccgggtcaaatccttggcgtacgtcttattcgagctttttttttatttagtgtgtactataagccaaattaaagagacatgtgcatgactcaattaattaagcaaccaaaaataacttttagctagggaaaaaaaaccatgccacgttgaaccaaccaggtgcaaaacggtatagattatcacccagcttaaaattgaaaagctgtattaatcaagcaccatatagaaacataatgttgatactcgtgattcgcccatgatactcaatgatactcctacatttttatatgatatcgatgatggatagaaatagcttacatgcatgatatcttgaggtctaattgtagtaccttagagatactcgaattaaatttaaaaatatactgttcattcaattttttttgaaatattcgggatgtaaattttttttaagaaatatattgtcaatctcgcgtaaccgttgcgcaaaaaaaacatgatgtcatgggcgatatcgcgcgaagaaagtgcgagaccgcgcggcaacggcatgagaccacgcgatctcgtggaatggaagagggagaccgaacggtaaccaatcagcgacaccgtcccaacggcttcatttgattagtgattaattacctaattaactattaactaataataaatagtgattaattatcttgattagcgattattaattaatcaataattaataactaattaaccattttgaaatccagtatcgctctctggctcaatgagaccattcggtttcgctcttccgttccacgagatagcgcacggtcttgcactttcccagtgcgataccgcccacgatgtcacgcccacatcatttttgtgcaacggttatgcgagatcgacgatatatttgtgcaaaaaaaatttgcatcctaaatattactgaaaaaaaattgaatgtacggtagatttttagatttaattaagagatactctttgatgtacgttgttactcgtgattcatccctgatacccaacaatactttttttataatggatactgagaagacttttaagtgaaactagctaaatgcttgtgctttgttgtggctaaaaaaatcatattattatctaaaataaataaaatcatatcttttcctaaaatatgtttcctacctttttattatagagaatactcacttttgtttaattttatatgtagttgtccatttggatttaattattattcaatatatcctaaaatataaggcacaaacatcattaacataaggattaagaaataattattaccacttacttgtttcaatcactcaatagatacaatgtatgcatccaatggaattggagatgttgagggtggaggatatttaaaaaccgaatttaagaaagaggaaagtactaattaattccatgcatgtatacacgccttatattataaaactattaagaaactacgggtgatctcatccacccaaggaaataggaccaacggttgctaatctaaccgatagagaagaggagatcgcccctctctctccctttggcgtccctctcgacaaccgatgcgatgttcccaaacatcgcatcccctgcggttggcaccgcttcacattgtataaatgtactgttgatcaatgagaaaatcatccattcgctctattgtgttcaattctctctctcgctcaatctctctcgctccaatcaattcatccactttcaacacgttagtcgtgccttatattttagcatgaagagagtatgtcatattaataagtttaagagataatatttaaaaactgtaatagtaacatgtgggctggcagattcactgccaacatcattagagtccttttaaggaagtataaatcaatgatacattaaagaatcatatactacctcagtctcaaaatggattttgacaatatatcgataaaatcctttaaagtcagagatatcattgtagtatccttgactttcggaatgcaattctaaagatagcataaataagtgatagagaattttttttttgtttgcaagggacaaaagagttcattgatcagaagataaatccttccccataggatgtgagatgaggttataagagttaccacatcaaaattctgagcttgcttcacaatgagcataatttgcaggctcgtagagagttgcaaacatgacaaactttttttttccttagaaagcgtggcacgccatatatatttttcgtggccgaaatttagcgttaatttacatgaattgttgagttgtattttccatatctgaatgatcgtatagctgctaaacgtaataaatcttcctttttttcccgaataattgacactgttccaactgaatcttggtccttcagagatattggttccccggcctatctctgtttagccatgtgttactaccaaaaaatcagtcataaatgctacatgtgcagtcaaaagtgacgatatttagaccagttgctcgagacgtgccctaacattaccacaaaattaaccaaacacatcgtaagtttactacagacacatctgacgagtttgtttcgcaatgaattctctgacagcaatacagcatgtagcagtcattcaggcccggccagctactgcaaggcaatgaatttgcaatcaaccggtggatgtagcttcagtagaacatgtcgcatagacgtactccaaaataaataaatctaaaacaaacataggatataacctaatacaacgaatctaaataaatcaaaataaacaaatctaaaatataatgttatataatcattacaataaatttgaacactcgttgtactagattatctctcatctcatcctgggtttgtttatttcgggatataatgcatggagtatagttgctgactcccactgtccataaatataaatgaataaatggactctagtactatattttcaattcattcaatcattatatatatttagtatttactagtagccatgggcggatccaacgtgggtgcagggagactcaagtcccctctacacccacaagacctatggatacccccgaaacacccctttcaattttttcaccatgaatgataaactaaaggtccctaaatggctagatattgaagaaactgtgtaaatgagccccctcaattttttttattcctggatccgctactgttggtagcagcattgttagacgtgatttttctcaatttaggaaccaagggagtacattgatacgcaggcgcagggctgcagaaacacagcagcagcagtaggcaggcaggcaggggcaataaaatcacagcttaattttagggaaacagttgtgtgagcagctatgcatgccacctgaatgctcgtgaaaatatcggcgactgcatgttcaatgctatctcatgaaaaatatcggccaatgcatgttcagtttaatgttgttctgagtcatttctgtgtacattgggagagagagaaagagagatacatgttcattggtctgctgaagaagaaatggcagagaggtggatagggtgtcatagaggagtaactgcatgctgaaacagaattttgtgtgggtcctaaaagaaatgctatgatcatttacatggcatctcaaaaatatctgtgttcctttaaaaaaatttatccatgttactgctcttccctgaggagtaatgggatgcagggatgggatggagagcctgaggagaaatttatccatatttttcaatttgacaaatttgggttaaattttactatttcaaatttgaactattgaaaactattcgaaaatttcagttagaatctaatttcgtcccgcatcgatcgaaatatcaaaatttcattgtttttttattggttttcataaaaaatgtaagccctagattttatcgaatggtggctctcttaccagatttttattcaggacacaatgggtcttatgaaaatctttctatatttggagaaattaaaaataaatgttcttattttctggaattcaatgcctaagtgtacgtaagggtatggtttcattcttttagatatgaatagtaatatgtttatatgttttaataggtcagaaccatataattagaagagatgtacgtgatcgaggataaaatattggatccagtggttacttgtgcgaaacgtacgaaagtgctacgcacggtgggaggagcagatggaaggagcacaactctgaatttaaagatggtagagatattctcatgtatacatgtaggatgaatgagaataatgcaaaccattattatggtttgatatgtaaaaatgatatatgagtagatttttcattaaaaatgcttcatatagttacattttcaacgatttctataaatatattattagaaaaaataacgaaaaagaacaaagttagtagtttgccttttatgttgtttactcataaaattatttactttctaaagaaatagtatatataatttacaagtctgtatcttttttaaagaggagctaaatctttcgtgacagatgtttaataatgttttcacggtataatcacgtgagtagaatctctagaggttgacttgagaacgtaaaacatgcatgccatcttttttaaaaaaaactaattattattcagtccccatgacttatctacctgtgacaaacaaatcttggcacagagatgacaaacaggaagatctagtcgcataaaattattgctacagaaaccgtgcccacattatggaggcgaaggtgatattattttgatgctgatcctcattgatcagatattctagctgggggggtccttgagtatggccgtggcagtacagatcaaagaccacaatatgtggcattaaagatgtggaaccccgtgatttgagagagagagagagtgaaggaaagcgccgaaagcaccattagcatggttggagacaacaagaagctttgcctaggttgtgtttgcaggaggtatctgaaaactactggtcttatcttttcgcttatgattatatttttcagctaaaatttaaattttcaaccttaaatttagagttttttcatcaaaatttatttttcaaacattgattttagatcactaagaacacatatataaaatttttatttataaattatttttcatttgcaaatatattgtttggcttattccacgaataagctggggtcgtacaacttatttcagaattttcatcttcccaaataatcagtggcaggcccggctcagttcataggtatccatatgaatatccataatttttagtaaaagtaatatgtatatacaatgtgtaatgcgtatgtatacgaaaaatataaaaaagatgctacattcaacacataatatgcatgctatatattattataccatcagtactttgtggtattataactgctaaatattagggtttttttaaattaccctaccacattttttaatacacaactaaattatgggcccgctcctgcaaacagtttagattattgcctaaatttgaagaactgtagttatactattgagaaaataaactcgaaactaaaagttgaagctcagtttttccaaattgttaataactatagctacatacttacaagctatgtttagaatcttaagcttcacaaacagggttatatattggatggaagggagagggcctactagtttattactccctctatcccataaaaaacgaatctagtaccggatgtaacatattctaatatatgtttagattcgtagtattaggatatgtcacatcggatactatgttgattttttatgggacggagggagtacgttggagcaacactaacttaaacactgctttgtgtgaaaaggtgtattatttgagtagttgcagactgatatgcatatggagttgtttatgaataaactattggtcaagaaggctccaacaaggatgtctagttgtctagcaaattaagtattgttagttactgttccaaatttccagtagagatggcaatacaaacgatttgggcgcattaatcactaatatttttgtactttgtcaaatgtagccatcaccggtggagaaaccatctttggtcggtcggctaaaatccacaatagtcccggttgcaataaaaaccaggactaaagattcaaaagattagagctacttttttatctttagtccagatctatttctagtcccggttggtaacaccaaccggaataaaagatcggcatgcgcggcggagagtacgaggcgtgcacgagatcgaggaggaggagacgggatcagttaataaattctatctccttctccctgaccttatctcttcctcttcctcctcctcctctcctttaactcctctcctccttcctccctcccccatcatccccacttatgatctgcagcgcgaaggcccgggcggccggcggcctcgcggcctcgcagcggcgcggcggcacggcagcgtgatggcgggcagcgcggcggcgggcggagggcggagggccgggcggccacgtggcgggtggcgcggcagcggtagccacagcgagctttttttcctttttttttgagaatttgtgattcggatctgtatatttgatttgtgtgtgatgtgaatatgtgataaattttgtagaagttgtgatgcaattttttttaagattttgtgatgtatttggatatgatcgatttggggatttgaggatttggggataatttatttgggattttgggatggggactgagtgaaatcaatatattaaaaacaatgaagaaaaaaaataatggagcaaccggatctagctagactagctctatctttaatcccggtttgtgttaccaaccgggaataaaaattctctatctttagtcccggttggtaacagcaactaggactaaaaatctatttttactcccggttaattcaccgggactaaagatagcgatctttaatcttggattcgtagtcccggttggaaaaccgggaatacaaagggttacgaaccaggactaaaaaacacttctccaccggtgcatgtataactgtgttaatcaaagttaacggctagtttgaaaaaaaaaagtgatgtacttcatgtgggtacttaattaacgatgtaatttgacactgctccttattttttatgtgagatttgctaaaataatactagatagtacttttcgtacatccaaaatgcaaaggattccttttatttacggaggtaataaattaatatgaaatggagggagagttagaagtaatatattatgcagtctaaaacgtgggatcgtgattattgtgaataaaaaaataaataaataaagtggttacaagttgtgaagctagctcgtgtgtgtgaataagatttttaattaatacttgtacagccactagttgagttgtttgacctgtacattcatcaattctgcagcctaatcttcgatcccaatgtacaagcatgggtagtacgccagctgcaatgggcacgttgtcacattgatgccagctgatgtcttcatgggcatgaagaattaatttcgagatcctgattggaccttgaatgatttcaatgaaaaatagtactccactacgatactcctccatccaaaaatactactccacgcgttgtcgtagaaatttagcagtactaagtaaaaataatgagtaatatatatatatatatatatatatatatatatatatatatatatatatatgtatatatgtgtatgtatgtatgtatgtatgtatgtatgtatgtatgtatgtatgtatgtatgtatgtatggtaaatttgtttggtgtttcatggtgctcgggctccatgatttaaattgagtatatactcaattcaaatgagtatgaaatttttttaaatgtttaggtataacatttactaactagttcaaaacaagtttgaactgaatttaaacatgtttttgtcagattttaattctaggtatatagcatccaaacatataattagttaggtatgtaatattggattgtgaaataaagttaaatttgagttgttttgttgctaggtataggtatgaatcgaatacttataactaggtatatgctcacaatttaaaaattttaaaatatttgggcgaatttgtgtatttcattccatggtgcccgggcaccggcaccatggtgcctcatatgagtgtcctgtatgtatgtgtatacacacacacactcacgtaagttgatgtggtttatgataatttaaatttaaatagtatataaaatgattattgaaatgtaaaagtaagttgacgtgactttatgagaaaagaaaataagagagatagtttggatcatagattaatcatctaagggataaaaaatggaggtgatatgacttaataagaaaaaggagggagataatttggatcatagataattatctaataacaaaacaattgatgtgatttggcttaatgagagaagagagatcacattttaactaaattaggagttagaatgaacaatatagatacataagatattataaaaaatgataaagagacatattgaaatattatgtgaattatgtgagatgatgatttaatattcttgcattcgaaaagctataaaatttagtaaatttaaaattattataaataatataacatgcttgcacgatgtttaaatgtaatactctatccgttttaagttataagacgttttaactttggtcaatgtcaaactactctaagtttgaccaattttatagaaaaaaaagtagtaatatttttaactcaagaaaagtatattataaaaatctattcaattatagatttaatgaaattatgctggtgctgtaaatattactacatttttctatagagttagtcaaatttagagtagtttgactttgactaaagtcaaaacgtcttataatctgaaatagagggagtaattgttagtggatgataatgtggtatctttacatgttaagctttagaatttagtaggctctaactttaaagtaagagaagataagtcacaatcactatttttattattttataatataagacgcacatacatacatataattaactaccatatttgtctcctctttaattcattataaataaaccatccacacataaaatctagtcatattggacacctagggaaccggttttttcagatgcagctatttatggtccgcctgaaacctactagcctactgctcatccagaaatatcagcaattgtatttattggagtgatcatcatacgagaaggtgataatagtatttttttttctataccactaaagtatattgttcaaaataaacatatagagtagcataagatagaaaagagggattatctatacttttatcgataatttttctctatatcagatataaatactatacaaattatagtgtaattacacttatatatgtaactacaatacaataactttttttgtgtgcacgtgttgtgggtatctgcgtctatacgtgtttctagaaaaaaaaatacaataaactttaaaaatcatgctataacacattatttttgtgaatcacaggtcgcaggaccaaatactttcacccatgtacacgctgtgattttttcctttcccaattgtacaaatttggagcaaattaacctaacgtttcgaaattacgtaaaatttacatacaagttatattgcacttgctgcatgcagactataatgtaaatacaccgtaattttgttgtactcatatttgacaaatgttttatagaaatagaagaaaactgacaaaatttttcaagcctaacgttgtcaggcggctctcctgttgagaagcaattaatatcacgcataggaacagtgccgtacagtggaacaaaactttgcattgattatact

SEQ ID NO: 67131 - DNA, 8981 bp, Oryza sativa
cgtgcagcggctccatcgaccgccgttgctgaccctcctcaagctcttggacctctcccaacggatagtccaacattggttagaaaaactggattggagattcggaaattttctcagtggattctacatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacattgagctgtagtgcaaggtacccaacagcacaggtttgagatactatgtcaagataaggcaagcaggggtatctaccacaagagagtgaagcaggagtgtgttctcaaagctgacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccacaacgatatggacgagtcggaggctggcagggtgaagcgttgcagcaaatgcgatgaacatgggcacacctacaagcattgtcctaaagacaaggagaaaccaagtgcggcggaggcaggactattaggattagcagcagatggagctcgccctacgggtgaaggcactatcttcactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatgtcacgaccggaaataacccaacgggcgttccttacgtgcgtgtattattccttgtcccaggaggcaaggtacaccaaaagttgatacaattcagagttcacaagcggaagcgtaattaattaatttattacatgggcggcgaaggccccgcacaaaagaagacaaacgaaaaacagcggaagactagggcgacgaccacaggcacttgacggcaggcacgagctagacaccaaagccttcatcttccaggaactccttttctgagtttgggaaaaattgagcaatactgagtacaaccaccgtactcaacaagacacatccacaagtgcagaataaatgcaagggagtacaagggagccataatatagggggttaggatttgcagtaaacagcattaaaagacacttaattgctcaaagctattttgtaaacacggtcctagagctatacaatattattaatcaaggccgtgaacccacacgaacctgccttaacccaaggcctatgatgatccagaccgaactggcaacccgaccctgggtcccagctcgacccaagccaacccaggccaaccattccatattttagttgttaagcaggttttaagaattaaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccctgggacaggtaggcaggactgagcccctagcagcaggacaccggccctgtgccatgacatctcgactaccgggccgcagctcgtgtagcctttatttgtcctagagatgtccatcgacccctgacttcgtccatctccatccgtgtacttttgtttataaccagactgagccacaaactaagccttacccactagacatgtggaagtacggtagtgctttgcaacagaggcccaaagaccggtccttatatggccgaggtgctactatcaaaaccatgcaccccgagcccagcctaaaaccattttgagggttttgaatagagggggaggtgtgaatccaattccacaataatccaaccattccatagtgtccaggtgatatgaatatcccaaagtctagagttgtaaaaccacctaatgttacctaattaagcagcgaagcatctacctaaattcatactagtggtaccatgagtagagtgtccactagttggggttttgtttattctagggtgaacaaggaaataatagcaataacaataataaggtcataacaaaggtaaataggcatggctaggtaaaacagtgataacgcgggaatttaaataaagcgataatgcaataatttaaatcgaaataattttataaacggggattcaatatgttcaaggatgatgtgacttgccttgctcgctttcccaaacgtcggcttcaacctccacgaagagcggttcttccgaacctgcagcgtctacacgaccaatggaaaaataaaagggcttttactctaataaactccatataacaagcaggaaaaaagcacaaagatgggttcttgacttcttaaggaaaaattagagacttgaatggtccaattccgagttcaaatggccaagttatggccatttgaagtttatatgttctttaaatgaaatatttgcgaatttcttcatttaaattttaatttaaaaagggtttattgcgtcagccgagggggagcgggcgcgcggaccgggtccacgggagtggggcccacgcggcagcctcacggtccacggtggaccgggcgcacccgggctcgcaccggccggcgccgtgggccccacgcgtcagccgcacccgagggcgcgggcggctgacggccgggccccacgcggcagccactcggcgcgcccgagggcggccaagccggcgcagccggcgggaggcggcgcccgcgcccctatggtcgccggcggcggccataggcacggcggagcggtggccgagagaggggaagggaaggggaaaagaggcggcggtccacggctcaccctaggtcgtcggcgacgacgagaaaggcggccggagcggaggaaggcggcggcgtggctcggctcgacggggtcgacgacgttccggcggtcggcgagcgaaacggaggggtggacgaggtcggcgaggatgcggcggagccgaaggaggcgacgccgaggtcggaggtggtccggggcgacgaggcggcggaccggagctcggcggcgacggcggagagagagggcgacggcgcgagctcgaatccggcgaggaggatgggcggcgagaggcggaaacagacggaggaggtgcggggagggtttaaatagggttggaaggggagagagcggccggaggggaagaaaaccggcgcgggaggtccggccgccatcaatggcgccggcgagatttgcgggggcaaatccgcccgtttgaacgcgagagagagagggaaaaatggggggaaagggagaggggatcatagggagtaattctccccactttattgcacgcggggacggcgggatgcggcggattcggcggcgcttggcgcgggcgaggcggcgggagcggcgggaggaaggggatgacgggtgggccccacccgtcagcgagggtggcgggcgggcccgcccgtcagcggcgcgcgcgcagggattagccgagtgggccgcggggagaggagagagagggggagggggatgggccgggccggcccaagggagtgaagggggactttttagggtttttctgtttattatttgtgctctgaaaattccactaaaatttatttacgcattttaggcttttaggaaatatacaaaaatcctctaagccttatttgacttttaactttgcacattttaattgttggaggctttcacacggattttaattattctaggcatcatttagaggatatattttagggttgctttgggacgtgacgctacatatatgttaaattgcacgtcatcgttatgtaccattagtaacgtttgctatatttaaatagcctgtactcttgttgtacataattaatctcatgatttgattactatgtcataattttgcaagttatattttgttttacattactattttttgaattgttctaacacgaaacactatatttttcagagatggcacgtcaggatacacctcagttgttggacccggcgatagatcaccgacaccggtctcaccttactgtggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcgactggtggaggctgcggccggcgacgcggacccggccagacgatagactgtggacaggtccctcctagcagctttggtcgatcgatggaggccagagacgcgcacttttcacttgccgtgcggtgaggtagcccctaccctacaggacgctgttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagttggggttccgcgttgttggcggctctgtaccgtgcactttgtgagtcttgcacgaagacggatcccagcgcgacctttggtgggtgccctctctttctttctatctgggcagctgagaggattccgatcggccgccctgaggtggaccagcacgcgtaggaggagtcactgtacgaggagcgaccagaggtcgactaccctacgatgggtactctgtggtgccgtcgtcaggtacgttgcatcgatcttatcgtattgttaagttaattgctaagttcgttgtacatcacatcgatcgtctcgtattgcagcgccgatgggctcacgtccaggttaggcggtcgtatcctgagtttgttatggagttcgaccgccttctgccgactgacgtcgtgtgggagccctatagtgccgcggctacctaggctcgtgcgccgttgggtctgtccacactctgcaccagggaccaggcgtgctggatgactatggttccgatggtcttcgacatctgcgttgagcctcacgcccctttccgcgtgatgcggcagttcggcttccgtcagccctttccagtaccgtttccgaccaccgtcccagctgctgttcaccggtaagatcttgcactacactttccgttgttgcattaaaatctgcctgttcataataatttgtaacatctgtcgtttcacactaatattacacattaattcgcaggtactcgcgcaagggtcagcagtcagctggcgactggcccgccaagttggcaacttttgttgaggactggttgctcgcaaccgaggaggtcgtggaccacgagggagagccacacactgaggagtcatactacgtctacctacgctggtaccagccacgcacccgtactagggtcaccttcgctcccttggagcagcagccccacgttgcgagcactagaatcctctatgccaggcaccgcgaccaggacttcgctcgtgctgtgagtaccctgcatcgcaccattcctttatgttttcatgtctttctcttcgtcaaattttacgaatttttacgaacaaattaaccatgtaggtcgacgacatcaaccgggtcgtcgttgacggttcaacgacgatacaacgtttaggcgcggggattccggtacccgtagaggagcacctgaccacgtacacgcggatggtggagtcgatgcgctcgattctccgagtgctcacctgtcgtgcagacgacgttgctcgggcagacgcagctgtacagcggccacccgtaccgactagtccccgtccagctgcgcacgttcctaggccgactcccccactgcacggaggtaagtatttttattactatttatgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttagaagggtcccgttgtcgatgtgtaggttttgcccagttcgctatgacgcaggccgcccacttctcccaggctgcagggtcagcgtctcaggcagctgtgtcgacctcgcactcagcgcagttctggcagtacactgggacttcgtcacaagcagccggcacgtcgagtcagggtccaccactggaccatgctgggacctcgtcggaccgcttgctgccttccaccttgctcttcgacatcactgacttcgacttcgcttcaggctcgacagaggacgtctttggcccctcacagctgggaggcgcaccgccgttgcagacacaggaccagacgcaggccactcctccgcgggacactcatgctacccgtgctgtgccaccggatcgtttcacctactcccaggaccacgtgcgagcacaggcccggaggaccaagcgtggtcgcagcgcggggcagggccagtagagcagtcttctgtttgtttacttgcttcactttccagtactgtatgcttgtgtaatgactacgttgttgttatatgtgcacgatacctttcggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgttcgcatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggggtgttgaggatccaaactggtgtagcgatccttgtgtatacctactaccaccttggtgccagcgtcctctctgcctatgcggtgatcgatgccaactaatggcttcgaggaatcctgatattcgaggaaggcgcttttttaggtgccctatctatgaccgtgaggtattttattatctgcatatgcttattcattccgtatgggcaatcgctttattcttcgtaacactactctattcggcagacccgcactacggcttgcgcatacattgagtgggtcaatatagaaaatcccattctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaaggattctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcaggttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcaactgggtcccttgc

SEQ ID NO: 67132 - DNA, 2311 bp, Oryza sativa
ataaaaccttttcaactttgcttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattatttcttttagagaatgatttttatttcgggatgaatttatcaggacgtgacagtcaccaccgtcctcgtccgccccttcgccgtcgttgttgtccgccggagcaccgtcgccgtcgtcaagccgaagagcgccgccgcttcttcctcatcgccgtcgtcgtccgttgttcttccgccgccgttttggtcaccggtgagttcgccgcgtcgtcctctacgtgctggtgccctccgttcgtgctgaagcaccaccgttcgccgtcgagcgtgtgagcccgagccgccgccggtaggtgacgtcatcgccgacgtcatcggggccgttcgctgtgagccggtcgtgcaccaatcgatctcggccgtccgttttggatggattgatctcggccgtccgttcttgtgaaccgccgccgtgcgcccggtccaccgcaaaccctagccgctgacgcaataaatctccttttccttttcaaaaataattcattgttgcgtcataattcaattaaaatccatataagtgttttaatccgatttaatcttcaaaaattcataactaattcatcttagctcggatttagttggttcaagtctctaaatttttctaaaattgagatctacatgttaaaaatatccatactgttcatgtttgtttatgtgctgttttggtgtttttgctcttttctgtttagactccgacgtttccggagagtccgttttcgcaggagaagaatttgaagagttccaaggccagcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataattggactaattgagctttatatatattggttcagctagatattagatataattgcttagtcatgcttagaaacattagcacactattgggataacttatgactcactattatttaatgatggcttaatgatagttcacgatggtcaatcgtgattggttaattaattacttgccaactaaaacttgataatggtgggttgtgggcacatggttttgagagttgtgctcatgacaattaagtaccggttcacgagtttcggttgtgaaacattaatcgtgccaaccacaagccagcgtgggcaacggctttaccttttgtatagcatggtttattgcgggacaccagactgagaagtgacggagataagcccacgggggtcgctggggagtccatgccttgtttataagggggtgattatgatccaggaatggtgcgctgtggtggattgtgttatgcaaggggtattgtcatagctcctttccgaggtaccgtggtggtattgcgacacatggtgacatgatgtggggctgtgtcttgtgggtacagtggtacacctctaatcagagtaaaactattcgaatagccgtgcccgcggttatgggcgagtcgaacaatgtttttcgtgattagtctcacacctctcatcataattatggatgctataactggtaataatttgcttagctcctggtttggaatggataattcctggtttggagattagatctgtacagccgggtatggttgttcaggatggtcgggcttgtgcagcatgggtgtgctgttcagtgttgattaaaatttctgattaactactctactgttttatttcacttaaatatttggctaaacgttgcttttgcaaatgagcctatattatgccattctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggacttaatgcctcttaagtaagtatttatcgttttagtaaatttgatgaatctgtatattaaattgtcaatttgtgtacctcgactgattggggtgc

SEQ ID NO: 67133 - DNA, 5126 bp, Oryza sativa
tggcatgagaagtttgacaccacgcttacagctgcaggctttgttgtgaacgaagctgacaaatgtgtatactatcgctatggtgggggagaaggggtgatcttgtgcttgtatgtcgatgacatactgatctttgggaccagtcttaatgtgattgaggaggtcaaagactatctgtccaagagttttgaaatgaaggatttgggagaggctgatgttattcttaacatcaaattacaaagaggagatgagggtgggattacacttgtgcaatcccactacgtggacaaggttttgagtcgctttggatatagtgactgcaagccagctcctactccttatgatcccagcgtgctattaaggaaaaatcgaagaatagcaagggatcaactgagatactctcaaatcattggttcattgatgtacttggctagcgcaacgaggcctgacatctcatttgctgtaagcaagctgagctggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagaccagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcatttccatgatgtgcttctcttctttcctgcatggtaggatggcttatgtcttaatgtgatccgagtggcttttccaagcagagatgttgacctgcagaacatctcagaaggaacacacctatatgagtttgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaatttataataattaaatctcaaaggcccataataaatgttgaggataataataccacctcaggatttaagcgagaaatatctcaacctaaatagggagttattagaggctccctgttgaccagttgaggtaggggtcggaatgccacacgcgcgcgcgcgcgccgggccgggccgtgggcgtgggcgatggcgagggcaaggcgaggcgtggcgtggctggctggcggtgtgcgtgcgtcacgtcacaatccttttgcagccactaacccacgttcccacgattccctccgcaacagcgcgtccacgttctttctcctgatagataaggaggccgcgagtccgatccgacttcttagcttttttcccggtgttagtttctccttctccgcgcctgagttgctctcgcttccccgcttctgatctcttgcgcgcacgagagattggaagaagcagtgcctccgaaaccacacctttgcctgagatctgcaccgggtaggcgggagatcaggtttttggggagtgcctcctgcacgactgctcatcgccatgtctggagttgctgctgccgccgctaccggtggaggtggtacgccgccgccgacaggagctggtgcgccgccgccgacaggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctgttctacatgatgcctctagcatgttatcgcgttactggtatgttcctgtttctgacattcatgatgcgcatagtatgctactggttatgttaagatcaccctacactgcttatgccatgatcattgtttcaatttcttggattaaaatatgccgaataatgactatatttccaacacaacctagttcatctgcataccgcttcgcttcttctttctcccatgtgtcctgttcatcttcttcccagcgccgagcacatgtcgccatgaactccaagacgccggctgatgcttgaggatacctagttgatattttttttgcaaaaattggaggataggctagagcctgatggagcctacctgctagaatcgccactggccgtcacctttagggtttgggttttgcttattctgtcaagaacagtttcgccgctagatcggtttgtaaggcccgaacttgtgagcttaatcattcatctgcaattttggttgtattcttctttgttcctatttgtgttctttgattcgcaaatagggattagccttctcggcaaggtcgtccgcgtttcaacacgggtgataaccagaggagacatggtgctgcgattgcagggctcaagagcgtgttcgttcaagaagccgaatcgatttgtgtcgcgactccacccaaatcattgattatcagaaccttccgaaagatcgaaccctagtccacgtcactttccacgcaaatagaacaattgtgctattggaatagcgatagcagaactacaatccgcatagttcagaaattcaagtgcataaggaaagatgtaatctcaccatttgtgagcacatagttagaaaataaaacttttcttgctttacccgcatgcaggccagtcatttgttatcagaatagaatgcatcaagaattcgacatacataacatgtataagaataagtgattaatagcctgtaacatgaaatatacgatgatacccagttgcccattgcagataccaaaacacataccccatggcagcttgtttaatataactgatttccaacgagacagacaaacacaagaaaatctttgttagcaatactaatggacgtgcagtgaaatagagggatttgcagtcttcaagcaggtaagagtgtggggtgcagtttgcttcaatccacattatgctacttgcaagattgcctaagaagaattcagactacatgctgaaaataataactcactgattcatcaggtcaatacattaaaatactgatggatcattaagtctacataactagctaataaataaaaatatgtgggcactgtctataattagattcatcacattgacccgcatgattagataccttcaatctcaacagtcatgcatacgcagggattacctaatctgcataataataagacctcgcatcaagtactggggcaaaccgcgcattgaggaattctaagggttacaggactgggccgcaccggtgtcatgccatgcggcagggagcagaaaacagtgtcttgctagttgctagttactagcttctcgccggtcatccattgttagaagtgcagaagctctgaaatcttacgaaatgaacttggttgatgctaagaagatcactttccctttccttgatccaaaatctcccttttttggttctctgcaagttgcacaagaatcaatcaccgagttgaatctgagcaaacaacgaatcaaatagcccgaagcacatgcccaggcatctagggccaacgccattcgtagatgaagctccagacgttgagcatgacggagagatgaaggtgatgcctatctagagaaagacatacctcggcccggccagcacactgagctcatttgatgttgggaggccgttggattgacctgtggcggaggcaatgagagaggcgacgagtgaggtgatgaggaaggcgacgagggaggcgatcccctcgcatggttggccggcgaggtacacgcacgccgatgtgcttacgccggtggcgagagctccctctggtgatagagccccctccggtgatacggtggggagcacagttcgccgtgaggggaaggaaccgatggaggagtctcgggttcgtgatggggaggggacgtcatcgccttcgttttccggcgatcgccgacttcggaggtcgtcggagtgctccgcgggaggtttccttctgaagagatggctaggccttcgacacatggggttctagctgggatggtttgggctagcccagcacacatgcatgacgtcatcaatggcggcagcccaacatctacagtacagcctaatactgttggagcccatgcggagagttcgagagctattgggaaacctgacttttccccaagtttatcccctcggtagagcagtggatttgggtgaagcaaggagaggtgcaaccaaagctagggttccctgcgagaggtgaggaagtccggtgatttggtagtggtgctcgccggatctggagagttccagagcgcaagcgcgaccatcgttcatacacagaggtggtgatggacaagcgccctccaaattcggccggagtggcaagtcaacaagcgaagggtgacggatccgattagaggtggagattaggggaaccgtgatgcgcgcgaagaggatgagcttcgacgccaacttctcgctcaaaatccaacggggaatctaggtg

SEQ ID NO: 67134 - DNA, 14116 bp, Oryza sativa
  unsure (1)..(14116): unsure at all n locations
tccagctcctcaagaagatgcttccgcaggctctgaaacaaacaagttgcaaggaaaataattcaatttgtattactaagtaagttcaaatgaaagacgatgtcaatttttcatctgaatacaggaaataattaaatagtaatgtaaaaggttgtaaaagatgaatgcctgtaaccaaacaccatataagaaaatagcagatgtttaacttggagaaatcaatcatggatcaaattatagtttaaaatacaaactaacaatgttgatactccctactacattgattcttatatggcatattttaatttcaaaaaggccaaactttgtagattttgatcaatgattagacaaattaaaggaaccatttagttagtgtataaaaagtatatcaatagctttgtactttaaagtgatctcacatactattggatttattactattatgagtataatttataagaaatcaatagacgaagttaatgttgaagacttcttcaaattaaaatacagcatataaaaatcaatggaggtagtttataaaacgtatccatgacacagactaatgcagatcacaactatatgcacctcataaaaaaaatatcaaaaggctaaaaaaaatctgggcctaacagttatacatctatcaataaatgctatagaagtattggatgagaatttccatctatttgtttcaatgaggaccatcaacttatacagctagatgtaccagtgataggaatctgtctagctagtacaacaaactttgtccccacaattcgcctaaaattaattagagcatattgttggaagtcaatgagagcaatacaataagcaaaatgtgtacttaataactgactagctagacagaagatactagaccataaccaatttcactgggttaaaagggattagtatatgctcctggatacggtttggatgagaatgtttgaaatgagataagcaaggctcttgctgattcttttcattcaagtgtcattgattcccttgaaactacatttaaaccttcttatctaaaaatcaacataagactaataacacgaacaataacaccccttagggcggggggagcggcaattgcagtttggatcaagagtttccctttgaacagatctaaatctctacttagcaactgccagggaatacctaaatctctacttagcacctagaatcaaaatagcacatgctatgtcagcattaaccaattgtaacataccttgaaagcatcggtcttgcccttagtgacctggttctttgcgatgcagctgttgagcacgtctcgggtgaactcgtcaggattcttcccgtcatcgatcaaactagcaaaacaggcaccaatccaatccaatccaatccaagtcatacacccagaaccagggggcgaaaggggtactgagatggaaatcgaaccaactcacttgacgacctccatggggacctggatgttgcatccctcggcgtgcttctgcatcgtgtcgagctccgccaccagcgagttcctgcggcaaacgagacaatcaccaaccaaaccctaagatttctccacccactcacacccgcacaggaagggggagagggggatttgctgggagaatctcacaggcgctggaggaggggtagctgggaggcggagctgaaggaggagacgttgaggttgagctggtggaggagccccagcgtcctctggatcgaggccatcatcagcgccaggttctgcttcgacgcgtcctccgccctctcgcccccgccccccgcntgcacgccgttccccgccgccgctgccgccgcggcgactccagatgcgttcgtggccgcgccgccgtccattccgccgcgatcggagaagacgagagagagagagagagagagagagagaagagagaccgagacttgacgtgtcggcccaatatatcagcggcctattgctgggctgacgtggacgtaacaccatcacgggctcttcccgaagcgcatgggccgcaactccctaattcgggcccagtttaactgggccgtgctgtcctaggccgagaagcatcggaagtttttctttttctttttctttttcttttcttgctatatgctacttcctccgttccataatgaactttctagcattgcacatattcatataaacttacattatgagaaaagtactaaaatttagggatgcaagtgggtagtcccgctatccgtataaaaacccgcttgctagttcatttcccatatagtagtataaaatttagaagaaaaaaataaactagaagaagcgggctaaaaaaacctatttgcccgtcccgcttgtatccctattacatacaaaagttggaaatattattagccatgcaaaggtaaaaatggagattgattggttggtgcgtgtcccaccatcatcaaatcataggttgataaccagtccatgtacagtgcacatacgcttcctcgtcggtattcatacgtgttacatatgacaaacaaacgagataacgagataagcgtcgtcactcggtcgctagctagctagatagcttaacttgctttgtttggaggcccgtctccatcatatccatccaatctgatctcatggccgctagctgcagggtgagtccgcagtgtgagtgatcagctgactcgatcgatgtgcatgcatggtgcatgcgaccggtgcaacgtaccgtacgttgcgtaccctgccctcccctgccggtatacgtgttgtgccactgccacgtcagtgacaacagtctcatcgtttggtcaacagctgatgactcataggaaaataaacaaaacaatagaataaataaagctttatttgtgttcttgatgagttaaaagtggatggtgaaaaataaaccatcgttaagaaaagaaattcaaaaaaccagctcaattaagttttagaacacacataaaactaatttgattgtggcttataagctaacaatcaaacaattgggctgcgagttttgggacgacgccgtacgtcgtgtaccatacaggtcatgtcatcagcaagagctggccaaagttgaggacgccgactcgcaaaccgatcgtccaagctaattattaagctagctaatcgatcgatcagtcgaccgatcgagagatcgccgtgtgattgcttacgtgcatggtccctgcagctagctaactagctagcaaaaacgtacaaaaagatcccatgaaaactaccatgtaccgacgacacgtacgttaacgttacgccgtggcatgggcatcagggcatgcaactaggtactagctcgatatctcagctgttggcgagctagttgtgcatttacacttaggacttatttaagagcttctaactactaaacaaaaaattggaaaacctagtttttttttaaaaaaaattagaaactaactatcaacgccgccagttactcctcagaatcttgagctctcgaaataagcccttaaacagctagctagctgagcacaagaacgacaaggccggccagccggctccctgtcgccgctttgtccgagtggccggccggcgagcgaaaggggcttgcgcgcattggattaactacgattatattccgacgattttagcaaggaaaagaacatcagcaaggtaacaaatttgcaaagatattcgcttctcgatcgagatctgtccggcaatcagctggctggccgatcgagacgatagctagctatagcgcagatcgccgtcagtccaaaccaccggccgtcacccgcacccacccgcggcgccacctttataccgcgattcgatgcgatgcgatgagatgagagatgcttcgatctctctctcccctcgccggcgcacccagcgttccgggcactgacccgccgcccaatcggctgcgatattcgccgtgcacctccgctcacggttgctagctagctttgtaccacccttacccgtgccgcccattgcatcatcgatcagtacgtacacaaaaaaccggaataagttcgtaccgcgtacgggcccggcgatcggtacatgcatatgcgcgctgctagtggatcgccgtcgtcgtcggcggcgtccgcctcgtacgtccacttggccaccgtgctggtgatcgatcgatcgccggatcggaggcaggggtatatgcgtagaggtaggcatctcgtcagacacaagtagcttgacccgtgtggcgttcatggcggggccccggggttggatctgataagatccaccgtgccacagccggcgaatcagccagctatagctaccctcgccggcctctgcatcgcattcgctcgtggctacacgtgcggctgcggcctgcgctgcggcacaatatctggaacaaaccggccactcgcgtgctccgccgggcgccaataataatgcaaaatcacctcgatctttacttgcacccggagccccgcactagtggagaaaccatctttggtcgctagaccaaattccacaataatactggttccattaaaaaccgggactaaagatgatttttagtccggttcatcccctgtcagatgtatgtcaggggccgaggatctttagtagattaccactttagtccgggactaaagattgatctttagttccggttggagttatcaaccgggagtaaatatttctctcccacatctgatcggttaagtcccagacagatatttagataagattggatcatcccatctcttcctcttctcgatccaatccccttcctcctcccctcccccctcttcctccccccttcctcttctcctcctcccctctcctccctcccataagccggcccttcctcctcctcccctctactccctcttccatcagccggccggcggcgggcggtggcagcgcggccgcgcggggtaggatggcggcaggctgcgagcggtggccggctcgtttgtttttttatatataatttgtgtttcactatatgtatatttttttagattttgtgattcattgcatcgcatggatctgacatgtataatctgtgatgtatttaatttatgtgtagttttttaggatttatgatgtatttgatatgtgtgtaggatttgtgatgtatttgatctgtgtgtatgagtaacttaatatttaggatgttgatttgggatatgcatcccactcgatttgggaaaaatatagggattaactctagccattagcaaatcaacaatgaaaaaaaaagacctcaagggattgccgctacccctcttcagggactaaagattacccctctttactccaaccgggactacctggattcgtagtcccggttgaaaaaccgagggttctaaaccgggagtaaaaaatatttctccaccagtgccggacggcggatcacagtgatcggcatcaagaattaccatatccacgtattaattccagcgtccaaaattaccaaagccactcaaaagaattagttataattactatacctccatattaaaacataaagatttttggaagtagttatataatattcgatagttttttgaatgaaaaactttcaactgcaactactatataattacaattacaatgtagttgtaggagtaccatgtaactacaatataagctatctgtgactcaaatgtaacttggaagaatttgatggagcgattggttatttcaatgagcatgtagtctgtaggtctcgggttcaattcttgtagtgagcgtgtggttttttttttccattttttccaccacagcacaaagctcaaagcatatcggacggtttaaagtttgctgcaggtctcgggttcaattcttgccgtgagcgtgtggttttttttttcattttttcctccacagcacaaagctcaaagctaagcatatcggacggtttaaaatttgacagttttcacccctgaaaactgtggtgaaaactgtcgacagtaggatagcaaatccgtttttagattgtacaaagatatttttaaaatatgtataattaggggcagactcacacctcagatcactcgggccatggcccgaagactgcccattaattatgatggatatattttcaccatgtaatcattatgcataggctaattaattatgtggatatattttcaccatgtaatcattatgcataggctaatgtgccttaccaattttttggcaacttaaatagtacatgtgtttggattgagcacaaccaattggtagtgcccatgttttatttggccaaattatagaagtttttcactacgataccaaaatttggcttcatattgatcccaatcgaaacaagaaccatataactttaccttaacgaaatattagtagtgctaaaatttgcctagattttggcactagtaataaattgttagggtaggatccaaacatgcccttaactcttttataggctagccctgaccatggaccaatcctagatcacttcctaggtggaactaaatgaaaaagttatgatttgttaagaacataagtagatagagaagttatattttggtataaattttaggaactgcctatatgacttttgacatgaaaaaccccctcaaatgttgtaaattttgaactattggatcactttaagatttgtgcaacatagccaaaaccttttctttctccttcccttcctcagtcccgcttgcacatgcgcatgcacactcctcctgcgccggctgcagcccggtctcatcggatggtcggaattggttaacaataccaagtcctctctctccggccggcctccccccttctctttcgcaaagctatggtgcccccacccaaggtcttacccgtctctagccgccggatccttcatcaccagtcgttgcctcctctacagtctcgttgtttgcccccgtcttcaacgccggcccactgcccactgccaacccccatggctccaacgtcgttggcccgtgtccaccacccatcataggtcctctgctgtctatggcgatccctctgaaccccaaggaaatccttcctcttccccatctcccaacgctcctacccaacctaatcttaaacccaaaccctaatcttgtctcctctgtcagagttgggaaatatcgtcggggccggaaagagggggagctcactaaagtcggaggataaaaagcttagccacaaaaatttagtgcggatcggatggtccaaaatctataagattttatttctaaatttttatcgaatgatatgtagcaaatatgtaaattttaaatgctggaggtccggatggagcgagtacgagcttgattagtaggggtggtcccactgcacagttgatgagcctaacccaatgactaggatggtatctatagtattaaataagttgccatctaaaatgaaaaatgatatggcaagtgaataaatgaggaaagagaaggaaaccatgtcttgcatgagacatggtttctacacaacatctaagacatcatgtggaataagtagcattaaattaaagtatggaatagttgtgtttgcattggaagagtagtgtctagcactagtttcttgatgatgtggagtttatggaaactatgtctagtgtcatgtgttgggaatgacctaccattctcaatccaatgactaggatggtgtccatatcattaaataaactgtcacctagaatgaaaaatgatatggcaagtgaataaataaggaaagagaaataaaccatgtcttgcatgagacatgatttctacacaacatccaagacatcatgtgagataagtagcattaaatttaagtatggaatagtgatgcttgcattgaaatagtagtgtctagtagtactagtttcatgatgatgtgaaatttatgaaaattatgtgtagtgttatttaatgaggagttacaaaatcttttcttgtaatagatcttaacctctggtagataacctagaaatggttatattatttgtggatggaaggagtacaatacaaggttagcatcaggatttgccaggtatgtgaaaagagagagctgatgatccaaatcaaaaaacttaattaacttactccccggaattaatcagctgatggatcatcatcactcatgctccttttagtttcttttgaggaaggcatcactcatgctgtcatccaatattggttgctgtttcttgctaatatgaacaaaacagtcgctatattatatatgctcgtaaaatattgatgcgttgtgagtagaacgcaaagaaaaaacaataggaatcgataaggactcaaacacttatctaattgtaagcgtcttaaaaaaccgcactgttcttttcgtccctcgtatgcactagtaggattcagaacttcagatatatttaatcatgctctcatccctcgagctagaataatatacaatgatgaaaactaacttgtgcttgacatagacagagaatgcagaattttcagatcaaacttactgtaccatacaagattagccactcacagctcatcgatgcaataattgattctagtttatagcttaacacctgatttgtttatggtaaacatggatgttttcctgcaatggaagcaatcagtgtcgatcaagcaagattgccacaacaagatggcaggaacggaaagagcatatctaaggaagaatcttgatttagtcactcctcttcagattaaaatagagttggtccatccatatccacaagccttggaggtgttgttcacccgttctgcattttttttttcgcgaaacctgttctgtattttgcatgtccctctcttgaccacatataactgaagaacgttgcttaattatttcagttaaacatgtagtcaggcaagagcacattatgttattgagtaagtgagtcacctagttgacttgccacgagtcattttcatgtgtttttaagaaatggacataatggtacaattaggggtgcatagggaaattaactaatcagctatacatactaattagtatagtaacaaagcaagcctttggcgtccacaggagactaacagaatctagctagcaacagatcagatattatctatattggttgaagcagctcttgtctgagagcatgtcactgcgtcacatactcgcatgtattgtcgatcgatcgattgcaagaagccaagaactggtaaaaacggagtagaaatgaatgcctgactacagcctgagtaaccccctatttgtcccagctgtttggtgtgtgatactatatgtgtacttgaaagttctatctttccaagaattaatgaagctgcgaataccactgaccacataacgatctgataattaccttgctgggcactttgcctgttctgttcatgctgcaccataactgaaaagatatcacacaaaagcagcagaagaatgttatgacagtgctgagtgcttgcctcacaaactcgtcacccttacgatcgaaatcatgagctaattaaaacaagtccagcgacaaagcatgttgatctctactattattcttaatttggtactagtacaaaatgtgacgtataattttcctgaaccatatatgtatgcaacaataatctaattaacacgcgactgcaattccccctccccgggttcgtatcctctgcatttgggaccaaaggcaaagtttgccgttggttccatccaggacatccatacgtcaatcaacggttccatagtttagcagttagcacccttttagtgactaattagcagctaattaactaatagagttgttctctcttaaaaaaaaatcaaggaaatgatctccagcggtaaatcaaatacaactaatacctgccttgccttttggaaccaactcaaaaaataagataaaatcaagaagcaaacaatctcaggacaagaaaaatcctttatttatacagtagtaaaataattatgccacgtccgtatgaaacatctagcaattctaatgctaaaatcctcccaaaaaataaacatttattttgaaaaaactaatctgtctttattgtacaagagtattttatcataagaaaattaatagacagaaccgatcttgttaattaattggactaatatatagaaattattatattatattaattaattagctgttaatcatctttgaggtgctaaaccatgctaccgttcattgaagtacggatggtctggatggaacaacggcgaaccttgcctttcatcccaaaggcaagacgatactgaccccccagtattctttttagttcaaattttgtagaataatataaatattcgtagggaactgatcctaatgaacagaaattcatccatttaggcaatcatatcctcgagggggtaatctaaacaaatttaaaattggactactagtgtgtgttaatcttagtatttactactccctccatcccataatataagagattttaaatttttcttacaatgtttgatcactcgtcttattcaagaaatttgtgcaaatataaaaaacgaaaagttatgcttaaagtattttagataataaagtaaatcaaaaaaaataaataataattcctaaattttttgaataagacgaatggtcaaacagtgcaaacagaaacgcaaaataccttatattatgggacggagggagtaaataacttgcatatgttcgtatccatgggacggacatgcatgataggtgcacacttaagtacctgacttggatcgagttgttttatgcatcaaccttgcattatttgaggaaacttttttcataccttaatgcaatatcctcttatttttacatgcatttaatattttttagaaacatagtataaacacaaatacttacaatgcgcgcacattcaccctatgaacctatgagggccttcattgataaagtcgacacggacgcctcactatcgatgggtacgttgcctaccacggaaagaataattagctatcaacgcgagcagccatgtcaaatctataatttaaaccagatgagctagttccacaacaagaaacctacccagttgagttacactcacttcgctatatgcacctaaattgttattaattttttttaaaaaaaatgacatgatatattaatataagatatttcatgtcacaaacgtaccaatttaaaatcaatatatacaaatagaaataaaaaaacaataaatttgaatgtgaacagtgcgtaccattcgcaacgatatttattatttttttataattgtctaagttaaatttaaatttacatatttgtgaagtctatcttgttaatattttaatttttatcacttttaaagtgataagtacaaaacaagggaatatcctcatggaatggatatatgtctcccatcactgtagtgatatttggcatggtgagttggtgacatttctagccattcgatatttatttagtaggagtaatcacaaagtttgtttaatggtgtcgctaaatgcgtgacgcggtactaatatatagaatgacattatgttgcatcagctgggactccctgcccctgccctgataacctgatccgtatatctgatcattatctgaagatgtctagctgcagctatgcacacggaagaacttgcgtagactttcacaatcttcagctcctcagacaacctggattttcctatggatttcgaaaatcaatagctatagtatttaaaaattgaactaaaaactagaaacggaaaaacttctcacccgctaactactcatctcttaacaatgaatcctctaattcctgtttggcacaattccagctccagctccacctccatcctctactagaaaaaaaacacttttaccgacgttaggtatttattttcgcaggcggacatgaccctcggagccaaatagccgcctacagaaatacaaaccggggtgaagctcgttgtccgcctgcgaaaatagacttggaatataaatagagccaacctatagggcctattttttttcaaagtcctcattctccctcattcctctcccgcgttgtaatatcccggcctagggcttaatagaattaatagaatattcatatcaacaagttacaacttcttttccggaagccgatctcgaaagaactttgaacttgtgttggtttgtgagggtagtttatgacctatgaaagctgatagatgtaagcggacccgacctggaagaggcgggacgttacaagtggtatcagagccgactctcgcggttacacaggcgcgtgtgtcgcagttgcacaggcatggggctcatggctggtgtggactcggagtggtcatacagcatggcacatgcgctggcactggatgcacggacgtacgttacaagtggtatcagagccgactctcatggttacacgggcgcgtgtgtcgcagttgcgcaggcatagggcgcatggctggtgtggactcggagtggtcacacagtatggcacatgcgctggcactggatgcactgacgtagtcaagaggggacgttcctagcctggggttgaccgacgaggacgtcggtgtcttaagagggtgaggatgtaacatcccgccctagggcttgatagtattaatagaatactcatatcaacaagttgcaacttctttttcggaagcccatctcgaaagaactctaaggttaagcgtgtttggcttggagcaatttcaggatgggtgaccgatcgggaaattcttcctgagagtgcgcagaaaagacttgtgttggtttgtgagggtagtctatgacctatgaaggctgccagatgtaagcggccccagcctgggagaggcgggacattacacgcaccctccccttccccctcccctccacgacgttgggcggcggcggcgcggctcccctcccctcccggatccggccaggggagggcggcggtggcggcattgtttgtccagaggattttcgcaggcgggtgactaggccacctgcgaaaatttatatatgggtgacgggagcctgcgaaaatgatttttggttgcctgaaaaaaatgatttttctagtagtgatctctcctgaagctggagttcaatcaaacagttttagctccacctaaaatgggagcggaactgggtggagttctctcacaaaatgaactagagaggtggagctaggtttagacagctcaacaacttcactcgagacccaactcctgtagttatttagaagttggagctctacaaggccctagggtatgtttggcacggctccaactcgagttttagagctcagccaaacagttctagctccacctaaaataggagtgaagctgggtgaagcgttctcacaaaataaagtagaaatgtggagttgtgtttagggtgttctccaactccactccaaatccaatttgtgagctaaatttaggagttggagctgtaccaagggcatgtttgatacagctccaactactaaatataactccaggagttgagtctggaatggagttatggagctgcataaacccagctccacaactccagtatattttgtgagagctccacccaattccactcctagttttggtgaagctgaaactgtttagctgagctccagctccggaaggggtggagctggagctagagctatgccaaacagaccccaaatactactactagctgcttttaaaaatctcaaaactcttcaaacagcgccgttgcggcatttgccagaggacttcatgaagcacacgatcgaacgagcgacaaattaaacaagggatacggaggaagaggtcgatccgccgatgccgttgcattggttggtgagcagcatcatgcgcgcgcccacgcccgcacgcgcacgagccccgcgtgagcgacgcagcgacggcgcgtgccgggctagctgtgggcgagcgcgcgccgagccgaccagccgcgccccgcggcgcgagcaccatgctccgcgcctacctagtattccgatcgtagacaattacacaggccgacgcgacgctagcctctgcacatgcatgggcgcgcacgcctagctgccaaccggcgcatccgtgcatggtaataacgtgcacccaacgccgcctcgcccccgtgcccctctccggcacccctaccaccaccgatcgtgtacgtgtcaccgccgcttccctctatcccaagtccttacgcgtgcccccccactatcgcgcgcgccgtttcaccccctcaaa

SEQ ID NO: 67135 - DNA, 13049 bp, Oryza sativa
acgaaatcgggagcgcctcggccacatccgtctctcccgagcccctataaagcatgcccgcactcccctccaccttttttctttttccaccgctctctcccgtgccctccattgctcccgcgccgtgcgcccatccgccgccgcctctcccgctactccggccgcctctacacttgccgccgcaccgcgccgtcggcgccgttgggttcgcgcggccgaggtccaccccgttcacccctcctccgtcgaggttcgtcgccggagccctcaccccctcgcactctggtgagcaccatctctaccgccgccttcggccatggtttccgcccgccgtggaccacccctctccctctaatctctctcttttcctttcttagggcatctcggagctcgtccgcccgccgacgtcgtcctcccgtggctcatcgtcgacggtcgccgccgtcccattcggtgaggactcccacccctttcctttccttcccccgatcccccgtgcgtcgccgtcgcccgcgctcgccgtcgccttcggtcgctgccgccatccgttgccgccgtttccgcgtcgttttgcgccgtcgccccgccgccggatgcgccgccggcaacgcattcgcgcgcgcgccgtcgccgcggccggtcggccggccttgagccaagccgagccgggtgccgccgccccttttctttccccccgccgctgaccagtgggccccgcgtgccggcgcccttcctctctctcccgagccgctgactggtgggccccgcatgtcagcgccgcttccccgtgctgatgtcagccctggaaaatattgcgcaataaattatttaagaatttttgttatagtaataaacacagtgaatcttctaaaattcataactaattcatccgagctccgtttaagcccattcaagtctcagtaaatcaagaataatgtgtagaatccattaaaaatggttttgttccctgtttcagtagtcttatagcctgtttgcattgtttgctttgtatgtcgctagattccgactcctccgacgctccggtgtacttcgaaatagtcgctgaggttcctccagcagcagagcaaggcaagtcatgcttgtcacttgaacatgttgatcctatattgcaaatgctctattgttttctttcaaatattgcattgttttataatattactatgggatggttacctattgttacagctatgctttttggataccatgctcctttgttagcttggggttacaacatgattagagtttggactaggaattgcttagccatgcttagttcaactagttcacaatggggaaaatcctattaatgtttagactgttggttctaatggttttgttggattagtgccaccgctttggtgttggttaattaaaataaatcacatggtgggctgtgggtgcatggttttgctggtcgcacccatggcagttaaggaccggttcgcgggatgccctgaaagaacttatcgtacttaccacaagccagcgtgggcaacggctgggcttgtagtgtagctctcatctagtcgacgcatccaggcaagggtgggcgtgatggagcggggcgggccctgcgacggcctctgtcgtttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgtacggaaacgtatcgtggggctgtgtcttgtgggtacagttgtacacctctgatcagagtaaaactattcgaatagccgtgcccgcggttatgggcggtcaaccagattcaccgtgattagtctcaccctagtgtaatcttttgaaattggatagtttaggtggatggttgggcctgtcgcaacgtgggttagcgttgggcagtggatagttgatattaattaattattacaacggtttaatctttcaacttctgtttataaatgctcgctttatgcaaatgaactgctctagctcttctttgataattccctgcatcatacccctattccggtatgacttgctgagtacagtgggtagtactcagtcttgctctacttttcccaaccccagagttcgagttcgggtcagatgaaggtttctctgaggagtaggcttcgtgcgtgccgtcgaggatgcctgtggagtggtgttcccgctgcagtttagtcaaggcttagctcctgttgtctttcttttcttccgttgcatttatgtaagacttttatgatgtttgtaagacatggatctgaatgtcaacattgtcgtttgtgtaccccggctggtcctggacggggaatttaatgcacattctgcttgaaattctattcgggaatttctaggcgtgacaccgtatgcccgttgggtacaggttttgacctaataaaaaacccatgggtactaaatggagaataaacctaattctattagggtttttacccatgggtaaataggcaaacatgtcaaattgccatccctaattgcattggctacaatgcgtagggcaatttggtggatacctggctacaaacctcacccgagcagcccttatccagatgagcgacaagtggttgaggaagggatcctatggtgcgactgcacggctccaattgcgtgaagagacggacagctagccgcatgcacgatctccacgcgtggaagcgcggctcggctccgctttgctcgttgctggggatgcggactacgcggctagaagcagaagcgacgcatgtcatcaccgcgtctgtttagggtgcttaagattacgggaagtagttggttggtggtcaatttctgagaatgtgaaaaagctaagtttcccagcgtttgattaatttctagtttattttctatattaaataactacagttttttagaatcaaagctatattatttaggggaccttttaattatgagagaaactatatcagctagaagcttcccgaacagactcatttattgccgctttgctcatacttgaccttcgtgcgccagattgccgccaaatcatcgacaaccacagctgccatggcagggaaatcgagggacgcagtagctgccatgcatggcaggaggaggctaggagaaggacctagcctctacagcctctatgcctagttctttgattgtcatgtatattcatcaatttcatttgatttatcgttcatgatgcgtgctgtgacggaggtagtataaccaatataagtctacctttacttaaataaagtaatctattagctacgttttaatgaaaaatatttttcattactataataaatccataaagtcattgatagcatacaagaaaaattgttagtaaaattttggaaactgatatgctagatattttaaaaaaatcacacatagtacaaatagatataaaccaactccattattatgacacattttttttaataattttagtatggagtttatatgttgcaagggtaatcagaagaaaatcataactaatgtccaaactacttcgttattaaccaatacatgtttacaaggagtaaaaaaatacttcaacaatataatatcatccttaacattcataataaaaatgaaagctacattaaacaaggtgcccttcctagttaactatataagtgccatatatatactagacaaagacgataaaagaagtcattatcaacggaggaagtaaggagaagctgtgtgccttcgaattttggctcggagcaactccttgttagcaccaggaatcttgtcaatcttctccccatccttgacgaagaaaaatgttggcactatcccttcgatgtcataccagtccgtaacactctccagctcatcgctgtcgacattgaccttaatgaaaaccgcaccagcgaactccttcgcatactcggtgaaagctggcgcgatgtagcgtgaagcagggcaccgggaagtagtgaactggatgactacgagcttgtgggattgcttggcttggctcatgtggagggcgaactgctccattgtgtggggcacaatcaccgtcccttccgcaccggtgggcatgtcttcttcgatacttatctctgtagtagtgtatgttttgtgttggtgtgcaattatggttaagacatgagttagtaccatgggatatatattatacacgtttgcgctaaaatgcacccaagatgcgcaatacctaaaacacacacctcacgtagtaaattctttactgaaagttatgctgtcctcaaacacctcgtaaatattttactaataggctcagtatgggtatttggcgataattcatatctcagtaaacaaattactagcactgggtgtgttttaacaaatgtcttgacttgtgcaatatataaaggatactatagtgcatacacctttcgttctttgatccaagtgttagggccaacattctacggttcttaaggaggtaagactaggaaccacaccttctaggtacccgagaaaatataggacctcccattaattccttaagtagatgaactgtaactgtaaaatgacaagaaacaaaattacctctactctgaagacgtgaagaggattccggtagcatacaaaacctgattcagggtcacaacaataacatttaacttccattaaaattggtttcaaacaatcatcaagtcaggttgaagatgcatagaaggtaaagatagaagccacggcagagaaagaaagaagctcaataatccttgtaagttgtaacctgggaatagaatgaaaaatccatacccgtgatcatcttgttgtgccaaatcttcatccaagtctctcccttcagcaccaaagatccaatccacccattgtatatcaaccataagagtgctcggcgtcggatgcttgcgaattgcagtcctcaaggcagactccacttcagttttgtttgattcatcatcatcagtgcccccaattcttgcagagatctctgcaagggcgaccaagtgttccaaccctgtctccttagagtcatactgcttgaactcgttggcattgaaccttagatttaatctttgcacactcggcattgctccttccacaaaagtcatgcatggtgctgtacagacaaacatgaagtacttgagagacccgaacccctcattcgcagcgacgattctttgcgcaggcgctgttcgaacaagcagcgaaagagcagtgagagatcccagtcctttgagagtgtcaaggtcatcctgggaaatttgcatgactgcaatgtttaaaatgcggagattgttgagctttccagtccatttggggatgctggtgaagatgtacctgtgacagtgagggagcagatcaagtagtacaagacgaaggtgcaacaaacactgtgtatgaacaatatccaataggacagcagttgctcttgcatctgcttccagtgtctgcaagtgttgtagtccttggatcttctctggaagtttaactgtgatattacctgttatcttcagatatctcagttgtaacagttcagaaatgcttgtgaggtcatagcttgttttctcttgatcagcccaaaaacaaagaatcagaactcgaagaagcctataatctgcaatggaaggcatacacttgacttgtccgaaaaatgccatcgatcgaacttgtgagagtctcaaacctgctagtggtgttgtatcatgtgcattgctgaagtgaagcgagagtcggcgaaccttgtcagcatgtcttactgtcgtctgagaatgatccaatgtaatgctgaaattctcctctattgacttacacctgatgaaatttaataccatgtggtgcactacacatgacaatacctcatttttgcagttaacatctactggttggaccaggcccctaccaacaagttcatcaaaatagttccctgcaacttcttccatgactttattttctatggaattgatgaaaccttcagccatccattgcctcaccaagttggccttcctaattatgtagtcctctttgtagatgctaaggtataacagacatgctttcaaacaatgaggaagattattgtaaataaggttgagtacttgcctcatcccctgcaaagtaggatttttcttcaaattggaagtagtcaatgatttttgtatgtgattccattgctgcattccatctaacagctggcttttaaaatgtctggctgttatagttattgctagtggcaagccaccacatttttttatcatgtcatgagaaacttcagtaagatgtccaggaaattcatttccttggccaacaactccactgaaaaacaattgacttgagacatcatcacccagtggatcaatcttaataatgtgctctgagttatatccacagcatgccaaagctacaggttcaatttctgttgttattagtattctactgcaactattattatcaggcaaaccacggctaacaatatcccacattgatgaagcccataaatcttcaattatgatgaagtacctgcagaacatttagtacttcgtaaacattaaacttctaatgtacgaaaaaataaatcatatttaaaaagctatacgtgggatagcatgctgaatttaaaaagttgagtgcaatttcattttatcaactttgcaaacatggtgaagacatgttctatatcttgtaaatttcagaaattaaatttaaccacatatctaagagcaagtttaatagtatagccgactactagctccaaatcatctagagccaaatagccaattcatacaatagttgcttactatactattaatacttggtcctacctgtcatacacacattacgtcttagagtccgtgctgcagctggctacagatctgtaggctgctgctcttctctctcttcctatatctctttaaaatatgtttatagctagcttataacctgctattgtacctgttcttagacatggaaaaagacacgtactcctaagcaaatactctctcttgtttttaatgtttgatgtcaaacttttggacatatatatgttagatcatccatcttattaaaaatataattatcatttttttaaatttattttatcattaaaagtaatttaagcatatattatatttttcatatttgtaaaaaatttgaataaaataaatggccaaacatatatacaaaatcaacattgtcagacattaaaacaagaggcagcagttaaattgcaccatttttatcactgtttcgttttagttatattttaaattttgtttatgtacaaatacgattgagtttagtctaattcttttttgaccgaacaagggaggcccttacgactattttttattaagtaaaaaaaagttcttgtaacaactgagaaaatgaaaagaaaataaattacaacttactgctataagttaacatgccattgtggtagtttagtctaaaaaattataacaagggtatgaagcatgtactttcatttacatttagtaattaaaaatacaaacaactttgtagttgttctactagtagtagaaataatgtactagtagtttagtcgcctaaaaaaaataacaagggtatgaaacatatactttcatttacatttaataattaaaaatacaaacaactttgtagttcttctactagtagtagaaataatgtaaacactttacctttattttttcatgcaatagaccatatctatttatattaacaactcaattgctgttagtagaatgaggtgggtataataattgtttagattaccagtataattcatggctcgatcgaatcgtatctactaatagagggcactataaaagtaatttaaaatattattggcattgtcgagtaaattaaattcatatgtatagttactaacttaattactatatgaaggataaaaaaggggaaatttgagaaaatagtttgtaaattcatgaaaaaaatactagagatagatgtagacatgaattaccttttatcttgcaaatgcgtccggatagtttcaaggagtcgatcaacctcccaaacatccgaagactgatgctgatgttgtggccgcagctgtgacagcatgtcggtgaggatcttcgtcatgtcaggcttccggggcgtccgcacgaaagcccggcagtcgaacggcgcatccaaccgccggccatgcagacgatagaattctgtggccagcgtcgtcttgccaacacctccggatccaacaatggaagccaccttgagcttcggctcgccgtcggccagccaccggacgagcttttgcatcgaaatatccctaccaacgagctggccgtgcacagcagcgtcgtccatcccgaacgtcagcgacagaaaccggcggcgttcgttgccggcggagtcctcgcgatcgtcgtcgtcgacttcttctctcggcctcgagctcgaggtgcgcctgccaagatggtagctctcctggcggcgaatggcctccttcacgcgggcgctgaacagggtgacctcgtcggcgatccaccgccgccggttaagctcccctcgaagccgggcgatcatgctgctgatcatcttcttggcaccagcagtgctactgccatcgccgccgccgcggtggtggaggagctgggtcgttagctcgtcgaggaagtcgtcgacgtcgtaggagagctcgcgaacctccttagcccagcacgccgccgtcgagtctggcggtggcgcggtgtctgacggcggctccacgaggaggtagtagtcatctagcaggtgtcggagatcgcctctgaggaggaggatcttcttcctctcccccttccgcagcgacgacggttgcgcaggcggcggcggctccggcggctgcagcagcagcgagtcgagcttgctcgtcagggaccgcatgatgacaccctgcgatgcactgaccgccggcgccatggatggagacctctgcagctcgccggcgctagctgaagatcagatcagagctagtgatcgagattatgcctcgttagttgctgatttgacagcatggatcgcccaagagtacaagaaattaactcttgaaacttatcctatctagtaagaaatcatgcagagaggctgcgctgcaaatgtagctctgccatagccttcaaaggttgatgtggaaagaagtaggcaatccctcgtctctttcgtcatagggagatactccatccaaatccaaatgtattaagcatatttcattgttttgattatttttttccaaatgagatgagcttattcatatagtctccatgcatccgagccttaaatgaagagagtctcttttcgttttactgtgtatgattaaattgttgaccgaaacttgagctgccatgcattctccaacccttttgcatgcatatgaaaaagtttgttacatgggagtacaaatcgaatgagttaattttttttcttggtctcgatgataaaataaatatgcttacgatctttgcatggaccgagtagctaattaatggaataacttttcctactttggaactatgacgacttggttctcgcttgagagtaacgttgtacgatggtaactatataattagatgttaggttaggccaaactccaaagaggataaagttggaagaaaattctacagaggagagcccattggggattaaaaaagaaagcataactaagggcatttgccctggaagcaactcttgattgtagccttttggataaaagcatgccactgagttgagagtactaatcctacagtacttatcttcatagtagtagctttgggttagcaacacttccattaatgccctctcccttgttcccatggtcaccgatggtgctgtctccctcgtcatcaccggcctatgttgttaattcttggctgccactacctctcgagtagatgccatctactcgagaggtagtggtaaccaggatcaaggtgctaactaccacattgaattcaggcacaaattcacagtttgaccattttgtagctgttatagaggtagtcttctttgctacgatgtctcaatagcattagagttacgtctcgggaacaatgtcttccttacaataacggcatcaacattttccatccccgacacttgaggtgccactatctctttctctgtatggaccacaccctctcttcatgcggaattggcgacttgcaaaatgtcctccgaatccaaagctacacgagataccccttcccctatggtgggatccaagcctacacaaaaatgtattattgtgagttctctaaaggagatgggggtttgtgcgccatgggagaggggaggggggacgggttagctttgacaggtgggcctggcgactttttaatatttcctgtacttagtgttttggccatattgattccatgcaggctgtatgctgcctatgatttctacatagcatgtgagataagtggttactcattcctatttcttgtcccgtgttttataaacctttcgaaattgttacaatatctcccaccagccttatccacgcggtatgggtataacataaagtcaagaaaaaatttctcttttttaaaaaaactgtagcactggctaccaaaactcagccaaatttatgaattttctttctattctttcaaaattctaatttgaaatttaaattctcaaaaaaaagataaaacacaaaaaaattgctgaaagaagtgaaaattcaaaagtggtatttcgcaacctgctagctatgtgctgacaagttagcaatcattctttcatcgctttagcaaagacgatcatccattggcctgtaatgtgacgataatatatactccctccgtcccataatataagggattttttgaccactcgtcttattcaatttttttttgaaattattatttattttatttgtgacttactttattatctacagtactttaagcacaaatttttgttttttatatttgcaaaaaaaaattgaataagacgagtggtcaaacgttacaaagcaaaaactcaaaatccattgtattatgggacggagggagtagcagctagtggatgctaacaaggaaagtagcaagatgcggatacccttgataaaactggtataatagaatactacaaaggttgatgtaacctgcgaacctgcttttaattgcaggcaatgagtcagtcaagcactatgaaaggtcttcttaaaaaaaaaaccactatatggaaggatgcctgtgaagattatggatacatgatacccacattatctatatatgtatccaactgctaatagaaggtgtgctatatttgtacataacttggttgctagggtttccttgccggttaaggcaggaccgtacacttcgattgggtttatctcttgtaatactaaagggaacttaggccgaatccgactgggtttcatacttgtaacctctgcccctaacctatataaggagagccagtaacaccctcgaaggacaacatacaacataagtcaccacaacaagatcgtcagatcaatacaacacccgacggattcaatccctcaacaggagtagggtattacttctcattaaaaggatctgaacctgtctaaacctttgactccacatccatccacttttggacttcgtaccactatgcaggatcaggtcatttctgacagccctaaaccctcacctctgacgggttcaaccttggtcaaagataagtggtcactgatgacgttgagtcacctgtgacgggtaaaggcccgtcagaggtaagagtcacctctaatggtccccaactaaaacccatcacagatgagggtcacctctgactggtcccaacaaaaacctatcatagatgagagtcacctctgatgggtatatattttaacatgtcactgaccgtaattacgatccatcactggtgtgaaaaatgggaaaaaaaagtaataccgtcctcctaggttaccatcacattcatttggacggtcatagatcgcatctggcattcacaaataaaataaatcatcaaaattcctcttgttcccatggcattcatcccaacaaaaccacatgaatgtcaatcaccagaatcaccacatgaattggaatcatcgatcatagtagcaagaatgtgaacaacatgaacaacacaagacaaagtatttgggtgaaagaggactggcaggcaatggatctgaacgcctccacctgccatcatgttcgttgtgcttgtccctgagacaacgcagattggagcttgggcgcggaggagacaacaaaacaatgggcgacacatgtggatggaggtggcggcgacccgagctcgatggtgaaggagacgaaaagacggcagtcggtgcatgtggatggaggcagcggcgaccggacccccatgtctcccattcgcctgcctccccatctctgcctccgccctgagccaccgcatccacgcccacacccccggatgcctccccatttccggccccctctgcccgagccgagccgccggctccccatctcagacctgcgttgccgtggttgctgcctccacctccacgccgttgcctctgcctgcctccccatcttcggccccctctgcccgccgcctccccgtcttagatccgtgttatcgccgtccccgcctccgcctgccttcccatcttcatccccctttgccttgagccgagccgtcgttccccgtctcagatatgctccgccgccacctccagccgcacgtcgtcgcctcccgcctgccttcccatctccagcctctttcacccgagccaccgcctgcccatctcagatctgcgctgccgccgcctccacccccacgccatagcctccgcctacctccctatctccctctccccctccctagtgctgtagcctcagccccaactcccgctcacccgttggcgttgcctccatccccgctgactcactggggtcacctccgcctccaccaacgcgcacccgccggtgagagggaggggagagaggggaggtcaagagacgggatggtttgagtgggaaagagagattgagagagaggggggcaaaaaaat

SEQ ID NO: 67136 - DNA, 15203 bp, Oryza sativa
ttaaatgtcctgcctaggaaggatgatttttactggttgtgctctttaggtatctgacagtggatatatattttcgcacgcgattaattcatgcttgtgaaaatactctatctatttttattggcatttggttgttggcggttggtccggctgtcagcgaaaatatgatatggccgccaatgaaaagctttttttatagtaaccctgaacatagcgagatttcatcaacatcataggttcttgtagatgttgcacatgccccagtggtgatatgtccgatattcagacaggcacttaagtttctgcacagcctgactcggtggctatcttgcatcgtctcgtcctggttctcgggctggcgcaggccggcaaccaaacgggcttctgcatggcctcatacgaaccagacctgatgtagacaaatccaacataaccataataggcaccgagctgcaagtagccatccaactgtagattgtctgatgagtgatgatggtattcagaaaatgctccaaaacttcatgatcaaatgactcatcaaacatgtcgttttataaagttcaagttcggagtgattccacacacgcaatctatgtgtgaaagcaactgctgaaaatcacagaaccaagtgaaagctgaagaacttttacgctatgcagtaatgtagacactcttaaggcctcatgttttgctttggcaaaatttgtttttaccatgatcacacttcccaaactgttaatgtttttttcataaaaaaattatgtagaaggttctttaaaaataaccaattttcaagtttgtaataatctattgtattataagaccgtcttgaatccctagcacatggtagccgtgacactgagagctgctgctaggtcactactccatggcgatagactgttgttgcggctacgacaacacatcctggtggttgcgagtggttggaaggtgagagaggaggaagaggaaacgggaagagaggagagagtagagagaggcgatgaagatgatgaggcggaagtcgctgacatgtgggtcccacctatcacgtcaactgaaaccgtttcccaaaccagcagagaaggcagttcgcaccagtttttaagttggagagacgttatacccgattttacgattgagggatatggttcgatcaaaggcaaaagatgagggaggtaaaatagactaactcagctcaagtaggactttccccaaactgggccgctaccatcagtcgtgtcgtttaccgtgcagaacttcagtcaagcaaatcatctgtgagaatatgactgtcaaagctgtgtagtaccacatcagaagaggaaaaaaaaatgctcctactcaattttgcgggcatgcacctcgcactttgacacgctaaaactttatatcctgttatatctcgaatatttaaacacatgtataaatattaaatatagtctaaaaaataattaattatatagattatgactaatttgcgagacaaatcttttaagcctaattactccaagatttgataatgtgttgttacagtaaacatgtactaatgacggattgattaagcttaataaattcgtctcgtggtttaccgacggattctataattagtttttttatgagtacatgaatattttatacactaacctctataatatccgatgtgatacgctaaaacttttcacctctaattctaaatatctcctccgttgctgactaccgtgcacattattgcccatagctagtggagtggagtactctaccactgtaccagccaagaagaggagatttcagagccgaattcacagctagtaccgacaacttgccaagatatttcgctctgtagaaaaatcgctgtcaggccatctccctagccgacttctttgatcctagttctttgtcagttcattatattttctctcatataatagcatatatgttttctcattatattattaaaatatattacaatgacaacataattttaaattttgcaataactttacgaaactactaatgtgtaataaccactctagtctcctcttctaatattacttatttttttaattccaaatttccactgtttctaaattgtatttctatatagactctgccttttctttttctccgattaatgtgagaatttctaggctatgagagtgaatgtggaggctcctttttattctaaattttagttagttttaaattccaatatggactctatactctatttctaatattccttattttttaattccaaatttctatttttttttcttaattatatttctatatgtactctatactttacttctaatatttcttatttttaattccgaatttctattatttcctaattgtatttctatatggactctatactctacttctaatattccttattttttaattctgaatttcaactatttctaaattgtatttctatatggactttagtctcctcttctaatattccttattttttaattccgaatttcagctatttctaaattgtattttgatgtggactctgctttttctttttctccgattaatgtgagaatttctaggctatgagagcaaacgtggaggctcctttttctattcctttaataatataatagattgtgttcaacatttaaccgttatcttatttaaaatttttatttaaaaattttatgagaaaattttaaaaacaaatagtcacgtataaactactatttatattttatcatctaataacaacaaaaaaactaatcataaaaaaattaaataagacgaacggttaaacattggatatgaaccgtgtaaaattatacttattttggaacggagagagtataactcaatctaaaaaagacagattcttgctacgaatctagacacgtatgtgatcagattcatattaaggattatgtctttttctttttggaaaggagaggtagactaccttaattagatgaaatttagtactattaattatactccatatttatacaacaaccagtgactcatcaattatcgcggtggagaaaattcctatcttttttcttggagtaggattaggatgtaccactacgtcttcctcgccgccgttgcgctcctcgccgtcgtcggctacggggtcaagaaccgacgccgtcgaagcgccaagctcccgccatcgccgccgtcggtcccgtttctcggccacctgcatctcttgggcccgctcctgcaccgctcgttgcacgagctgcacctccggtacggcaccgacggcggcctgctcctcctgcagctcgggcggcgccggacgctggtcgtgtccacggcggccgccgcggcggacctgtacaggaaccacgacctcgccttcgcctcccgcccgctcgtcgcggcggcgcacaagctgtcgtacggctccaagaacatcaccttcgcgccgttcggggagcagtggcgccgggcgaagaagacggccgtcgtccacgccctctcgccgcggcgcgtcgaggcgttcgcgcccgtgcgggccgccgaggcggcggcgctcgtcgccgcgacccgccgcgccgccgatgccgcggcggacgggggcgccgtggagctgagggacctcctgtacagctataccaacgcggtggtgacgcgcgcggcgaccggcgccgcgggcacgacggcggagaagctgaagcagctgctcgggaacgccacgtcgctggtggccggggtccaggccgacgacctgctgccgggcatggcggcgaaggcggtgaggtgggctacggggctcgagaagcagtatgacgcctcgatggaggagtgggacaagttcctctcgccgataatggcggagcacgcggagaagaagaagaagaagcgagaggacatcggagcaggggaggaggatttcatagacgtcttgctgcgtctgaaagaagaagacaccgagctcacggacactcacgtcaagagccgcgtcgtggtgatgatctaagctatcaaatcattctcatccaaactactctctcaacaaattttcatcaaattaatctctcgattcttgcgtttaaaattctgcaggatttgatcgccgccgcaaccgagacgacgtcggtgacgctggaatggaccatggcggagctcgcggcgaacccgcgggtgatggcgaagctgcaggaagagatcgctcgagcgaccggcgggaagccggccatcacggaggcggaggtgggcggcatggagtacatgaaggcggtggtgaaggaggtgctccggctgcacccgccggccccgatcctcgtcccgcacgagtcgacggcggcggcggccgtgcaggggtacgagatcccggcgaggacgtcgctgttcgtcaacgcgtgggcgatcgggagggaccccgcggcgtggggctcgccggaggagttccggccggagcggttcttggccggcggaccggcggtggacttccgggggaacgactaccagctcgtcccgttcggcgccggccggcggatctgccccggcatcagcttcgccgtgccggtgctggagatggcgctggtcgccctcctgcaccacttcgactgggagctccccgccggcatgcgcgcggcggagctggacatgagcgaggcgcccgggctgaccacgccgctgcgcgtcccgctccgccttgtccccaagcgcaaggcgccgcttgcctagacatatttacaaacgaaatgtaattggtgaataaaacttgggtatagctatatttattacgctatatttttcatcaaaaaatagtcggcatgtatttacattgtaagtccctaaattacatatgtaattttagtgtatttataatgtaagtctcaaaattacatatgtaagcactaaaattacatatgtaaattcgaaaattacatatgtaagtggggtgtaaatgaggtgtaactactgtgtaagtggctgaaaaaaatcgactgtagcatatggcgccatatttctagcaactccgataaaacttttatatacgtgttcttaacaattaaaagaaaggtaaattggaaccatgtcattataattttgtgaagtttgaaatatgccatcggtatctcaatgacatgtaggacccacatgagtcaataacatgtgggtcaagatggtatatcttaatttttacaatattataatggcatggttccaatttttctaaaaataaaggcggaaaaataagcttcgatgaaaaatctttaaaatcggtttcaaatttaaagttaaaaattaaaaatttgactgataaatgtaagcctacgcgaaaagatagtttgttgtcgtgggctcgtcgtccgtgctgctagtcgtagatgcattgtatctggtcagtgacacggggatcagtcgtagtagtatgctgctacgagtgtttctcatctgctctgatcagagtggtgcaatgtactcctactccattgttgtatctgacctcattgtcagcaaatttgtcgatggatggaacacgaacaaatgaccacaaaattgttggaattgttgtcgttgaagcaccgttgttacaaatccgccgccgcggccgccgtggacacgaccagcgtccgccgccgcccgagctgcaggcggagcaggaggaggagcaggccgccgtcggtgccgtaccggaggtgcagctcgtgcaacgagcggtgccggagcgggcccaagagatgcaggtggccgagaaacggaaccgacggcgactgttcttgaccccgtagccgacgacggcgaagagcgcaacggcggcgaggaagacgtagtgatacatactacttcaagcaaaaggatttggatttttctccacctcgagaattgatgattcagataattgtgagctgcaacgatatcgtgtagatatgctttctccgtcagaaaatgttgcaatttatttcctccgttttacaatgtaaatctttctagcattaactacattaatatagatgctaatgaatctagatacatatgaatatggataatattagaaagtcttacaatataaaacggaggaagaattttacatattctaaaaaaatctggacagaatttgtttaggatagatctaaatctcatcctaaatacaacattttgagacagaagaagtagtgtgctcctgtgttggtaacttggtatcggtagctgcgaattgggatcagagaagacaagtcggctcatgagcctgcttgacagcgatttttcagacaaggaaatatcaggtccggtagatcaacgtctggtcgatccgagctctgatgtccccgtcttccttgctcctgctggtagccttgggcaataatgtgcacgtagtctttgtttgagagctgcataatgtggcgccaaatttagttttctctctctcaaaatttagtacagaaacacacacttatatacacgtacacacactcatatgtaaagacacatatgcatattatttttttgaacatctccaaaaaaatattttaacatatattgagattgaaatcattgtaggtgtttcaatgtcgactcataacactccgttcgttgagttctttttttttatgtggtatggagtagctttgacagtcagtcagtcacggcgctttgcttgtctgaaactctcaactccactaccgggggatgtcgattcgaaggcacattgggcctatataagttaatgggccagaactgatattcaaaggaacattgggccagtttatcgtggtccatctttcttcttcggtgatgacatggaatgaggcctggcccaactaaacatcgggcccaacttttcttcgtcggtggtgggctagagatggtgtcagggcccggcccaactagaccacatcatcctacccctacctcaacccgtcggtcctcaattccccatagcgcggctcgtcgcgacctagccctagccgccgcccgttcgcgacctcgccggcgccgccatcccgccgccggcgaacctccccccctagcggcaggtcgccgtcacgccgcgccgccccgcgccgccgtactaggcgccagcccgcgaggtccgctcggctccaggattcgcgctgccgcacactccgctccgctcggcgtccccgccgactcgagggcacccctcctcgtcgggcctctccgtcgccgacgagctttttggggggttgagccgaacccccatgccctacgtttggtctgtcccttggtcgtgaggatatggaccatatagctgaagaagagactgtgggagttgcggaagaccctggtttggctgatgttggcaaggctgatgagaccaaggaagaaggtggtggtgctggagtgcacttggatgaaactagggttgcagtggatgatcccacggaggtgcgtgcttcgcagattgacgatggtacggctatggtgtccgtattaggtggcgatggcgatagctttgttgagcaagatggtcaggatactagcggcggcggtgcttgcaatgaaggtaatgagcctgaggaagatgctcgtgttcaggtgcgtttggatgatactagtgccgctgtggatgaggggggtgcttccttgattgatgatgttatgaatacgctccccgttggaggtgtggctagctttgatgatggtcctcagacggacaagaatgcgcaggatgagggggcgcttatagatgtagtttcctcaactgtgctgaatgatgcgagcatagatcttgtcaaagctagtgatagtgtctcggaggaaggcacagggatggatatacttgtccaaccgggagaggacattaaggaaatggttacaatagcctgtgatgcggccacagatgacgagggcaggaaggtggatgcagtttccagctccagtgatcgcaacgaggaagtggttggtgcagctggtcttgatgagacagatgaagacatgcgattgggtacagttggcctgtctggtgatgacaatgtggcaaatgaggctgctgccgcagctgctggtggtgcagatgatgaggacttgaagatggatggggtcattaccgccggagataaggatgtggaaaatggcaaggctgacaatgctgatggtgttccggaagtgaatgtagttgccattagtagagataatagtgcggaaaatgaggctgctgcagctggtgatgatggcgcagatgaagagggcattcagatgaatgtgctaaacacaactagaggtgagggtgaagaagatgatgaggctgctcaaaatgttgttgaatatgctgttgatggtacagaagaactggaaactataggcctgactggagatgataaggcggaaaaagaagctgccccagctggtaacaatagtgcagatgaggagggcatgcagatggatgcggttaccacaactggagctgaagatgaagatggcaaggctgatgaaaatgttgttgaagatgatgatggtgtttcagaagaagctgtggctgacacagttggtgaggatatccctgaagaagatgcagtgcagatagatgaggacgaggatgatgatgacgtgcctccaccattgacaaggaaaggcggggggcgccggaagcgaggtcgtgcatcttccaaggctcaggttgtggtgaaaccacctgttaggaagaaggatgatgaggaagtttgcttcatttgctttgatggtggtgaccttgttgtgtgtgatcgtaggttcgttaatgacatggaatttcattctttccatatcccaaagtatattgctatgttacaattattaatggttatttctatgtcctcatactcaggggttgtcctaaggcttaccacccttcttgtgttaatcgggatgacgagttcttcaaatcgaagggtcgttggaattgtggtatgtgggacttagtctgaacaactcgcagtgcccttgcttagttacttagatggtttactttggaatgtggatatgagtattcatacttcatttcatcaaaatccatgatttttatgggtcatatttgcattgaacctactctttttacatgcagatagtgggatgccggtaaaatataaatataatagctgatttaaatttttttccattttgtcctgttatatcatatttatttgtttattgttctttactttgaaaactgaagcttgtgaaatctgtgtaatactgagtaaaaattgctggagataaatgatgctggactgtttctctgataatgatgagatttgtgcttagtccacagataatatcttccttttttttttgattttgttcaatctgcatcattttcccagggtggcatatttgtagcaactgccagaaacctgccttccatatgtgttacacatgtacctattccttatgcaaaaaatgcataaaagagacaaaattcgtctctgttaggggaaacaaaggcttctgtgagacatgcatgaatactgtgatgttgatagagaacaaggaggaggctactgagcaaatggtaatatttcctctgtttcttggcttaccttaatctatctattgtatttctatagtatcatccagtatctttgatcttttcatcattttttagtttctgtatatcatttgtgacaccattttatccttttgtcattctctctcatctaagaaacttaggtggtgtttgaaactcatgaagatgaagataaagttggtgcacgtaaaacgagataactattagcacatgattaattaagttttaattattacaaacttgacaaatggatatatgtgatattttaaagcaacttccatatagaaagttttcgcatggaacataccgttcagtagtttgaaaagcgtgctaacggaaatcgaggtaatatcttaattcataagaaaagaacagggcaaggcgtaacaagttttcgagatattcatgctcaataatcattttgttaagatgtaggccctatgtatcttggaactgttaatttgcacttgatttgtctatttgattagtaaactcaaatgagctaaccaacctgctgcctgcaggattcaaaaggtgtaacaagaactattttctgaatgatgttgtccaagcattgcagcttgctaaattgttttcacgaaatggcatttccataacttccaccaacaccttctatgcgctatgtctatgttgtacacacctatgatcattattgagatacagagttgtactgatttcagtactcacttacttattaatcaacatcaatattcttaatttgtcttctcatttcccgttgtgctttgctccataccttgccaaagtgttaacctagtatacttgtacaaatttgcttaacaggatgtagattttgacgacaaaacaagctggtggtatttgttcaaggattattggttgaatttgaaaacaaaattaccattgacgtttgaagaaatatcagcagccaagtctcaaaagaatggttcttctttggttattcgtgacaatgatctcagtgaaccacatgatacaaatgatgaagaagagggtaattcagacagctcatctgtgcgccatctagaaggcaattcaaagaggaaaggaaggaagcgatcaaagcaagctgctaacgatgacagttctgtagttaaagatagcactaggaaatctacaaagcgaggcctgacaggtggccgtgatactaaaagttctacagggagaaaggttagaaaattgtccaagcgtgctttgagcagtgaccatcgaccaagagaatctgaaagcgtagggacatctacatcgtcagctgaagagaccagttgggcttcgaaggagctcttggattttgtagcaaatatgaaaaatggtgacaaatctgtgctgtcccaatttgaagtccaatcccttttacttgattatattaaacgtgaaaacctccgggatcctcgcaggaaaagtcagataatttgtgattctatgctcaaaagcctttttgggaaagcacgtgttggtcattttgagatgctgaagcttcttgaatcccatttcctcatgagcgaggtctcgccagttgaaattgatgacaaccatggtggtgttgtagaccctgatcctagtctggatgctgatggcaacagtgaagcatcaatggtgatgagctcagaaaaaaggaaaaaatctcgcaagtatgaccagaaagctctgcaaacaaaccttgacgactacgcagcaatagataaccataacatcagtttaatgtacctgcgtcgcaacctgttagaagaattgatcagtgaagttgacacatttgatgagaaagttcttgggtcatttgtgagaataagaatatctggaacaggtcaaaggcaagacatctaccggctcgtgcaaattgttggtaagataagacactttcaagctaatctggctggttttagcttcatgatgctgactttcccatatctgtgtgcaggcacaggaatagcgccagaacaatataaatgtgggaaaaagtcgactgatataacactggagattctaaacttagacaagagagaggttattactattgatataacctcaaaccaagagttcactgaggtattatcattttcagcacaggcacttttactgtttgcttactgtttaccgcaacttggtagagttaacacttgcaagcttatatttttctaactgtgtctatagttttatttcctttcactttgtatactgttagtaataaatttgacacaacctgatcatgttactttagattatgtgtacaagcattctctcaacaagcaaatctgctgctttcttttgttcacatgatgttcatttcctgattcactgttgcttttcttgttctaggaggaatgcaaacgcttacggcaaagcataaagtgtggattcattccaaggctgacagtggtaatgttattagttattattacacaacgttatatgtgcagtttttttggcatatgtgcacagtttcgctgtttctaaactatcttaccattcagggagaggtttatgagaaagcaaaggttctacaatctctcaaagtcaacgatgtaagcaattagcactgaatggatgctcagagttttctatatagtacatctatcatttcttaattcattattgcctattgcaaaaattgcagtggattgaaagtgaaaaatgcggcttgggcatcttcgtgaccgtgcaagcgatatgggccgtagaaaagaatatccttcttcatgtcattcttttatatctatcaatatttatttatccttatatttctttaagtcttcactatgggattttaatcatatcgtgctggcaaaaaataagtatattatattacgcaagtattcacaaatccagtggcattatttttgtataaaactcgttcatgcacttttatgcatattattacttaattaattttgcaatggcctatatctatgtggacaagtccttgttaaatgaaaatttagcttgtttgtcttaaccagtatttacgcttagagaatgtgtagagaagctgaagcttctaagtacccctgaagagcgtgttcgtaggctgaatgaagaacctgaagttcatgctgaccataccatggatccagattatgaatctccagaggaacaagagcaggatactggaagaagtacttgattttattttgcttccgccccataatattcattttcgatccatgcgtgctcatctgacatcactcccttttttctattgtacaggcagcttcaataagtcaagaggatctttctctaagaaagataataatcctgtatctccaggtaaaggagagggtaggagtcctgcacaaagagatttaaaaaccaactgggagtctaatcgaaacacatggggcgaatccagtacacatatcgagtcaccccttggacgcagacctgcattttcgtctcacggtgaaagtgctggttacacaagtaaatcagatagcccaaacatcggtacacacgcagttaaagtgggagctactgcaggtaatgctccacatggtctatctggtgtttcatctgaaactttaggagccaatatagggtcagggggaacacatgcatcacagtcagttattaatgagtctgaaaaaatctggcagtacatggatcctaccggtaaaatccagggtcctttctcaatagtgcagttgcggaaatggaatggcagtgggtacttccctccgaatttaaaaatatggaagtctactgagaagcaagatgattcaatattattgacagatgctttgctcgggaggtttgagaaagacctaccgccgtgggaaccgccagttggaagcagttcagatgttgatggtaggccccgtaatgattcccttcttgaggaaggaacaagagctggagaacaaccttcaaaatcagcagttctaagtagcacacagtctttctcaggaagggctggtcagggaaacgatgcggcaaatcttggaccagccactatccaatctagtacacaaggttattatggaatgcaaaactctcaagcagcgtatgcagtccaacaatctcttagtggaagttggaacgcctcaagtcagtttggaactgcaataaatcctgtgacactttctcagcctgccatgggtagctttgtagttggacaaaatgcagctttaggaagtgcaggtcagctaactcctgtaccaggtcctgcgacagtgagtgcagaagtagttaattcacagttgcagtcccagaaccagatagcatcttttttatcacaaagtgatggcagattagctgatggaaacgattcaaagttgggggaagatgcttcgcgtgaaaggatgaggtcatcgggtgaaggtaggctctttgcgaaggtttatatcgttcaatgtattgaggaaacaaatacttaatatataaaaaaaatgtacaccgtttctttaatgaatggtaataggctgagaattataaaatcgccgcgaagaagtatttcaatatggcctaaacattcttttttggttcttcacagatcttggactatctggtgcacaacctggaggggtgcaatcaaatactcaacaacttgaaggtattgctcaatgcttgttcattgtttatgccattgtcttctcttttactgtattagcatctgttgtttcacaaaggaagcttttaatcccgaagcaacttttgttcaatgaaaattatggtttaaatacctaatgaaactgatggcattacctgcagatgcaaggaaccagttacaaactgatgcttccaactcggtaaagccatctcagctgatatcaacaccatctgctgaagcagtgcagccctcgtccacagccatggctggtggtgataatcaaaacactgcttgggcacaattggcaagcacatctggccaatctcagcctcaggcggctggaaatatgacctggggagctactctccagggtaatgcaaacatgggctggggaatggttggacagaacaacatgaacatgtcttggggaggaacagcacaaagtgccacaggctacaacatgggtttggctatgcaagcacagccaaatgcagttccaaacatgggctgggttacaccaaatcctggaaacaccaatatgaatatgatgtgggcaactcaaggccaaggcactccaaatgcagcagcaatggtgggaactcagatgcaaggagttgcaatggctccatggggggccattgcacaaggaaatacaaattcttatcctggttgggggggccaagttggaaacatgaaccaaaatgttggatggggtgctcccatgcaggttaatccaggtcccagtactggaaatgggacaggccaagataataacaatatgaactggaattcaccaagcgggaacccaaattggaataaccagcagcgagacaatggaggcaggcattctgggcatggtggtgattttaatggcggtgactctggtgggaggtcttggaggtcgcagtcaggtggtgatggagggtcgtggaggcctaaaaggggagtctgctattctatactcgacaagggatactgcaagaatggtgagcactgcaacttttcccattcaataccgaatgatggatatccatcaagaaacagtcggcacttcgataggcaaaattcaggtaacgagagacggtacgacaggcaaaacgagaggactgatcggcagtttgatcggcaatcgtcaggcaacgagaggcgtgatgacaggcacaacggcaggga

SEQ ID NO: 67137 - DNA, 11087 bp, Oryza sativa
ggcgacgcacgggggatcgggggaattaaaggaaaggggtgggagtcctcactgaatgggacggcggcgaccgtcgacgatgagccacgggaaggacgacgtcggcgggcggacgagctccgagatgccctaagaaaggaaaagagagagattagagggagaggggtggtccacggcgggcggaaaccatggccgaaggcggcggtagagatggtgctcaccagagtgcgagggggtgagggctccggcgacgaacctcgacggaggaggggtgaacggggtggacctcggccgcgcgaacccaacggcgccgacggcgcggtgcggcggcaagtgtagcggcggctagaggcggccggagtagcgggagagcggcggcggatgggcgcacggcgcgggagcaatggagggcacgggagagagcggtggaaaaagaaaatatgtggaggggagtgcgggcatgctttataggggctcgggagagacggatgtggccaaggcgctcccgatttcaccggcgacgtgggaggttgaaggtgggggagagagagagagagcggcgggattcaaatttgaatcccggccatctcggttgagggcccggcgagagagagagggggagtgggtgcgggaggcgcggcgcacgcacgggcgtggccgacgtggccggaggaggcggggtgcggcggtttcggcggcggatgggcgacgtgggcgagtggccggaggttggggaagggcccgataggtgggccccacctgtcggcgaccccggggagaggagggaggcggccggcctggctgggcctcggcctgcggccggcccagcagggaggagggggaggaaggagagaatgggccggcggcccattcgaaaaaaggaggaaaaaaaaagggaggaaaaagaaaaagaagaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcttgatttgcacctgcattttcttggggggtcgtttataaattaaattttaggcctgggaggagaacttcagggtgtgacatacgggcacgagcatgggtagtgacccatgcccgcttcgcccgtttacccgcaaaaaccaactgacatgtgggctctcagtcaaattagtataaatgccaccgtctaggattgataaacttgtaatgcttgtattgtagaacttggtacaactgtaccctatctttaaactgtgataatatctctctgcttgtagagatttgtggttgaaggattgaactgtaagcctgtgatgggtaaacggatatgcccgcgagcacatggcgcccgcgggcgatgggcatagacaatgttccttccacgtcatgtagtaacgggcatgcccgcgggcacgagcatgggtagtcactacccgtgcccgtcgtgcctgccatccctaaatgcaatgataatgaaggggtggatcggacgctcaatgttcaaacttgagagcccagaaaataatttatattgcggcgaagcccagaagcttgtctatttttgaaaatgaataagtccacttgccgtccctcatctttatgtcgagtttaattaacatcccaaaactgcaataccataaatcttcacctccccccaaaaaaaaaataaaactttacaaaaccgttcaagtgaggtcccttggcagtatggatatttgttttggatgacgtggcatcttagtcatcggaaaaaaaagttaaaaagaacatatggggccggcccacatgtaagtgccatatcaccttcctctgccttctctcccctctctcttcaccaacggctagcacgcagtgggaatgggcttcagctccatgctgttatccatgcttgcctctgtcacgacgaactcccaacggaaatcggcttcggctccatgatgttggagctcatcagcgcggattccatcggctccgacaccggcacaaccatcgtgcgcaacttcttcggcatggcggctctacgtctcgctaatttttagagaaaaggtcagagacctggcttttacttgaaagccacatcggcggtgtcttttaacagctggggatgccagcgaaccatacaagagcaaaacaagactagtaagcttaaccacagcaaggagcttaggagcagaccaaaagctgaacaaacacttgacaacaacctctaaagccaacacaccaacagctaacgctaaccaactaacccacacctaatctcggatgccgtaggcctgtcatcacctttatttcttctgtcatagcttctagcttgatctcatcgttaggtttgaagagcctcctccactgcaaaagattagagataatttgaaagggcaaagttagtgtcacgcccagaaatttactagtaatttccgaactagtttgttgtcacgctcagaaattcactagtaatttccgaacttatttgtgcataaaatcctcgtccaggaatcagccgaggtacacaaactgacaatttaatatacagaatcatcaataatagtgttacatactttcaaaagaaaagaaaactgcaacggaattacggtctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagaggagtaaaacagtggagtaattaatcagaaattttaatcaacactgaacagcacacccatgctgcacaggcccaaccatcctgaacaaccatacccggctgtacagatctaactccaaaccaggagctaagcaaattattaccagatataacatccataattattgtgagaggtgtgagactaatcacgaaaaacattgctcaacccgcccataaccgcgggcacggctattcgaatagttttactctagccagaggtgtaccactgtacccacaagacacagcctcctcatcatgtctaccatgcgtcgcgatactggaaagtacccgaatagaggctgtgacaataccctttgcacaacacaactcaccacagtgcaccattcctggatcataatcaccccctctataaatataactagaggcatggactccccagcgacccccacggacttctcgccgcttctcagtctggtgccccgcaatgaatcatgctatacagaaggtaaagccgttgcccatgctggcttgtggttggtacggttaatgtttcataacagtagctcgtgaaccggtccttaattgtcatgagcacgaccttcaaaaccatgtgctcacaacccaccattgtcaagttttagttatcaattaattatcataacacgattaaccatcgtgagctacgattaaaccatcattaaacaatgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaattggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaaactaacacgcaaaacgaagaataagactaataaaaaccaaataaacagtacatataaagtaaacaaacatgtagatcctgattttagatgaatttagcaacttgaaccactcaaaaccgagttacgatgatttagttatgaatttccgaagatttaatctattagaaaaacaggaaaaagaaaaaaacgatgatgacgtcacctcatcaatggccgaaccaagatggcgacctcgccggagattggatggtcggctgcgactttggaggacaagaacacgtagaggacgacgagacgaacccaacggtacccaccctcgaaccaaacgacgaacgacgacggccggcgacgaggtctagcggcggcgcggcttcggtcgacggcggcgacggggctgcggtggtcggcggcttcggggagatagcggccgggcttctccaccctcccgcgcacctaacggtggtgacggagaccggcggcgacggcggaggcggcggcgcgacgcggatggagctcggccggcgactacggcggggtggagcacgtggcggcggcgctacgaggcacgggagaccacgggagagggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttggggataaagatagaggaggataagaggaatatttcccctcaactaattttagaaaaacacaaggggaaaggtcagatttggaggagaaaaaccgagccaaatcggtctcagttcggctgctagaggtagaagataaacagtgtggagggaggcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttgaattgttaaaaataattcctatgctcaaataattccaagaaaaatcttgaacatacttggagacccaaagtatttaacaatattaaaaacagaccatttaatgattaatttaatatgtgggtaattactgaaatgctctttgtatgattaaaagttaagaattgagctccgaaacatctgagaaaatttcagagagtgtaattaatcatggagaatttaatcaaaattaaatccatccatgctttatatttaggaaattttatttcccacatttaacttcacttgtaaattaatgaacatttaatataaattctaataataatttattaaataatttataaatcctgaaacaaaaatcaggatgtgacatttgtgcataaaatcctcgtccagaaatcagctaaggtacacaaactgacaatttaatatacagattcatcaaattaactaaaacgataaatacttacttaagaggcacttagtcctcaccatgaagaaaactgcagcggaaaataaaatctagcgaagctccagctccactcccataggtagctcaactgggtataagccaaacgtcttctccttcgcaacttgtcttcaactgaggtttgattgattattgcaaggtgagcatatgacatactcagcaagccacacagcaaatatgcaagtgcacaaggataccaaagaatggcataatacagggctcatttgcaaaagcagcatttagcaaacatttgagaattgtaaaacaatagagtaattaatcatcaatattaatcaacactgaacagcacacccatgctgcacaggcccaaccatcctgaacaaccatacccggctgcacagatctatctccaaaccaggaatgtaccattccaaactaggagctaaattaattaccatcaattaccacattattattaatgagtagtgtgggactaatcacgaaagacattgttcgacccgcccataaccgcgggcacggctattcgaatagttttactctggccagaggtgtactactgtacccacaagacacatctccacaatatgtcaccatatcatcatgtgcccatgctgaacatgtcaccatttgtgtagttgtgacaagacccctcgcataacttaacccaaagcagtgcaccgttcctggattgtagtcaccccctcaaaaaccagaggcatggactccccagcgacccccgtgggcttatctccgccacttctcagtctggtgctccgcaatgagccttgttatacaaagtgtccagctgttgcccattctggcttgtggttggcacggttaatgtttcacaaccgaaactcgtgaaccggtccttaattgtcatgagcacgaccatcaaaaccatgtgctcacaacacaccattatcaagttttagttggcacattaattaattaaccaatcacgattgatcatcgtgagctatcattaaatatccatcattaagtaatagtgaaacattagttatcccaattgtgtgctaatgtttctaagcatggctaagtaattatgtctaacatctagctgaacaaatatataaagctcaactagtcaaattataataacccaaggtatcaaggaatagagtaatcaatgcaaacagaccataacaaaggaataagttcacaccacccgattgtaacactagaaatatgggccttcaaaaactttttaataaattgcatcatgccgattttatttgcctattttattggaatttggtttcaaagtttaccgatcgcgaataaggaataattaattaggaataaacactaaaattaaattggcaaaataactaattaaaataaagattaggtgagtttggaaataaataaaatattatcgcgaccatattggtaacaattgaatttaggtgcgatggaataagaattaaccctaattaaattcgaataaattaaatataaaaataaaaataaaatatgggtagtgataatctaagttagagcaacacaaatattgtgtaaacttgatttgtgcaaaaattagaaatattaggacaagatttgaataggaaaaacaaccaaattggaaaaataggaaaagtcactgttcattgccccataggtgttcgcttgaggtcactagccctaaccccccccctctgccccgcgcgtggccgccccgagccccgcgccgccatgccgccgttccatcgcctcgagccccgcgccgccgtcgcgtcgccgcgtgccgtcatcatcgccgcccgtcgccgtcgccgtcgcgtcatctcgcgccccgtgccgccgatgtcgcgccgtcgccgtcggccgtcccgtcgccgctcgcccgtcgcgtcgccgcctcgcgccccacgccccgtcgccgctcgcccgtcgcgtcgccgcctcgcgccccgcgctgatgccgcgccgcgtcgtcgtcgcatcgccgtcgccgtcgcgccgagccccgcgccgcgccgcccgcccgtcgccatcgccgccagccgcaccgcgcgccgcctgtcgcgtcgccatgaggccgcccgcccctcccccacgcccttataaaacccggcccctccccttctccaccccacacccatcctctccattttcccccttctcctccttctccatgcgccgccgccgtcgtgccgccgcgccgccgccttcatgcgccgcgccgtcgcctcgaagccaccgcgccgcgccaggtgtggtgccgagcgttgccgccttgcgccgccgccgccggtgagccgtctttcccccccccccctcgcgtccaatgccgccgccgcccgggtgggcaaaaagccgagagagagagaaagggagaagccggtagggagaggaggaagaaagaaaagaaaaggggaaggaaaaagagaggagagaaaaagaaagaaaaagaaagagaggagagaaaaagaaagaaataaaaaagagaaataggatagggaggttaataaaaatagaaaatttaaaataattaattatttaagtatagattaattatagtcgtaaaattgcaaaattaaattatattttggtaatctctatgagtaattaattttaggtaagaaattagatttatttaagcgctaaataaatacgttgaattcttaggaatttacttaggagacacaaaatatcataggttgaggaatagtcctatttcacgaataatatagttgatatagaattcgcctctcgcgctcgtttttcaatttggtctttattggattttatttgaattctaatggaattcaaatcaattcttcgcacgtacttgtagagcccgagggagttgcggatccgagcgaaggtcaagacccgcaagactttgagcaaggcaagtcatcactattctttgagcatgtcgatcccgattgcaaaatttattttgtttacaaataagattgcatgcaatgatgaacatcccacttgtgaaatatgccatgccttgattattgttcacctttaaatctttgtaaccatagatacgtacgagcccctagtcaactatgacaattgcttagaaatgctattttagattcatgcatgctcatattttatcaaatactatatgcttgggcaattacctttgggaaggtaattgagatgcggcatgtggaaacatgagcgccacattgccatgatatgatgacatgaattgtgaaaatagaaatgaaattaaacacttgttttagactggggccgacggtaagattgggtggtatctgggaaaggctagtaccgtccccggtcaattgaggaccgagccataaagttaagcatgaaacgaccccgtacaaccacacttctcgtatggggatagacctagcagagtaaatagctgagcggaggcagtatccatgcatagtggtttcttgatgtgtaaggcaggggctctacagtggtgtcaccattggtaggactgccatgtgataatttaaacataattataacttaatgcatgtgtgtgagtcttcccttcccggtgcgccagaactcctctcactgctagaaactgtgtacacctagagtgcatgaggatgaaaagttcatggagcgggtactgccaatgcgaggttatcgaaaagctttgccgtgatacgtctcatgtgttgggacgaggctcatgtgttgggcagtcgcggagtgtgggtaaagtgtacatccactgcagtgtgagtaaaacaaatctattcgattagccgtgctcgcggttattgagcaccgggacatgtattatacttggctagactctaaattcttaacttgtgtgggaagggttattgcatgatgaattttatgctgttggagccacttcctgagaagggggaaggtggacgttctcagaaaactatgacgactcaatggcgggaagctatccttgggatcacaatggatgatggacagaaccatcgttgtttaaatataaacactagtactaaaatttgatcagtcaatgctaggtcttaggcttgtgaaaagaattagaaaacttgctttgcgcaaaagaaccatagccatcctttgaaatacccctatcatgtgcattgttgatgtggtggcttgctgagtacggttggtactcacccttgcaaatataaacttaatcagaggccggagatgaagcttcggaggatccctatgcctattaccaggagggtgatgcagacgatggcgctcaataggtcttagttacggtcgttgcctgtggcaatggcatgccgctgctttatctatttctgctgtgggatgtattccggactgctcggttgtcacgctcggaaattcacaagtaatttccaaacttatttgtgcataaaatcctcgtccaggaatcagccgaggtacacaaactgacaatttaatatacagattcatcaaattaactaaaacgataagtacttacttaagaggcacttagtcctcaccaagaagaaaactgcagcggaaaataaaatctagcgcagctccggctccactcccacaggcagctcaactggggtataagccaaacgtcttctccttcgcaacctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaactccaaaccaggagctaagcaaattattaccagatataacatccataattattgtgagaggtgtgagactaatcacgaaaaacattgctcaacccgcccataaccgcgggcacggctattcgaatagttttactctagccagaggtgtaccactgtacccacaagacacagcctcctcatcatgtctaccatgcgtcgcgatactggaaagtacccgaatagaggctgtgacaataccctttgcacaacacaactcaccacagtgcaccattcctggatcataatcaccccctctataaatataactagaggcatggactccccagcgacccccacggacttctcgccgcttctcagtctggtgccccgcaatgaatcatgctatacagaaggtaaagccgttgcccatgctggcttgtggttggtacggttaatgtttcataacagtagctcgtgaaccggtccttaattgtcatgagcacgaccttcaaaaccatgtgctcacaacccaccattgtcaagttttagttatcaattaattatcataacacgattaaccatcgtgagctacgattaaaccatcattaaacaatgagtcataagttatcccaatagtgtgctaatgtttctaagcatggctaagcaatcatatctaatatctagctgaaccaatatataaagctcaactagtcaagttataat

SEQ ID NO: 67138 - DNA, 36757 bp, Oryza sativa
atagagttcgttcatttgatggatccaatggccgcttcagttttcgcctttatgatttcttccaatggatggatcaatgaatctttatgctttcttccaatggtggatcgatgaatgctacaaaaaaaaaaactagataggttcaagaaagaaagaaagtgaagagaggaaaaggatgtgtgcatccatgtagatcaagattcccgagcaggtgaggggatgagaatcgaacaacacacattcgctcactcacacgtactacgctacagtacgggacaatacagagtggcacagatcacagaacatgcgagccgccattgttaatttcaagcaaatgtaagaggcgcgtgggattagtcagcccaaatatatatatatcataccatttgatcggagattgattttgtagtgtagtgtagtcctgatcagtttagcacaccccatttagacacaaacctttgcagagttgggacaaattaacccgaactcatggcacctttggaacctaattaagatttctacagagttttcatatatagtagtttgattcctacgaaaatctttcaaaatcctcctgttccaaacgagcccttcagcttgctgcgcttacaggataaacgactgatgagtagtcgcatttttctgcaagatcagaaggccattttttatgactaaagctagaattttgtgagaaggctgaagagtgcaaggctgagtaatcaatccggatacaagcagtagcagttttagtcaaagacaagacccacccaggacaatgacagccaccatgttaatccttcgtttatcctaggtagaagtgatagtaataatttacccggcatacttcttttccatcctgacagcgaccagctccaacgtgtcaacaatccagtacatgctagctcacccacaaggccacaaactaaaatggtgatccaaaaccaaaatttcacttatcaattaagcaacttatttacttacagtaattaatggcgatggtatcacccactgtttcttgggcacgtacgtaaccccggacgaattaggttgctttctctggcgaacgatcaggtctctttctttcgtcttcaactgttgtgtgggctccatggcataattacatgtcactgttcagacacagtgacgatcagaatcgttgaacacaaattctatgttcgatgggcactagccaagcagccaagagtatgaaactctgaaaaagaaaaatggagaggaaaaaatattgagttgagcttgctagctccagaatatcacaggcgcttgtcgtgttatcttgagggtggttagcattgcttccatctaaccgatatgggttccactcaaatgtgacaactcatgagcccaacatattataagcaaattgcaatcctgtcaagaacaaagaccccatcagtgaaggcaaagggcaaagcaaagcaaatataatggactagcaatatataaaaaaaactcttcacctagtcacagaattgtagccacttgtacaccctgtgatgtgaatgcaagggttctgtcatcaagccgttgtccacgtggattgcttatcacttactcgtgtgacattaccttggatgagttagaatatacagaggcttttctcagtggatgcttgatacactccaataagagactgaaagactccaagcacgcagtttcaatttggatattcaactttagatgcgattaggtgtcaactccagataagttgcagatcattcaaaagatgagcaccacgcatggtagtacatcaatttactacatatctggaacacatgatttacgtaatactagtaataattaaaacaaagatttgtatggaattcctagagatgaaactcagtggaacaaacagggtcttgcactctcatcttcatccatggacgtgttgtactgggagtttgaaaccaatagcatctttgacttgattactgatgcacaacgactaaatgatttggactaaatgatttggatacatagcttttgggacttatctgggcaggcgtgactcgttaatttaaaaagctcccatgcttggaacaatccaaagactgagggtagtacagccatcaaagaagaaatatgagaaaatgatctcaaattattctcacatatctttcaaaataaacatatggactacatcatacgatcgctcgctacaagtcactgttacgtcctaaagatactctgcatctcatatatgcttatatacataatattccaggctgatgtcaagatcaaggtttacttctaatttaatgcagtcttgtattcataatatatcttccgtccccttaagttccattagaccatagcaaattccatggtagctcagtagctcaccatcatagtatccacgtcactttaggagaaatcaccaaacgatttaagtacctgaattaattgcattcatgtgataaactggtgataatagtcaaaatcataaataggaaagattagacattgaagcgccccaagtatacagatgaatttcctaatttcaactagctgacttcgaaagggaaatcgaccagccaacacagcataagacaaccgtttctctgtttaacaaaccagaaggcaatctatcctatgtactatataggaccatagactacattgcagaaagaatctaggggcaactgccaactggattagcaaatgaatggagtacacagcagtatccagtaggaccagaatgaggaaatggttatcagatcagacgaatgataagatataagcttacagatttactattaattgtcagttgcataatagtctattgactgatagatgaggcatggcattcctagtccagatggtgctactctttggataaaccaaaataaggtaaacacaactactcagcatgcagcacctaataagcaaccatttttcccttgagctagctgagctgcagataatttatgctcatgtaggatgatagattacagggttattacttcaatcattaggtaagctgaacaaatgatgtggcacacaatacgagaatacatacagatctattggtaagaaacagttgatacaaggaaatttgagttgttaattcacaaatcatacctaaagcaaagcataaataaaaatccttacctttgcagttgggtcctctcaatgctccggtttcactttaacatcaccattaggcaaggcgctttgggactgagccagctgttttgattcctggataaaaacaaaatatttagaaatcagttggatataaaaacgaaagaattagtacacccagaagaactaaatatgcattctgataattgaataatgaagcttgatataataccaaaagatgatcaccacaacattgctggcccattggaccagctatgggcattcatatgcaaatcctgaaacagaaactacattccagaacttacagcagcagcagtagcgcgtatctccctgtatgcttctacatcctcaggaaaagcttgctccagctcctcaagaagatgcttccgcaggctctgaaacaaacaagttgcaaggaaaataattcaatttgtattactaagtaagttcaaatgaaagacgatgtcaatttttcatctgaatacaggaaataattaaatagtaatgtaaaaggttgtaaaagatgaatgcctgtaaccaaacaccatataagaaaatagcagatgtttaacttggagaaatcaatcatggatcaaattatagtttaaaatacaaactaacaatgttgatactccctactacattgattcttatatggcatattttaatttcaaaaaggccaaactttgtagattttgatcaatgattagacaaattaaaggaaccatttagttagtgtataaaaagtatatcaatagctttgtactttaaagtgatctcacatactattggatttattactattatgagtataatttataagaaatcaatagacgaagttaatgttgaagacttcttcaaattaaaatacagcatataaaaatcaatggaggtagtttataaaacgtatccatgacacagactaatgcagatcacaactatatgcacctcataaaaaaaatatcaaaaggctaaaaaaaatctgggcctaacagttatacatctatcaataaatgctatagaagtattggatgagaatttccatctatttgtttcaatgaggaccatcaacttatacagctagatgtaccagtgataggaatctgtctagctagtacaacaaactttgtccccacaattcgcctaaaattaattagagcatattgttggaagtcaatgagagcaatacaataagcaaaatgtgtacttaataactgactagctagacagaagatactagaccataaccaatttcactgggttaaaagggattagtatatgctcctggatacggtttggatgagaatgtttgaaatgagataagcaaggctcttgctgattcttttcattcaagtgtcattgattcccttgaaactacatttaaaccttcttatctaaaaatcaacataagactaataacacgaacaataacaccccttagggcggggggagcggcaattgcagtttggatcaagagtttccctttgaacagatctaaatctctacttagcaactgccagggaatacctaaatctctacttagcacctagaatcaaaatagcacatgctatgtcagcattaaccaattgtaacataccttgaaagcatcggtcttgcccttagtgacctggttctttgcgatgcagctgttgagcacgtctcgggtgaactcgtcaggattcttcccgtcatcgatcaaactagcaaaacaggcaccaatccaatccaatccaatccaagtcatacacccagaaccagggggcgaaaggggtactgagatggaaatcgaaccaactcacttgacgacctccatggggacctggatgttgcatccctcggcgtgcttctgcatcgtgtcgagctccgccaccagcgagttcctgcggcaaacgagacaatcaccaaccaaaccctaagatttctccacccactcacacccgcacaggaagggggagagggggatttgctgggagaatctcacaggcgctggaggaggggtagctgggaggcggagctgaaggaggagacgttgaggttgagctggtggaggagccccagcgtcctctggatcgaggccatcatcagcgccaggttctgcttcgacgcgtcctccgccctctcgcccccgccccccgcctgcacgccgttccccgccgccgctgccgccgcggcgactccagatgcgttcgtggccgcgccgccgtccattccgccgcgatcggagaagacgagagagagagagagagagagagagagaagagagaccgagacttgacgtgtcggcccaatatatcagcggcctattgctgggctgacgtggacgtaacaccatcacgggctcttcccgaagcgcatgggccgcaactccctaattcgggcccagtttaactgggccgtgctgtcctaggccgagaagcatcggaagtttttctttttctttttctttttcttttcttgctatatgctacttcctccgttccataatgaactttctagcattgcacatattcatataaacttacattatgagaaaagtactaaaatttagggatgcaagtgggtagtcccgctatccgtataaaaacccgcttgctagttcatttcccatatagtagtataaaatttagaagaaaaaaataaactagaagaagcgggctaaaaaaacctatttgcccgtcccgcttgtatccctattacatacaaaagttggaaatattattagccatgcaaaggtaaaaatggagattgattggttggtgcgtgtcccaccatcatcaaatcataggttgataaccagtccatgtacagtgcacatacgcttcctcgtcggtattcatacgtgttacatatgacaaacaaacgagataacgagataagcgtcgtcactcggtcgctagctagctagatagcttaacttgctttgtttggaggcccgtctccatcatatccatccaatctgatctcatggccgctagctgcagggtgagtccgcagtgtgagtgatcagctgactcgatcgatgtgcatgcatggtgcatgcgaccggtgcaacgtaccgtacgttgcgtaccctgccctcccctgccggtatacgtgttgtgccactgccacgtcagtgacaacagtctcatcgtttggtcaacagctgatgactcataggaaaataaacaaaacaatagaataaataaagctttatttgtgttcttgatgagttaaaagtggatggtgaaaaataaaccatcgttaagaaaagaaattcaaaaaaccagctcaattaagttttagaacacacataaaactaatttgattgtggcttataagctaacaatcaaacaattgggctgcgagttttgggacgacgccgtacgtcgtgtaccatacaggtcatgtcatcagcaagagctggccaaagttgaggacgccgactcgcaaaccgatcgtccaagctaattattaagctagctaatcgatcgatcagtcgaccgatcgagagatcgccgtgtgattgcttacgtgcatggtccctgcagctagctaactagctagcaaaaacgtacaaaaagatcccatgaaaactaccatgtaccgacgacacgtacgttaacgttacgccgtggcatgggcatcagggcatgcaactaggtactagctcgatatctcagctgttggcgagctagttgtgcatttacacttaggacttatttaagagcttctaactactaaacaaaaaattggaaaacctagtttttttttaaaaaaaattagaaactaactatcaacgccgccagttactcctcagaatcttgagctctcgaaataagcccttaaacagctagctagctgagcacaagaacgacaaggccggccagccggctccctgtcgccgctttgtccgagtggccggccggcgagcgaaaggggcttgcgcgcattggattaactacgattatattccgacgattttagcaaggaaaagaacatcagcaaggtaacaaatttgcaaagatattcgcttctcgatcgagatctgtccggcaatcagctggctggccgatcgagacgatagctagctatagcgcagatcgccgtcagtccaaaccaccggccgtcacccgcacccacccgcggcgccacctttataccgcgattcgatgcgatgcgatgagatgagagatgcttcgatctctctctcccctcgccggcgcacccagcgttccgggcactgacccgccgcccaatcggctgcgatattcgccgtgcacctccgctcacggttgctagctagctttgtaccacccttacccgtgccgcccattgcatcatcgatcagtacgtacacaaaaaaccggaataagttcgtaccgcgtacgggcccggcgatcggtacatgcatatgcgcgctgctagtggatcgccgtcgtcgtcggcggcgtccgcctcgtacgtccacttggccaccgtgctggtgatcgatcgatcgccggatcggaggcaggggtatatgcgtagaggtaggcatctcgtcagacacaagtagcttgacccgtgtggcgttcatggcggggccccggggttggatctgataagatccaccgtgccacagccggcgaatcagccagctatagctaccctcgccggcctctgcatcgcattcgctcgtggctacacgtgcggctgcggcctgcgctgcggcacaatatctggaacaaaccggccactcgcgtgctccgccgggcgccaataataatgcaaaatcacctcgatctttacttgcacccggagccccgcactagtggagaaaccatctttggtcgctagaccaaattccacaataatactggttccattaaaaaccgggactaaagatgatttttagtccggttcatcccctgtcagatgtatgtcaggggccgaggatctttagtagattaccactttagtccgggactaaagattgatctttagttccggttggagttatcaaccgggagtaaatatttctctcccacatctgatcggttaagtcccagacagatatttagataagattggatcatcccatctcttcctcttctcgatccaatccccttcctcctcccctcccccctcttcctccccccttcctcttctcctcctcccctctcctccctcccataagccggcccttcctcctcctcccctctactccctcttccatcagccggccggcggcgggcggtggcagcgcggccgcgcggggtaggatggcggcaggctgcgagcggtggccggctcgtttgtttttttatatataatttgtgtttcactatatgtatatttttttagattttgtgattcattgcatcgcatggatctgacatgtataatctgtgatgtatttaatttatgtgtagttttttaggatttatgatgtatttgatatgtgtgtaggatttgtgatgtatttgatctgtgtgtatgagtaacttaatatttaggatgttgatttgggatatgcatcccactcgatttgggaaaaatatagggattaactctagccattagcaaatcaacaatgaaaaaaaaagacctcaagggattgccgctacccctcttcagggactaaagattacccctctttactccaaccgggactacctggattcgtagtcccggttgaaaaaccgagggttctaaaccgggagtaaaaaatatttctccaccagtgccggacggcggatcacagtgatcggcatcaagaattaccatatccacgtattaattccagcgtccaaaattaccaaagccactcaaaagaattagttataattactatacctccatattaaaacataaagatttttggaagtagttatataatattcgatagttttttgaatgaaaaactttcaactgcaactactatataattacaattacaatgtagttgtaggagtaccatgtaactacaatataagctatctgtgactcaaatgtaacttggaagaatttgatggagcgattggttatttcaatgagcatgtagtctgtaggtctcgggttcaattcttgtagtgagcgtgtggttttttttttccattttttccaccacagcacaaagctcaaagcatatcggacggtttaaagtttgctgcaggtctcgggttcaattcttgccgtgagcgtgtggttttttttttcattttttcctccacagcacaaagctcaaagctaagcatatcggacggtttaaaatttgacagttttcacccctgaaaactgtggtgaaaactgtcgacagtaggatagcaaatccgtttttagattgtacaaagatatttttaaaatatgtataattaggggcagactcacacctcagatcactcgggccatggcccgaagactgcccattaattatgatggatatattttcaccatgtaatcattatgcataggctaattaattatgtggatatattttcaccatgtaatcattatgcataggctaatgtgccttaccaattttttggcaacttaaatagtacatgtgtttggattgagcacaaccaattggtagtgcccatgttttatttggccaaattatagaagtttttcactacgataccaaaatttggcttcatattgatcccaatcgaaacaagaaccatataactttaccttaacgaaatattagtagtgctaaaatttgcctagattttggcactagtaataaattgttagggtaggatccaaacatgcccttaactcttttataggctagccctgaccatggaccaatcctagatcacttcctaggtggaactaaatgaaaaagttatgatttgttaagaacataagtagatagagaagttatattttggtataaattttaggaactgcctatatgacttttgacatgaaaaaccccctcaaatgttgtaaattttgaactattggatcactttaagatttgtgcaacatagccaaaaccttttctttctccttcccttcctcagtcccgcttgcacatgcgcatgcacactcctcctgcgccggctgcagcccggtctcatcggatggtcggaattggttaacaataccaagtcctctctctccggccggcctccccccttctctttcgcaaagctatggtgcccccacccaaggtcttacccgtctctagccgccggatccttcatcaccagtcgttgcctcctctacagtctcgttgtttgcccccgtcttcaacgccggcccactgcccactgccaacccccatggctccaacgtcgttggcccgtgtccaccacccatcataggtcctctgctgtctatggcgatccctctgaaccccaaggaaatccttcctcttccccatctcccaacgctcctacccaacctaatcttaaacccaaaccctaatctatgtctcctctgtcagagttgggaaatatcgtcggggccggaaagagggggagctcactaaagtcggaggataaaaagcttagccacaaaaatttagtgcggatcggatggtccaaaatctataagattttatttctaaatttttatcgaatgatatgtagcaaatatgtaaattttaaatgctggaggtccggatggagcgagtacgagcttgattagtaggggtggtcccactgcacagttgatgagcctaacccaatgactaggatggtatctatagtattaaataagttgccatctaaaatgaaaaatgatatggcaagtgaataaatgaggaaagagaaggaaaccatgtcttgcatgagacatggtttctacacaacatctaagacatcatgtggaataagtagcattaaattaaagtatggaatagttgtgtttgcattggaagagtagtgtctagcactagtttcttgatgatgtggagtttatggaaactatgtctagtgtcatgtgttgggaatgacctaccattctcaatccaatgactaggatggtgtccatatcattaaataaactgtcacctagaatgaaaaatgatatggcaagtgaataaataaggaaagagaaataaaccatgtcttgcatgagacatgatttctacacaacatccaagacatcatgtgagataagtagcattaaatttaagtatggaatagtgatgcttgcattgaaatagtagtgtctagtagtactagtttcatgatgatgtgaaatttatgaaaattatgtgtagtgttatttaatgaggagttacaaaatcttttcttgtaatagatcttaacctctggtagataacctagaaatggttatattatttgtggatggaaggagtacaatacaaggttagcatcaggatttgccaggtatgtgaaaagagagagctgatgatccaaatcaaaaaacttaattaacttactccccggaattaatcagctgatggatcatcatcactcatgctccttttagtttcttttgaggaaggcatcactcatgctgtcatccaatattggttgctgtttcttgctaatatgaacaaaacagtcgctatattatatatgctcgtaaaatattgatgcgttgtgagtagaacgcaaagaaaaaacaataggaatcgataaggactcaaacacttatctaattgtaagcgtcttaaaaaaccgcactgttcttttcgtccctcgtatgcactagtaggattcagaacttcagatatatttaatcatgctctcatccctcgagctagaataatatacaatgatgaaaactaacttgtgcttgacatagacagagaatgcagaattttcagatcaaacttactgtaccatacaagattagccactcacagctcatcgatgcaataattgattctagtttatagcttaacacctgatttgtttatggtaaacatggatgttttcctgcaatggaagcaatcagtgtcgatcaagcaagattgccacaacaagatggcaggaacggaaagagcatatctaaggaagaatcttgatttagtcactcctcttcagattaaaatagagttggtccatccatatccacaagccttggaggtgttgttcacccgttctgcattttttttttcgcgaaacctgttctgtattttgcatgtccctctcttgaccacatataactgaagaacgttgcttaattatttcagttaaacatgtagtcaggcaagagcacattatgttattgagtaagtgagtcacctagttgacttgccacgagtcattttcatgtgtttttaagaaatggacataatggtacaattaggggtgcatagggaaattaactaatcagctatacatactaattagtatagtaacaaagcaagcctttggcgtccacaggagactaacagaatctagctagcaacagatcagatattatctatattggttgaagcagctcttgtctgagagcatgtcactgcgtcacatactcgcatgtattgtcgatcgatcgattgcaagaagccaagaactggtaaaaacggagtagaaatgaatgcctgactacagcctgagtaaccccctatttgtcccagctgtttggtgtgtgatactatatgtgtacttgaaagttctatctttccaagaattaatgaagctgcgaataccactgaccacataacgatctgataattaccttgctgggcactttgcctgttctgttcatgctgcaccataactgaaaagatatcacacaaaagcagcagaagaatgttatgacagtgctgagtgcttgcctcacaaactcgtcacccttacgatcgaaatcatgagctaattaaaacaagtccagcgacaaagcatgttgatctctactattattcttaatttggtactagtacaaaatgtgacgtataattttcctgaaccatatatgtatgcaacaataatctaattaacacgcgactgcaattccccctccccgggttcgtatcctctgcatttgggaccaaaggcaaagtttgccgttggttccatccaggacatccatacgtcaatcaacggttccatagtttagcagttagcacccttttagtgactaattagcagctaattaactaatagagttgttctctcttaaaaaaaaatcaaggaaatgatctccagcggtaaatcaaatacaactaatacctgccttgccttttggaaccaactcaaaaaataagataaaatcaagaagcaaacaatctcaggacaagaaaaatcctttatttatacagtagtaaaataattatgccacgtccgtatgaaacatctagcaattctaatgctaaaatcctcccaaaaaataaacatttattttgaaaaaactaatctgtctttattgtacaagagtattttatcataagaaaattaatagacagaaccgatcttgttaattaattggactaatatatagaaattattatattatattaattaattagctgttaatcatctttgaggtgctaaaccatgctaccgttcattgaagtacggatggtctggatggaacaacggcgaaccttgcctttcatcccaaaggcaagacgatactgaccccccagtattctttttagttcaaattttgtagaataatataaatattcgtagggaactgatcctaatgaacagaaattcatccatttaggcaatcatatcctcgagggggtaatctaaacaaatttaaaattggactactagtgtgtgttaatcttagtatttactactccctccatcccataatataagagattttaaatttttcttacaatgtttgatcactcgtcttattcaagaaatttgtgcaaatataaaaaacgaaaagttatgcttaaagtattttagataataaagtaaatcaaaaaaaataaataataattcctaaattttttgaataagacgaatggtcaaacagtgcaaacagaaacgcaaaataccttatattatgggacggagggagtaaataacttgcatatgttcgtatccatgggacggacatgcatgataggtgcacacttaagtacctgacttggatcgagttgttttatgcatcaaccttgcattatttgaggaaacttttttcataccttaatgcaatatcctcttatttttacatgcatttaatattttttagaaacatagtataaacacaaatacttacaatgcgcgcacattcaccctatgaacctatgagggccttcattgataaagtcgacacggacgcctcactatcgatgggtacgttgcctaccacggaaagaataattagctatcaacgcgagcagccatgtcaaatctataatttaaaccagatgagctagttccacaacaagaaacctacccagttgagttacactcacttcgctatatgcacctaaattgttattaattttttttaaaaaaaatgacatgatatattaatataagatatttcatgtcacaaacgtaccaatttaaaatcaatatatacaaatagaaataaaaaaacaataaatttgaatgtgaacagtgcgtaccattcgcaacgatatttattatttttttataattgtctaagttaaatttaaatttacatatttgtgaagtctatcttgttaatattttaatttttatcacttttaaagtgataagtacaaaacaagggaatatcctcatggaatggatatatgtctcccatcactgtagtgatatttggcatggtgagttggtgacatttctagccattcgatatttatttagtaggagtaatcacaaagtttgtttaatggtgtcgctaaatgcgtgacgcggtactaatatatagaatgacattatgttgcatcagctgggactccctgcccctgccctgataacctgatccgtatatctgatcattatctgaagatgtctagctgcagctatgcacacggaagaacttgcgtagactttcacaatcttcagctcctcagacaacctggattttcctatggatttcgaaaatcaatagctatagtatttaaaaattgaactaaaaactagaaacggaaaaacttctcacccgctaactactcatctcttaacaatgaatcctctaattcctgtttggcacaattccagctccagctccacctccatcctctactagaaaaaaaacacttttaccgacgttaggtatttattttcgcaggcggacatgaccctcggagccaaatagccgcctacagaaatacaaaccggggtgaagctcgttgtccgcctgcgaaaatagacttggaatataaatagagccaacctatagggcctattttttttcaaagtcctcattctccctcattcctctcccgcgttgtaatatcccggcctagggcttaatagaattaatagaatattcatatcaacaagttacaacttcttttccggaagccgatctcgaaagaactttgaacttgtgttggtttgtgagggtagtttatgacctatgaaagctgatagatgtaagcggacccgacctggaagaggcgggacgttacaagtggtatcagagccgactctcgcggttacacaggcgcgtgtgtcgcagttgcacaggcatggggctcatggctggtgtggactcggagtggtcatacagcatggcacatgcgctggcactggatgcacggacgtacgttacaagtggtatcagagccgactctcatggttacacgggcgcgtgtgtcgcagttgcgcaggcatagggcgcatggctggtgtggactcagagtggtcacacagcatggcacatgcgctggcactggatgcacggacgtacgttacaagtggtatcagagccgactctcgcggttacacgggcgcgtgtgtcgcagttgcgcaggcatagggcgcatggctggtgtggacccggagtggtcacacagtatggcacatgcgctggcactggatgcactgacgtagtcaagaggggacgttcctagcctggggttgaccgacgaggacgtcggtgtcttaagagggtgaggatgtaacatcccgccctagggcttgatagtattaatagaatactcatatcaacaagttgcaacttctttttcggaagcccatctcgaaagaactctaaggttaagcgtgtttggcttggagcaatttcaggatgggtgaccgatcgggaaattcttcctgagagtgcgcagaaaagacttgtgttggtttgtgagggtagtctatgacctatgaaggctgccagatgtaagcggccccagcctgggagaggcgggacattacacgcaccctccccttccccctcccctccacgacgttgggcggcggcggcgcggctcccctcccctcccggatccggccaggggagggcggcggtggcggcattgtttgtccagaggattttcgcaggcgggtgactaggccacctgcgaaaatttatatatgggtgacgggagcctgcgaaaatgatttttggttgcctgaaaaaaatgatttttctagtagtgatctctcctgaagctggagttcaatcaaacagttttagctccacctaaaatgggagcggaactgggtggagttctctcacaaaatgaactagagaggtggagctaggtttagacagctcaacaacttcactcgagacccaactcctgtagttatttagaagttggagctctacaaggccctagggtatgtttggcacggctccaactcgagttttagagctcagccaaacagttctagctccacctaaaataggagtgaagctgggtgaagcgttctcacaaaataaagtagaaatgtggagttgtgtttagggtgttctccaactccactccaaatccaatttctgagctaaatttaggagttggagctgtaccaagggcatgtttgatacagctccaactactaaatataactccaggagttgagtctggaatggagttatggagctgcataaacccagctccacaactccagtatattttgtgagagctccacccaattccactcctagttttggtgaagctgaaactgtttagctgagctccagctccggaaggggtggagctggagctagagctatgccaaacagaccccaaatactactactagctgcttttaaaaatctcaaaactcttcaaacagcgccgttgcggcatttgccagaggacttcatgaagcacacgatcgaacgagcgacaaattaaacaagggatacggaggaagaggtcgatccgccgatgccgttgcattggttggtgagcagcatcatgcgcgcgcccacgcccgcacgcgcacgagccccgcgtgagcgacgcagcgacggcgcgtggccgggctagctgtgggcgagcgcgcgccgagccgaccagccgcgccccgcggcgcgagcaccatgctccgcgcctacctagtattccgatcgtagacaattacacaggccgacgcgacgctagcctctgcacctgcatgggcgcgcacgcctcgctgccaaccggcgcatccgtgcatggtaatcacgtgcaccccacgccgcctcgcccccctgccccttctcccgcacccctaccaccaccgttcgtgtacgtgtcaccgccgcttccctctctcccccgtccttacgcgtgcccccccactctcgcgcgcgccgtttcaccccctcaaaactttcaccagcttgtgccatgcatctcgccaattcgtccggttgagaatcctctacgtgaattctactcttctactgctttacgtgtcactgcctataatagtactactattatgcccagttcgccacccaaaatatctcgtcttttcatctgccgaatcgccgttgaaatgaaaacagctagtagtactactactcgtagaagtgcgttaaactgtataccgtcgctcgcgtcgcgcgccgttgacgactttcccgcgcctataaaagccggcgcctcgtccgtcattccgcctgtgtcaagccgaagcgttgagctaacgaacgagagtcgtacgtctctagacagtcgagtcaacaatagtcatggcgactccggaggacactggcagctggctgctctacctctccttggcggctaaatgctccggcgatggcgacggccagcctcaccggcttcttgggttcgtcgtggtttgcgccgtcgctggtctggttacatgtctgctgcactggtccttccccggagggccggcgtgggggaggtggtggtggacgcggcggcggcgtcgggggtcgccgtgcggtgtggcggctgttcctgggctgagggggctgccggtgatcggcagcatgtggctcatgaccgggctggcgcaccggaagctcgccgcggcggcggaggcggcgggggcggggcggctgatggcgctgtcgctcggggagacgcgggtggtcgtggcggcgcacccggacgtggcgagggagatcctgcacggcgcggcgttcgccgaccgccccgtgaaggagtccgcgtacgggctgctgttccaccgcgccatcgggttcgcgccccacggcgcgtactggcgcgcgctgcggcgggtggcgtccacgcacctcttctccccgtggcaggtcgcggcgtccgcgccccagcgcgcggtcatcgcgcgccagatggtccgcgccatcaagctgcagcagcggagccggagcggcgattccgccgccggcgccgccgtcgaggtccgccgcgtcctgcgccgcgcgtcgctccacaacgtgatgtggtcggtgttcggccggcggtacgagctgcagctggaccccggcaaggagagcgacgaggtccgggagctgagggccctcgtcgacgaaggctacgacctgctcggccagctcaactggtccgaccacctcccatggctcgcccgcttcgacctgcagagcacccgcgcccgctgctcccgcctcgtcccccgcgtcaaccgcttcgtcacccgcatcatcgacgagcatcgctcatctgctcccgtcgcagccgccatcgacttcaccgacgtcttgctctccctgcagggcagcgacaagctcgccgactccgacatggtcgccgttctctgggtgcgtcacgtcaccgaagaacccaacctttctcgccggcgactacctctgcatgttttctcatcggttttctgatacgtgtgcaggagatggtgtttcgcgggacggacacggtggccgtgctgatcgagtgggtcttagcccggctcgtgctgcagcaggacgtgcaggctcgggtgcacgacgagctgggccgggtggttgggctggaccgggacgtgaccgagtccgacacggcctcactcgtctacctccacgccgtcatcaaggagacgctgaggctgcacccaccgggcccactcctctcatgggcccgcctggccacgtcggacgtacacgtggacgggtacctgatccccgctggcaccaccgcgatggtgaacatgtgggccatagcacacgaccccgacgtgtgggccgagccgatggagtttcggcccgagcggttcatcgggaaggcggcggagttcagtgtaatgggttcggatctcaggctcgcgccgttcggatcgggtcggcggagctgccccgggaagagcctcgccatggccacggtggcattctggcttgccacgctgttgcacgagttcgccctcctcccctcgcccgacccggcacacggcgtcgacttgtcggaggtgctaaggctgtcgtgcgagatggccaccccgctggcggtgacagcgtggcctcggcgtgtggtgtgatgacgtgtccaagctacgtcatcagagatgctccttacaaagactacttgatggtgccttgtactccctccgtcctaaaaaaaactcaacataggaggggatgtgaccccttctaagacaacgaatctggactgactaacgacgcttagtccagattcgttatgttaggaggggtcatattcccttctaggctgagttttttttggacggagggagtagttgtagcatatgctttagatgctcctgccactacatatataggatgtgaagtgctgatgctttttggacgcctggtcagcctgcaccggcacaaaggccacaagggtgtgtatgctggcgaaatgaggtgactgagtgtgatatttttgttttgtactgttctcttgctaaatattaccctcggcttgctctgtaaattagtctcaatggtatggaattgtacatctattttactgccaagactcgaaatctccatttccttgcaatgctaagctgaactgtaactgatttggctcacaaaggaaggaccaagaacaatccctgacaaaacatctcaaccataaaattcaggagttaacaaaagcatccgacaatctgaagcatgactagatccaagcatatcctgaagacctgaacactagattttattccttcagagttcagactgtaaactagctaaccagccacttattacaactggtctgaactctgaattattcccagcttctttctctgaagatggcaaccgtttggggctcttggcagatagcttcttgtaaccgcgctacctgccatgaaatctgaggacaacaacttggcatccattcctacccaagcgcgtgcctctcttatctcccaatttcactgccgaaagttgccaagttcactagcgggtcgcttttctctcgaggcacaagttgaggcgctaagctacaaaactgaaactggcatcttgggtagaaaccgatctgtgaatccgacgcatgatgttttctagtaggaggttcagtttaagtcgatcggcagaatgtatcactgtctttgcttcatttttggtttctttcatgataaaatccagccgatcgaattgccgcgcaatcgcagtctatccataatccttaatatagcagtcagtgtttatttgtcactgaaatgtggggttgaaatggccaaatgttacacaggaacagataaggatcatgtcaagcatatgatatgtagtttttgctatgcagcagtagttaaaattgttgcaaccaattactcaagtcagtttacttttcactcatgcatcatgcatgctactacatcaccaagacaggaagcactattaattggtaggaaaatcacatgataagtacagcatattattgatgagagagcacctagtgcatgctcaggattctttaacaactctgattagaagggttttaggctttcagcaagtgtataatgtatacgcagaggttctgatcgactgagtcacagacccataaatccataattaattctggaaagggattgctcaagcttttagaacagagattaaactcaccaaatcaatcatagtgcagcaattttgctgttgtcagacgatctgtgtccacttgctgtatctcagtccaagtttgtggtcagattagacagttaagcagccggactgattgattgtgtagcttagaacgactcagattgatttatgcaggcccccagctaagctacacaatttacatatatatcatcattagtatgcagctgtttcgattttgcccaaaagatgcatcatgatcacgcaggaacaacatggcttcacaacaaaggatagagcaccttacgatggtctgtactcctccctccgtcccataatataaggattttgaatttttacttgcactgtttgaccactcatcttattcaaaaaatttatgcaaatataaaaaataaaaagttgtgcttaaagtactttggataataaagtaagtcaaaaaaaataattctaaaattttttgaataaaataagtggtcaaacggtgtaagcaaaaactcaaaatcacttatattatgggacagagggagtattatttcactgcagtattatcaccagcagaagtgatctcaatcattcaattgtgagttttattactagtaaagaaacatatattttattataagtagttgagatggtagtacagatagaaataaatacgatatatggattaggaaagatgaagtcgaaattaattctaatactactataaaccatctccaaagggttattattatctttagaccttttatgaataagaaaatctacaggacggtgtttgtgcaagataaattaatgagatacttatcctttcctcttccctcgctccatcctcctccgccccctcctgtattttcccctcctcctcctatgctcctccttctagccgtagacaactacttcgtagaaatgcttagcgatggtggagcaggccaatgaagccagattataggctagacccttcccacctactggatccggccgagtgcacgtcaataacaagggcggttgccagcatcattctcgtggcctcctccagttcatactttgaggcataacggcatccatctaatctggcttccatggcgaaagggggcgaccaggaagaaggaatgacatcgagaaagatgccaatcagcgcattgtcgatggtgatgcaagggagaggccaataaagttgttggacttggagtttcgattcacaacaacatggtggtgagcccatcgtgctccttgccggtattttgtgcagttgcggtgcattatccttatctggtacctatggtatcacagctgatacctacggggtatcaagtctatcagactgtcactagcacctcctctcctcttctcccttccccttggctcaacccttgctccctgttattgttgtcgtgacgagcgtcattgccaatagggatgcaagtgggtagttccgctacccgcataaaaacccgcttgctagtttatttctcacacgatattacaaaatttagaagaaaaaatgaactaaaagtaagataagcgggctaaaaaacccacttgcccgccccacttgcatccctaattgccaacgtagccgctgttggctcaaggtgcggggcgtgagtgcgtggagtgagggtaggattatgctagactacgagtaggagcggatacatggaactacgtcaaccttcataaagtatcctgttcggacgatatcccatgctctagcagctctctttatgaacagaaccatttgttaaacatacggtttggtctatctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcgcttgaagcatgtgtggtggagagaagaggggaaacacacgcgcgcgctcgctcgcctcgcctggcagggcagggcaggcggcgcgcgtgcacgacgtacgcgtcgaatggtccgaaaaattggctcctcacccttgcgcagatgcagcctccttttgcagttttgttttgttgcaaattcggattcgtttttgttttggaaacgttccgaaagatccggtgcgtgcaaacggcgtggagtccggataagttacgcgcgacttatccggttcggttacgcgcaatagagatcgtgcgggcgccctgatcaagcgacccttctctatataaaccgacctgccgtcttcacgcaacatacaaaaaaatcaatctagggtttgcttcctactctgtactgcgccgtcgctcgtagactactccatcccgctcgccggcgtgcaccggcgatcgggagagcaggtctccggaacctctgccttcgacgttctgcaccgggagaaggcggtaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctattcatgttatactgtgtagtttacatgtgtagatctaatgatgcgttcatactagttttcatctgtaatgtcatgatttatttatggaatagattaaatcattatatgtctataatctcaacactatcaactacgagaaaaaaaagacctgcataaaaagcaagttgtgtaatcatattctaatagtcactaaaaaagggcagatataaacacaacactcagaaacagcaaacgcgagacagcacacttttctctgaaagtaaagaaaagctaggaaaactcttgaagctgttgctatcgttattaggtctcgacgtccatgtcgagccatcgagtgtcacacacacacgctttcctgtactatgttcagtgcatgcagtacacacttgccactgaaaatgcagcactaaaaacaaacagttacagtgtatttttaaactgaaatttcactggcgtaaattggtcacttatcgagttcaaaatttcagaagttttccaatttatccaaagtataaattttgaattgtatggtgtaagattagcggtagaagttctcacatttaggccaattttgaattggagcaaaagcaaagaaaaccaaggatttgctttcctatgtatttaaccactgtaacatcgtttggatcaacgtaattaatggcacaaaggaaaatcgaaggaaagcataaagaaagtttccttccctgtctattccagaggaaaagaagaattcactcagagctcttgattttcttttcatcccttaacttttcgcataatgtttgaccattaattttattgaaaaagttagtacaacgttcgcacaacattagcagcataaaatcctctaaaattcttaatttttcatatgttccattcaaatacatatttatatagaattattgtgtttttcaatattctgttttacacgggcgttcctatcggtttcatttctttttcttttctatcatgtatctaatcctccgatcatttcagtggaaagcatcgtcgacaagcctatccgtttggtgtttggagctcggacactagtattctgcagtcacaagtgcaaccttatgacagtgcaatgtaatcgagtgaggtcagctacactgtgaggagtatgtttggagcaaacaatttttcttttttgtagaaattaatttcacagtaagattctgtcgaaagcgcaggagaggtcccataagaatttgacagaaactaatttaatttagtgccaaatatatacacaaaggcggttacaaagtacacaaccatccaaaaatatagctactttagtgtttaaatgtccctagtatactccctccatgccatattaatcatcacataaaaaaaattcagaaatttcaaactgatcgtcacataacactgacatcttcatttgacgtgcagtattattgtctatacatgcaaattaagtttgcatgaaatgggggtaattaattagaacggtcccaaccctccacatgagctaatttctatagcattaaagagtaaattgcacccatagtacaacaatttagcgggtggctgtgatatagtacaagaacttaagaattaaacattcgagtgcaacaacttgacaagtgggtgtgttctagtaaaagaacttgacaatttagtattttggtgcatcaacttagctaagcatatgctaggtgagtttttttttcacgatgtcaatatgctgttacatagcaatcctacagatattatcttacaatattaaatttaatctttaagaattatactgcacatccaattaccttcaagaatttttgttttcttcaccttcccaaatctcaaccgaaatataataatttctacatccagtttaattgactttcagttattagttattagaataaaaatataaatatacttatatacaaacccacgctagtatattatcaaaataagtacttaaaaatctaatatgtgtaaaaatgtgctccaaataattaagttgttgaataacttcttaacttattgtatcaaaatcatacatatcttgtaagttgttgtatttatacgatcacttatgaagttcttatactaaattgtacttatctgccaagttgttgcactagaacgctcatttctcaagttcttgcaccaaattgcacccacctgctaagttgatgcatcatgggtgcaatttactcatcattaaatatattgtcacataagaaaaaaataaggtggcaaaagagttaatgagtagagagggaaaaaagatgaagaaaccatttttatgcaacaaactagttctacataaaaaaaagaacaaggggataggaggatgaggagagagaataaaggtgattggacaagaatattgtcagggttatggataagtcataccctctatccttagggtcatgagacatacggatacggtatatccataagtacacgaaaaggatctgtataaatcaaggaaatagtatttgtgaaatggaaagtaacagagtcctactcggagaggattaggatatagtttggtcgtacggggtccgttgtctccgacttctacttggagactaaggtgatctacggtataaatacaaaccccctaagggatacagggtatcaaatcttagtgcaagacacctgccaccatagacgcaatccggaggacttgaagcctactcgccgatagatctcgttgaacccctctcgacaaggatctcgtcagtaatctcagagttcagtcgttctcttctgtactctctgtggtttcttccataatcttatataaagtggattagcgctattaccttacgaggggtctgaactagtataatcattttcttcttgtatgcttgatgtcgtatcgtttagatcctcgtaccaacgtaccccaataccctccaaatacgatccgcgggtatcccccgtcgacaaatatattttgaagaaactacttattgggtacatagtttctatatatagtgtctatatgataaggtaagtatggaaatcactatatgatttctaggttgggattgcccttaagcactctttccttgtgcatatgaggaagtttaagtctatatgtttcttgattattctctaccactttttgtacaacaggtaagtctttcgttacccagcttggaaaccaagcccaagagacaacataagtgcatacatgaaaagcagacaagagaaccttgctgcactaaaagtgaaaaaaggcccaaaagggcagaaccatagtaaacaactacactggggctatgtcacaccccaaagttctttcccaagcctaaattgaagttataaatggtctcaaaaaaatacttgtgtaaatcaagagaaaaccttaataaattaatgcaaataataatcagaattggcatgtggaatttttcttgagttctacatgtcgaaatacgctaacaagatttttagtggaattttcagagccctagaaataattttaactaattaaaattgagcaagcaatattttaattccagggaaaatccttttcttcctttttctttttctttttcccccttttcttttcgagtgggccgccggcccattccccttcctcctctcccctccgctgggccagccgaaggccaaggcccagctaggccggccgcctccctcctcccacccaggacgccgacaggtgggccccacctgtcgggcccgtctcctacctcgcgcccgcgccgccgcgcccgcaaccgtcgccacgcccacgcctccgcctcctccgggccacgtcggtcacgcccgcgcatgcgccgcacctcccgcgcccactcccctctctctcccgcccgcgcccgcgcccgagatggctgggattcgattttcgaatcccgcctctctctctcctctcccactcccccacgttggccggcggaatctcgcccctaccggccacgtccgggactcccctcccctatttaagctccgccgtcgccccctctctctttttccccatttcgtcgaactccctcttgctccccatcgctcccgcgccgtgcacccacccgctgccgcctttcccgccgctccggccgccgctagccgccgctaggctcgccgccgcaccgcgccgtcgtcgccgttgggttcgcaaggacgaactccaccccgtccgcccttccttcgtcgggattcgtcgccggaattcgcatcccctcgcgctccggtaagttctacctctaccgccgccttcggccatggatgccggccgccgtggttcatctccctctctctaatctctctctcctccttccttagggcaccccgaagcccgtccgccggttgccgtcgtcctcccgtggcttgccgtcgccgttcgccgtcatcttcctccgcgccggccaccctcggtgaggcgtcctctcccctttactcccctccctctccctcctagtgccgcgccgccgcttcaagtcatgcgccgttgccttcggccgccaccgccgcctcccgtgccgccggtcgccgtcgccgtcggccgcgtgtcatcgccgctagccctggccggccggccggctttgatgctgagccgagcccggcggccacctctatcgccaccgcccgatcggctcggggccgatctgggccgtcggtcccgtggaccggcggtggatcaccctgtggtcccggtccacggtggaccgcccccccttgagccgctgccgagtggggcccacgtgccgccgccccttcccctctctcccgagccactgaccagtgggacccacccgtcggcgccgcccccttgatgatgtcagccctgggaattattgcgcaataaatgatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgaaatagtcgccgaggtttctccagcagcagagcaaggcaagtcatgcttgtcacttgatcatgttgatactatattgcaaatgttctaatgttttctttcaaatactacatttgttttgcaatatcactatgggatgtttacctattgttacagccatgctattttggtaccctgctccttttttagcttgggttataacatgaatagacgttggactaggagttgcttagccatgcttagttcaactagtacacagtggggaaaatcctattaatgtttagactgtaggttcatatgataatgttggtttagtaccaccgctttggtgttggttaattaaaatgaatcacacggtgggctgtgggtgcatgattttgctagtcgcacccatggcagttaaggaccggttcgcgggatgccctggaagaacttatcgtacttaccacaagccagtgtgggcaacggctgggcttgtagtgtagctttcctctagctgacgcatccaggcaagggtgggcgtgatggagcggggcgggccctgcgacggcctctgtcgcttctggattcacctaggtacgagaggggactgcccgctgccttgcgaggagtgggggtgaaacctgaggtgtggtgtgcttggttagagggggttatgcaaagggtcctgtcacggcatctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtataggtggatggttgggcctgttgcaacgtgggatggcgttggacagccgatgatcaatattaattaattattgcaactgtttaattctttcaacttctgtttataaatgctcgctttatgcaaatgaaccactttagctctcttttgataattccctacatcatacccctattccggtatgacttgctgagtacagtgggtagtactcagtcttgctctattttccccaaccccagagtacgagtatgtgtcagatggaggtttctccgaggagtaggcttcgtccgtgccatcgaggatgcctgtggagtggtgttcccgctgcagttctagtcaaggcttagctcctgttgtctttcgtttttccactgtatttatgtaagacttttatgatgtttgtaagatatggatctgaatgtcaacattgtcgtttgtgtaccccggccggtcctggacggggattttaatacacattctgcttggaattctattcgggaatttctgggcgtgaccacactggggctaccagctatccaggacaacatagaaacacaagaaaacatactcatattaaatgaaatgcatggaagttaagccatcctcatctttgatgaaaaaaacttctatgaagatcaaataggagcggagggagtagctacctagaattgtaaaaggtgattttttttttcacttactttttcaccctacccctagcaatctatatcaaaccaactacctagccttagaatataataaatttttaccttgcaccataatccttaatctctccaaaaacaagctagatacttatattttgagacaaaggaagtaggatttagagttataacatatgcaagataaaaaaatatagtctgactcttatcctaaactctcccttaatagagatacaaacacaatataactgcatggggacagtaacatatgcaagggaacaatggcaagtggttcaagcagattgagatttgttgataccttgatacactgtaattatgtcagattgggaaagagtgcttgcaattagtgtctcagggatgtatgttttacccagtattcacctagacgctaaacgctagacggacggtgacccatggtatagagtctagctagtctagacgatatgccgtacactatattatcgtcattttttttatacacttaacatgttccataaatattgaagaactagcagctttatataggtacaaccactcgagtaaagccatgggccggacaaatatgcagcaaggtccacaatgacgaatagcagagaagagacgacgtaagttaattgcagtgactggcttagagtagaggagaaaggtttggaatgaggtcaaaaccttaaaccatatgcactttggattgggctcgaagttttaactcctgccacacaaaaaatgcattggcccattgcctaggccatagtctaaaacgacaggtttacaatttacacttgtctatatattgtctaattatgtggtctagatagtgttcgaattggttttgactgactggacagtcgaacagtctaattccaagttaacccaacatttagggtctagaccgtctaaactatatggtctaggcgaacactaattttacgttaacctcagtaacaaatattatatgttagtatcttcatagagtcccactccggtgctttctactcggagtataaattaatctaaaccgttgatcgttttatatctaatgggtcagatctatttatactcctatcttaaatagcggtagtagaaacgttagagggtataatcgtccaaaaaatatggacgggatggttgaattcgtaattttgcatatcagttagaaacacttgagcatcgttgggccgtgctaggtttagggtgagtgtggcggagcagatgcgatgagcagatcggcggcgtgcttccatgagatcgttgcgggattacggcgggggatcagcctcgggaggctactccttgcccagcggctcaaatgctagagatcagtatgcgttccacgccaggcccgagaaggagacatataactagcgagcctgaagccctgaaccacgacaagaagtcagatcaattcaacgatttcaacgccatcgaagccaatcaatattacggtgttttgagcatcgctttgaactgagcaaatgaccactctgaacttaaatacttcggtaccatcttggacaaatttagcgatgttaatggcttaattctttaagaactgaaaacacaacatgtggagaaactaataaataggttttaaagataatcatggtgagtttataacagcacatttgctcttgctcctcgatttgactatatagctttgttcagtagttctttgtagtattatctgttcaacggaggagctcgcacatgccggagtgggcactgccgccggagtcgggcgcacgcgagaacgaaagaagcggtgacacagacgaactgatcctactattaagaaaaaaaagtaaaagttaaaaattacccttaaccataaattagtaaaatactaatttgcccttataaattaatggctcagattgcttctacttgtagtagaatactacaagtagagagcaccatagcagtgctcatcttcataacgattagatttccatggtatttttttcgcgtgcggctattgaggtctatatcggtgctggtttttatagaaaatgggaaaatgcgttgcaatccaaacaagagaagacatttttctggtgactcgtcagctcagcgcatgggcaaagccccctatctcgttacaatccaggagtactagtgtttccactcggaacatatgttgctgccgcacgatgcaaggtggaaacagacagagaataatcgaaacccaagctaatgcttggtcaccacctgcaaatattactttctccactctactaaagcctcagctaagctttgttcctactgcacttttgcagtgctgtatatagctgtgcactggcatatcactaccagggggtgatgcacaaaaaggtttctggctcaaatgatcagagaattgaagcgcacacacacgagaagagactccagtggtgagacacttctgatctctctgtcccccattgcaagtttgcaacctcaaatgcagttcaatccccacacgtgcaaatgcagattgatcgaccaggccagtgggtatgtaggtgtgtagccactgtgtagtgccagttgaagcaatgatatagctcatcagcattcagcaagatgaatgtttcttttcgaaatgtttatcagattgatgaaacgaatgatttgtttcatgctttaaaagatatatttttttataaaaaaaatttatcgtattgtttggatcatgtacttattttaagttatttattaagtttatttgttaaaatattcaatttgtccttataattaagtagatcagccgcagcaacaattcactcagggctcattcggttcacaggattttcaaaacgtaggaataggaaaaacgtaggaatactataggaatacatgtgcaaacctatggattgagaaacacaggaatttttcctatgttgttgagcaatccaaccaaaggaatgcaaacattaggttggagtggattattttttcctatgcttttcctttataaatggaggaatggaaaactttcctatagtttttctatggtgcattcctataaaacgaatggtagtttaaaacccattcctattcctatgcttttcctttgcaattcctttgaaacgaataagcccaatctttcaaatttaaagtattagtagacattagctcaccatgcatgccaatccacttatcagagaagcagataggtgatactgccgtatcttctgaaccgaacctctgatttgaagttgaacgaaccatcgatccaacccacctgctggtgccgattgcgcaagtgatcgaatcactcatcatctccaccatgcttgtgtctgtctagacagttaattactcccacattttaaattacttatcgctttaggattatcccaattcaagcattttaatctctttgaataatattttctgtaaactcatatagttttacaccataagatttatatttttaaattcaccatacaaatacttttatgcctataattcacatgttattgaatcacacgaataaaaattaatggttataaatatatttgatttaggataaattaaaatgataactataaataatttgaaacgtatggtgtagctaacttagacatgcatggcagcagctggatgttgttgctataacatgtttgaaggcatagccagattttcttgcctaagagcatgttggtgcagtactggcttcatcttcatctctcttgaagttggggcctaaccaaacaatttcagttccatctaaaatagtagtggagctaggtttagactgttctataactttactacatacctaacttttggagttaaatttaggaattggagttctaccaaacggaacttaagattcaactagtgtaatttacatatttttatctttatctcatactatatttggaggttttgaaatatatggtatgttcagattgtactcaaaataaactttatcaaaatttgacaataccaaaattttgacaatttagcaatattgccaggttttggcaggacttcttatatatttatcagagtttgataaaaaagaaactaaatagatgcacatattgaacaacttaaaaaaatggtatgatttgaaataatatcgatatgtacaacctcataatttgtaatggatatctaggctcaggaatatatagggtaatagggctacacagtagcaacggcatctagtgtttgaggggagagtcgatgaggcttccctgtcatacagttcacctgcagggagcccggacgcacggtggcttgccggctgtcgatctcgccgtcgccgtcgtgctcgcatgtcagccatgggagctgtagctagaggtagacgacgtacgaggtggcgaccgatagctaaagctatagctgtagctagctgcagatctcgatcagttgacgcatgagatgagatcgagagatcttcagtagcgcgcaggcttaggtgcagggtgactcgactgtgtcgcgatatgatcgctttggtcgtttgagctttgatgaagaagccgagacttgcaaagcggtgggcagtcgagaggtctcactatcgacggtgtgcgctccgtccttcgtacgtatgccatttgcagagggttcacgataaatccgaaatttcagaaattttggaatgtatatttcggtctgatataatttcaattttgagatatttaactatttgccatacaagtgataattaaggatttaccattagatccacatgtcataatctgaataaaattagctaaattcacggatatattagaatttcggatgctatagtttcgttcctgggggccgaaatgttgaaacaaaatttcgaaccctgatgcaatgaattgtattgcttgctgatccattttcgaataattgttagcgttgactatcacattttcatttcctatttttactgtaataaatggaagaagttttatgcctatgtttaagatatatgcaatatacatatacttcgataatatagtattttcttaaatatttgtattttttaagaaaaaaatgagagattaaagtttaagcatgaatagttcagctacaagttatttaaaaatggagatagtatttcctttatattttaaaaactaaactcttaaataacttgttttaaaaagtatcaataattgaaaaaaaatattatagaactattgttcatggcatggaatgacaacaatgatttgccatatcattggtctcttaagtgacgcaacaacattattctatctcaacattacagtaggcaaatggttcagatttataaatatgcttaagaggagtttattttaaaattatatttaaaaggttagaaaataaaatgaattgtacatgcatattttacatatttccatgtaacttggaaaaaaaatacgccatgaaattttgtacgccacattggaaagttgtttagaaatatgaatccgacaacaaagttatgccctacgacaacttgtggctaccccaacatggagagcttcatcatactacgatttgatatgttccttgtcttgtcactcagggcaatccaccatgcggcagaaagaagacaatcgaaacgtgtacgggatacccatatatatctgatagactgttagcagaatgctgtgggcttgttttgagatggttactacagtagtagctagtttgttttatcaaactcttagaaaagaaatgtaagataagctattactctccctgtcccagaaagattgatgttctaaggattataggataaattagctcatgtgtaaatttccaatttatcctccttcatcaaaggtggtttgagtggttgagaaataacaataaatacgcacatgcatttaattcaaacaagtggacaagaataattcaagtactatatgatccgacaaaactggtatgataatctatataggatattttgtgagtataaaacgatcgcctttacgggacagaggaagtagtgtattactaaattttattctccatctcaatataagtgcaacctatggtggatgaaacatatactagattcgtagcactacgatatgtcacgtttatcctaggttacacttatattaagacggggggagtaaataacttgtatgataccttggccaaattttgacactaacccatgtatgatatactaatttgtatccttgatttacggagta

SEQ ID NO: 67139 - DNA, 9555 bp, Oryza sativa
gacggcgacggcgatgacacgcggcgacgggcggcgacgtgacggcggcgcggggctcgaggcgatggaacggcagcgcggggctcggggcggccacgcgcggggcagagtgggaggggggttagggctagtgacctcaatcgaacacctttggggcaatgaacagtgacttttcctatttttccaacttggttgtttttcctattcaaatcttgtcccaatatttctaatttttgctcaaatcaagtttacacaatatttgtgttgctctaacctagattatcactacccatattttatttttatttttatttttaatttattcgaatttaattagggttaattcttattccatcgcacctaaatttaattgttaccaatatggccgcgataatattttatttatttccaacctcacctaatctatattttaattagttattttgccaatttaattttagtgtttattcctaattaattattccttattcgcgatcggtaaactttgaaaccaaattccaataaaataggcaaataaaatcagcatgatgcaatttattaaaaagtttttgaaggcccatatttttagagttttgattttcgttggttgaattttcaggatgttacaaacctaccccccttaaataaatctcgttccgagatttcttaccggtcttcgaacagatgcgggtattctgtcttcaagaattcttcactttcccaagtggctttatcctcagtgtgattactcaattgtaccttgtacatatgccacactttggccctagtcctcttttctacttcatccagtatccgaactggatgctctgggtacgtgagatcattgctaatatgaatttcctccaacggagcttgctcctccggcactcgcaagcacttctttaattgggacacatggaagactggatgcacatcggcgatgttttctggtagctgtagctgatatgcaacttctcctcgtctagccgtgatttgaaagggtcccacatatcttggcgctagttttcctttgaccttaaaccttttcgttcccctcatcggagaaacctttagataaacataatctccttctttaaattccaggtttcttcttcaggtgtcggcgtaactcttctgtcgtgattgagccacttttagacggtctcgaatcaggcgaaccttctcttcggcctctttgataatgtcgggtccaaataccgcacgttcacctgtctcggaccacattagtggagttcgacatcgttgaccaaacaatgcctcattgggtgacatctttaggcttgcttgaaagctgttgttgtaggagaattcggcgtagggcaaacatctctcccattctttgctaaaatccaatgcacaagctctcagcatgtcttccaggacctggtttgtcctttccgtttggccatccatctgcggatgataagctgtgctaaaagcaagataacttcctagggcttcatgtactttttcccagaaatgcgaggtaaactgtgtgcctcgatcagatataatccttttaggcacaccatgaagacacactatcctggtcatgtacaactcggcgagtttagcactattatagtttgtcttgacgggaatgaatcttgccgtcttggtgagtcgatccacaatcacccagatggaatcataccctgttgtggtcttgggcaacccaactatgaaatccatacctatctcatcccatttccattcgggaatcctaaggggttgcaacaaacctgccggcctctggtgctcagccttcaccatctggcatacgtcgcagagcgctacgtattcggtcacatctctcttcatgttgggccaccagtaaccctccttcagatcctggtacattttggtacttccggggtgtaatgaatatgccgattcgtgagcctcctttaggattaatcctctcagtccaccctgttcgggtacatagatcctctttttgtaccatagaacacctttttcatcggttgaaaattcctttgcacatcctgcagctaggcgtcccttcacctctcggatttcctcgttgtccttctgggcttcttctatttgggttctcaaaagaggttgaacgtccagggtgtttatctatccatgaggtactatatgtaggtttagttgagccatctcctccttaagctcaggaaccatcccttccgtcctcagatgatggcaatggctcttccgactcaaagcatcggccacaacgtttgccttgccggggtgatagtgaacctctagatcgtagtccttgattaattccagccatcgccttagcctcaagttgagatctgactgggtgaaaatatacttcagactcttgtggtcagtgtagatatcgcaatggtttccaatcagatagtgtctccaaatctttagcgcatgaaccacagctgcgagttctaggtcatgggtggggtagttttcctcgtgtggtcgcaattgtcgtgacgcataggccacaacctttctgtcctgcatcagtactcctcctagtccttgccttgatgcatcacaatatataacaaagtctttcctgatgtcgggaagaactagaataggcgccgaggtcagcttttctttgagctgctcaaagctttcctgacactgttctgaccacacaaacttcttttccttcttgagtagttgtgtcatcggtcgggctatcttaaagaacccctcaatgaaccttcggtagtatccggccaagcctagaaaactccgaatttcagtcacagacttgggtgctttccatttcgtaacagcctccactttagcaggatccactgctactccaccggctgaatcacgtggcctagaaaagcaacttcttcaaccagaactcacatttgctaaattttgcatataacttatgctttcgaagtttctcgagtaccaatcgcaagtgctccacatgctcttcctcatccttggagtagattaaaatatcatcgatgaatactaccacaaatttgtccaagtaatccatgaacactttgttcataagattcataaagtatgccggggcgttggttaatccaaatgacattactgtgaactcatacaatccatagcgcgttgagaacgtggtcttgggtatatccccggtcctaattttcagttggtgatatcctgatcggaggtcgatcttagagaacaccttagctcctttaagttgatcgaagagatcatcaatccgtggtagtggatacttattcttgatagttacttcgttcagtgaacggtagtctacacacatcctaatgcaacatctttcttcttaacgaatagcactggggctccccaaggtgacgaactggggcgtacaaatcctttttcttgcaactctctgatttgcttcttaagttcctccaactcattgactggcatccgatatggtctcttggatatgggagcagttccgggtatcaggtcaataataaactctatgtcacgatctggtggcatcccaggtaaatcctctggaaacacatcaggaaatcgttgcactacaggcattcctttcatgggtagcatggtgaatatgcctccggcatgttcggccagtctaggatcttgatccatagttgttctcatatccgatccccaggggtggtcaaggtaacttttctacgcctacagtcgattacccctctgttctttgttaaccaatccatacccaatatgacatccagggtctgaggtatcaaaaccataaggttggagggaaacacaacatccctaaggcgaatatgtacgtctatgcaagcatgactcacagttatctcgccctcaggtgagtgtaatatcataggctttctaagtcccactagggttaagttgtgcttttgactagccttcagagatatgaatgaatgcgatgcaccagaatcgaagagaactttaaccggggtagaattgatagaaaacatacccattagtatgccctgatcttcctgggcctcttcagctcggacatggttcacttgtccgcgcccaaatctggtagcggtcctgttagtttgcggagtcttgaatagacctcgtccggcaatagggatagtagtcccacgaacagtcattgcattagcgctagtacggacaggagttttgcgtggatgagggcagttgttggcgtagtgcccatactcctcgcaattgaagcagtccacattcttcttggctccaggggcagccagagttggtgtaggggtgcggttctgaattgcaaccggcctgttgaaattgctaggtgcggcggggcggttggtcgccacaatagggggtttccacccagacgaagtggctcccttgagtcgctgaggcactccctgaggtgggcgattcatagcaagcctcctcttgcggttgtgctctacagtcctttggtcattctccagcctaacgactttgttgatcaggctctggaagctctcatggtcttgcccaatcataggtccacgcaattcatcattcagcccttctatgaacttgtcgatcttttcctcttcatttgcaaggtctccaattgcatagcgggccagctgagtgaaccggttcagatattcctgcaccgttgtgttcccttgtcgcagccttctgaactcgttcttcttcatacgcattaccgcagcaggcacgaagttctcgcgaaatgctgcagtgaactcttcccaagtgggttctccagcatcctcttcccgagcttccttgtaagtatcccaccaatcaccagcgggtccctccagttggtttactgcgaagatcactttgtcggcttcgcgcacccggataagggtcagtttcttctctatgatacgtagccaatcttctgcctccataggctcgtctgtcgtagtgaacgtgggtggcttggtgctcataaactctccaaagcttgatccttcgtggttgccttgattgtttgcaatggcttgcagaagttgggtttgagtggccataactccggccagggtggttaggtcaggtgtctgggtttcatcattgctggttgacgcccgacgtcggcttgccatctgtgtaggtcgattgagtaagtatcctaatctcctaactggctcttatggttttatctctttaagggaattgtcttgatgtgaactttgttttgcaagcatggtggaataaactcatttacaacacaacagcaataatatcataaataacatcacagagttccacaaatagtacataaatcgtgatgcaatcgactgcacacatacgcagtccaaataaggttcatccaaaagatacattgaactaatcatcaaactactcgtcgatctaggtaagggggggtgtctcgcatgctatccaaaaaccatatgaagcgagatcgaagctgcaaatagtcctccagtctagtcatccaaccatccgcaggatcctggggcaggtagagggtggttgctggcacgggcaaacctgagtccccacggcttggaggtagtggcctctggatctggcttgggcttcttgcccggggatcgggtgctcttgcgggcaatgctgagggtgtgagggcctccgatgaaggtgatgcggggaacaggggtctcatcctctgaaggatcagtgatgtctggctcgatctctggctcggtgtcggtcccctctgtctcggagtcgacctggatcggagtctccatactggaacccagctgtggtgacggggtagggaccagtggggtgtgcacaatctctggtgcaggtggctgtgtcactgtcgtgtccactaggtagggtgctgacttagtagctagcatgccaatctctcccagaagagtgtggaatgcgggtggatatggcggggtgaggaagaagtagcggtcacgccctactgctgtggaagtagaagctcctggggtgctgaccgtggctgctcgaagctgctcctccagctggctgacgtgctcctgactctctctcagctgctcctcaagtgtattcatcatcccgcggcgattgttgtactgatgagataactgctggaactggtcgccgtggacctggagctgtgccttcagtgagtctatctcactgccccaagcctggtgcacctcccctagctgaagctgttgcactgtgaggtcagtcacctcggtctccaactctcccacaggcctctgctagtcgtcgatctctaacagagcctcctcgtagaagtcgtctactgcctcagcccatcgtgacagtcgagtcactatcgggttgtagcagcaaggtgtgtcctgaactgtgcagacggagttactctcctctcgaaacgggtggtgagcaaactcagtactcgccaactcagctcggtggatagagctaagtcggagaaaggcctcccgggctgcatcctacatcgcggtctctggtaagtcacgacggtggcatgtcggaaagctatagtctgactctgaaggaactcgtgtgtgaacctcgactcgggcctcccaaacggatccacactgtctcactcggtagatcggaaatctggggtaccgtagacgcctcatcaaccgatgcagctcaatgacgtatccctctgagcggggtacgcccatcatccaggtagcgggtgaatcctgatctgccatctaagtttaagaaaaacccaaagtcagctgagagtaaaacttgttttgtgaagaaaatagttaagagtaagatgaaaatcgtatagagttttgtgaacatagcatttttatttttgaaagtattactaaatgggaatttctcccttggccaacttagaaaagggggtggggcgccttttggtcttttcctacagtcgtatggctctgataccagctctgtagacccccgtttttataacaggaatcaatcgtgtaaacagtaccatttccttggatcaagtagtctggtacacacgagttcatagccgagataccaaacgcacatacacgagagtctagtgcaaattattacaacataagcccgcaggcgtagtcttaaatcatcggaccgagcggtccggaatacatcccaaaagcagaaatagataaggcagcggaattaaggcagcggcatgccattgccataggcaatgaccgtaactaagacctattgagcgtcatcgtcttcatcaccctcctggtaataggcatagggatcctccgaagcttcatctccggcctctgattaagtttatatttgcaagggtgagtaccaaccgtactcagcaagccaccacatcaacaatgcacatgataggggtatttcaaaggatggctatggttcttttgcgcaaagcaagttttgtaattcttttcacaagcctaagacctagcattgactgatcaaattttagtaccagtgtttatatttaaacaacgacggttctgtccatcatccattgtgatcccaaggatagcttcccgccattgagtcgtcatagttttctgaggacgtccaccttcccccttctcaggaagtggctccaacagcataaaattcatcatgcaataacccttcccacacaagttaagaatttagagtctagccaagtgtaatacatgtcccggtgctcaataaccgcgagcacggctattcgaatagattcgttttactcacactgcagtggatgtacactttacccacactccgcgactgcccaacacatgagcctcgtcccaacacatgagacgtatcacggcaaagcttttcgataacctcacattgacagtacccgctccatgaacttttcatcctcatgcactctaggcgtacacagtttctagtagtgagaggagttctggcgtatccgggaagggaagactcacacacatgcattaagttataattatgtttaaattaacacatggtagtcctaccaatggcaacaccactgtagagcccttgccttacgcatcaagaaaccactatgcatggatactgccttcgctcagctatttactccgctaggtctatccccatgcgagaagtgtgattgtatggggtcgtttcatgcttaacttcatggctcggtctttaattgaccggggacggtactagcctttcccagataccacccaatcttaccgtcggtgccagtctaaaacaagtgtttaatttcatttctattttcacaattcatgtcatcatatcatggcaatgtggcgctcatgtttccacatgccgcatctcaattaccttcccaaaggtaattgcccaagcatatagtatttgataagatatgagcatgcatgaatctaaaatagcatttctaagcaagtgtcatagttgactagggactcgtacgtatctctggttacaaagatttaaaggtgaacaataatcaaggcatggcatattttacaagtgggatgttcatcattgcatgcaatcttatttgtaaacaaaataaattttgcaatcgcgatcaatatgctcaaagaatagtgatgacttgccttgctcaatgtcttgcgggtcttgaccttcgctcggattcgcaactccctcgggctctacaagtacgtgcgaagaattgatttgaattccattagaattcaaataaaatccaataaagaccaaattgaaaaacgagcgcgagtggcgaattctatatcaactatattattcgcgaagtaggactattcctcaacctaagatattttgtgtctcctaagtaaattcctaagaattcaacatatttatttagcgcttaaataaatctaatttcttaccgcaaattaattactcatagagattaccaaaatataatttaattttgcaattttacgactataattaatctatacttaaatcattaattattttaaattttctatttttattaacctccctatcctatttctcttttttttctttctttttctctcctctcattctttttctttctttttctctcctctctttttccttccctttttattttctttcttcctcctctcccttccggcttctccctttctctctctctcggctttttgcccaccagggcggcggcggcaatggacgcgagggggggggggggggaagatggctcaccggcggcggcggcgcaaggcggcaacgctcggcaccacacctggcgcggcgcggcggcttcgaggcgacggcgcggcgcacgaaggcggcggcgcggcggcacgacggcggcggcgcgtggagaaggaggagaggggggggaaatggtgaggatgggtgtggggtggagaaggggaggggccgagttctataagggcgcgggggaggggtgggcggcctcatggcgacgcgacaggcggtgcgcggtgtggctggcggcgatggcgacgggcgggcggcgcggcgcggggctcggcgcgacggcgacggcgatgcaacgatgacgggcgagcggcgcggcagggtgcggggcgcgaggcggctactcgacgggcgagcggcgcgcggggcgcgtggcgcgaggcggcgactcgacgggcgagcggcgataggacggccgacggctacggcgcggcagcggcggcacggggc

SEQ ID NO: 67140 - DNA, 19150 bp, Oryza sativa
  unsure (1)..(19150): unsure at all n locations
ggaacgaagctagggttcacgggagagagagagagaggagaccgggcgggaggaaggagacgaccggcctggcgcgtgggccccacgcggtcgggcgcgcggtcagcgcacgcgcgggtgcgtgcgcgggaggggagcggctcaggcaggggcgcggcgtgggccgggcggccggcccaggaggagaggaggggaggggtggcccggggagagagggaggaggagggagtgggccggggaaggagggagggaaggagagggagagaaaaagagggaggagagagggacttcgggctgggcttggcccaaaggaggaagaggatttatttttaggtttttctttttaataaactttgataattgtttttgttgcttaataattatttccggtgttctgaaaattcaagtaaaatttgagggctcattttagaccaaggagaatttaacaaaaattctccgggccacatttgaatttttcttgtacgtattttagtgtttgccaatttcttttcgaattttaattaattctattattccttttggaaaatgatttttatttcgggatgaatttatcaggacgtgacaaatccaccccccttacaagaatctcatccccgagattcgaggaggctagcatgaagataggttgggcggtattctcttcttgtctgacttcttccgtcgcgtcttttataacaaacttgcctagcaaaacttctccactctaggctgcttggctcgatcccttgttgtagatggaatcttctcttcacctgacttgtccctggttgaacctttagctgacttcgactgggttgcggcacttgaagatggggcttcagttccagaacttcgcatagttcatatctttggagtcaacctcatacaagttacccacttcatgtcatgcgtcgagatcagctcgtcattactaggataccatgcttgtcatcatgagaataccatgcttgtcatttacttctaacttgccaccaactgcctcatattagctttcctgctctccgggtgctagctacttctgctattcgatgcaagggtcggtaactttgcctttgaattatgtttctaaaaagaaccaacttatcccacttgacatgctttgacgtctccccaaatgactttactactggacctgttatggtatgatcgttatcctaccaaatctgaagcttcgttgttagatgtgattttaatctgacctctgtagactatcttcgaacatatcacttggttcataactgggaatagctcccacgaacaagcaactcggattcactttctttatgtttagtttactttccactattctcttcatgttgtcatcatttagcattcaacgtattcctttacaccttcgaccttgatgagttccttcccattggatcatctcccaagacatggcattgcctggtaaccggtgcctgcacttttcactccgtgtagcatctgataccgagttgaagatttcactccttgccttcatagaaacacttttacctaggtcatcttgcttactcacagatttatttttttttctctcaatgacaaggtgactgttgcagggcgattactgtcaggagtcttccttgtgtgatgcagagcatgtttctgattatcctttatcaatcacctttcggcctacgtctttcctgctagagaacatcttggccaacctcttttatcaatcatctttcggcctatctctaacaggtggtactctttaatgtgggttgcggacacttctggtggcgatggggtcctttggtctgctgcctttcagtgaaaccttgaagtgttttcgccaaaagctatactgactgtcattgcctttgatccgaaaaagacacgtgtgaaactcttagtccaaacaaatgtctctttggttaatcgcttgattttcttttccatcatcaggttggttattaactcgaggttagaacatagttcctctgaaatgagaccctaggtctcctttgacagtaaacaattatacacataatcccatatcagcatcttctgaaagagtcctcatagaacttgtttttattacacatttctcccatattacatgaatacgaggcactaccttaaacaaaaagggaaggtgcttaacatcggtacattgtatcctcaacatgaatcatccataaacatagtaaactcactgtttatagacatgaatatatttatttattacatgattgctgcaaactttcgattacacaatgataagtagcgaattgaaaaccacaaacgtggctgctcattttgattctggagagatatagctggcattgttctagtaactgcatcatccttgattggttctgtgatgatgtgataggactgcatattgctatcattcacgggagaaacttccttctgattgctgtttgaagcagataacggtcttctgcttggtatcgccctcctgaggttgattgcccttcgctcagcctagagtaggtcggggagagaaacaacttcttccatcgacgacaattctttgctgaggccgtaggtgcagagaatggttggtgctgaaggtattattgttatgatttattgcagagtcaggtgcagcaggaggagcattggtgctgtggatgatatcgtcgatgttgctgttggagctgactagctgatgagacaatcgtagggttgttcgttggatttctgcggtcttggtcaacaacacactgagttggcaatccgtgggcacatggtttgtaccttcgcacagaaaacatgtgaccttgtgggtgggacattcacctggcggatggtcttcttcaccatgagggcaaagtgtgagacacctgctagcaatgtgtccaattttctccacaacgggtgcatgcctttgattccatctcttcctcgccgagatgtcggggagactcttcttcatcatccgaggagacttgatctgacccttcactatcagatactctgccaccatggcttaggaggtgctgggtcaactatcgtgcacctcggaaggtatttcctctttgacgtctaggaataggtatccctgctggaggccattcggtgttggtaatagtcatcttacgtacttcttcttcagttcgcatcggcgcttttctcttctgattcttactcttcttgcctttggcttgcttagtacgtgaccccacgtggtacgaaaggctaggaggaaagcatttcccgggattccatggattctctccattgggctctctactttgcacactaggctgcaagcttgacttggtgtgaggaggctggtttagcgatgtctgccctgctaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatagtgattttggtcttgacttccatccaatggtagctgcgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacttattctgcaagttgattaagcaaacaacctagcatggttacatcacaccccactgatgcaaaccaagcgctacacacacaagcaaggaaacacacaactaacgactctaccctagagggtggcttaggttctgcgacgggttctccaagatcttcactccttcacagctggcttcactgcttcctccacttcgctagcggatcctacagtcttctggagcttcggcaaacaactgacgatgtcttcttcttcactgacctgaccatccagtactagttgaaatccgaagaaggaagaagggagtaaacattttgaaaatagcattagggaaaggaggaaaaggaactttcgcaaatagtttcatttataaaatatgtccttaggttttatccacttggcttatcctacagtcgagacggctctgataccatcttgtcgcgaccgagaaaattgcattttcccgaacgctagtgtattaatccccgtcccaggaaaagccggggtacaccatacaaacatgatataaaatacacatctttattatatcgataatatttacattattacaaaggcacttaaggcctgacaatcaaaaataaacagcagcggattagcgggcctatggctccatcttcacaggcgctcaactggggtgtaagccaagactccacctaagacatcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacggcatttaaaaatcacttagttgcccaaagccattttaaaaagacgatcctagagctacacagtattattaatcaaggtcgtgaacccgcacgaacctgccttaacccaaggcctacgatgattcagaccgaactggcaacccgaccctgggtcccagctcgtcccaagccaacccaggccaaccattccacattttagctgttaagcaaattttaagaattaaaacactaacttgggtacattgctcggcttgcccataaccgagggtgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggtaggcaggattgagcccctagcagcaggacaccagccctgtaccatgacatctcgactaccgggccacatctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacaaaagccaaccattccaaagtatccaagtgatatgaatattcccaaagtctaaagttataaaaccacctaatgttgcctaattaatcagcgaagcatctacctaaattcatactagtggaaccatgaatagagtacccactagttggggttttgtttaatctagggtgaacaaggtaataatatcaatagcaataatattaaggtcataacaaaggtaaataggcatggccaaataaaacagtgataacgcgggaatttaaataaagcgataatgcaataatttaaatcaaaataattttataaactgggattcaatatgttcaaggatgatgtgacttgccttgctccgggagaacggccttccgaaccttcggcgacgaccacgaaccacgcttcgggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaatgaggttttgcaactataaaacatgtggaagcgctagcctggaaaagacaggaaggctgcgttgttgacatgcggaccccacatgtcaacctaaaggaccacggtagaccgagtacacagagacggtccacgggtcgacggaagcggaccccatgtgtcaaccgaggcgagtggccaacaaacggactccactagacaccacacgggctgcacatgtggaaaccatgctgctactgagcggacacactaacacggacaccacacggtcaccacccgcacacgtgaacgactaccgacacggtacacgggtaccggggtcgacaaccgcacaacgggtacggggcgacaccgaaaggacgagggcggggcagcgagaggagagaccttaccaccacgcgacgaggcgtgagaacgacaacgacgaacgggcgcggcggagacggacggcgagggaacgacttcggcggcgatccttgaacgaaggcgagacacggccggcacgaggcttgacgacgcggaggcgaggacgaagacgacgacggctacagcgaccttgacgaaacaccgaggacggacgagaacggcttgacagagggacgaacgccacgacggccgggaacgacgggaggacgacgacgacgacgaccgggaccggcgaggagacgacgagggcagccggcagcggctgcacggaggcgaggacggcgtggaacacgccgcagcgatgcccacgacggaggcggcgccgcgagacgacgaaccgggcgaggatgaacggtgaagacgacgacggataccggcggtgttcggccgaaggggaagcgatgccgaggacgacgtcgcggctgcgatgccgaagatggtggaggtgtggccgaccggtgcacgggcgaggagggacgggcggccgaacaactccggcgaggcggatggagaggttcgcggcgatgtgcggcggcttccgggcgaaaccgaggggtggacgaggtggagggctacgtcaccgtgccgagggagggacggcagcgccggctgatgcacgggcgcggcggaagggggctgccggaggagacgtcgacgaggaggaaggagaggccggcgcgggcgacggcgttccggcgaaattcgggcgacgccgtggcctggccgggaaagaggacggcactccggtgccgggagaggtggtggcgacgtcggccggcgcacaggggacgcggcagaggcgggcggaggcggaatcgtggcggcaacaccacggttgccggcggggaggcacttccggaggtctccgcggaaaacagagggtaggccggcgaagaggaggcggctgcgatgctggaggaggcgacggcgcgaccggacggcgctccggcgaggagggagaggcggctggaggcggccggaggcacgggagagagaggaggactgcggggagaggtgatacgaccacggggagactcgggatgaggttaaaacgatagaacggaggatggggattccattttatgggatgggggagggagccggccacgggaggagcgggaacggcggcaggaaacacggccggcggcaatggaaggcggccgggaatggcgcggccgttcccggcgattgggggcgccattcaaggggaaattaagggggaaagagagatgagggaaaggggattaattccccccaattaattttggaatccaacgcttaaatcgcgcggattcaagggaggaacgaagctagggttcacgggagagagagagagaggagaccgggcgggaggaaggagacgaccggcctggcgcgtgggccccacgcggtcgggcgcgcggtcagcgcacgcgcggcgtgcgtgcgcgggaggggagcggctcaggcaggggcgcggcgtgggccgggcggccggcccaggaggagaggaggggaggggtggcccggggagagagggaggaggagggagtgggccggggaaggagggagggaaggagagggagagaaaaagagggaggagagagggacttcgggctgggcttggcccaaaggaggaagaggatttatttttaggtttttctttttaataaactttgataattgtttttgttgcttaataattatttccggtgttctgaaaattcaagtaaaatttgagggctcattttagaccaaggagaatttaacaaaaattctccgggccacatttgaatttttcttgtacgtattttagtgtttgccaatttcttttcgaattttaattaattctattattccttttggaaaatgatttttatttcgggatgaatttatcaggacgtgacattggggaatcaatatcctgaatgagaaaagaagggaaaagaaaactcttcagggaaaattggaggagctagataggaaagctttagaagatgacttatcccctgaagaatggaattagagatatgaggtggaaagggatctagaacacacttataagatggaagagttgtactagcataaaagatgtggagaacaatggatcttggagggggataggaacactgagttttttcatagggttgctaatggcaggaaaagaaagtgctcaataatctctttgatggatggagatacagagctgactagtaaagaagatataaaaaaaatcatattgtctcttattacaaaacccttttttagagctgatgttttaactatacccacttggctcgagatatctggagtggcggtctgaacctttctgctgacaacaaagagagtttgattagacccttcaagattgaggagttagataaggcgcttcaggaggcaaaattgaacactgctcctagtccagatggttttagcatccttttttgcagagcttttggcctcaagtgagaaatgatttgtttgagatgttgcttatgtttcataatgaggagttagatctcaagagactgaactttggggtgatttctttgattcccaaaaacaattagcccacagacattagacaatacaggcccatctgtgtgctgaatgattgcttcaaatttctcagtaaagtggtgaataacagactctcagaggtagctaatgatgtgatttctcctacccaaacaaccttcattcctaggagattcattcttgagggctgtgtgacaatccatgaggtgttacatgaaatgaggactaaaaatagagaagggattattttaaaaattgattttgaaaaagcatatgatagggtcaaatgggagttcttgatagaggttatggaaagaaaaggtttccctcccaaatggattaattggattaagtcttgtgtgataggggccgggggagggtctgcattaacattaatggggataggactgagttttttagaacctttagaggccttaggcaaggggatcccctttctcctctccttttcaatctggtcaatgatgctttagctgcaatgttggataatgctaagagaaatggagttattagtggcttggttcttgagattgttcaaggggattacccatttacaatatggtgatgatactgctcttttcattgctaatgatgtctctcagattactgccacaaagtttatcctttattgctttgaagagatggctggtctaaaaattaattaccacaagagtgaggttttcactatagggttagaggaatctgatactattggagcttctcaaatgcttaattgtcctataggtcactttcctatgaaatacttgggcttgccaattagccctgagaaggttttaaatcctgattttgatttcttaggtcagaaactagagaagagattgggaaattggggacctggtagtctttctcatgctgggagagctgtgcagattaatgcttgtatgtcctctattccttcttatgctatggggttctatcttcttcctgaaggggtgcatcagaggtttgacaagataagagggaggtattactgggctggtaacaaattgaaaggtaaatatcacatggtcaaatgggaagacatggcttttcctaaggactttggggggcttggttttactgaaacaaggaggatgaatgcagctctgctggccaagtggattattaagttggaatccaatgatcagagtttatgccttcaggtgctgaggggaaagtatatgtaggaaggtggtatgtttcagtgtaaatctgggaatggttctcaattttgaaagggtttgttgaatattagaaagtgagtgcagcttggtgctgaatgggttttgggatgtgggaatcatatctatttctaggaggatttctggttacacaattgtcccttgtgagttatgtatccaaatattttcaaaatttgtaatcaacagaaggtgctggttgcacaggtcattcagagaggtgtggagtgtctcactttaggaggtcctttggccctatagaaagtgtagaatgggacaacctgaaaaatgacatagagaatgtgaatttgagtaatgagcctgacaagccgatttggggtttagcctctaacagaagattctctaccagatcactatatagagctttaacttttagaggtattagagaggtgaactcagagttgtgggctgccccctgcccaatgaaaatcaagcacttcctctggcttgctctaaaagatagaattcaatctgcagagaacctgaaaaagaggggttaggagggttttgaattctgtcaactttgtgggcaaattgagactactagtcatattctttttaactgtggcatggctaggatggtttggtgcatttgtagagatgctttgggatggggttccatccctcgaaattttgatgagttctttctattatgccaatgtgactgtaacccatcttctatgcatctgtttatgagtttgcttgcggctgtttcctggaatctttggctaactagaaacaatatggttttcagagataagatcttgtactccccactaactgtcacagcctgatttttcgttttaggatttataaattatttaataaattattaatagaatttatattaaatgttctttaatttacaagtgaagttaaatgtgggaaataaaattttctaaatataaagcatggatggatttaatttttaaattctccatgattaattatactctctgaaattttctcagatttttcggagctcaattcctaaatgatacaaaggacagttcagtaattagttaatcaataatcattaatgatttaattataattatgttaagtgcttttcttgtttaaaaatccttaaattacaaattgttgtttaattggaattagtagaaatgatcttaaaagcttaaaagaaaagatctaattttaatttgttaaattctaagataaaagtgggctagataaaatttcattaaatactttacttgattctatagttcctaaatttttctgggatttatttgagccaaggaagtatttttaataaatggaattgcatttcatgaataatttaaattgaaaaaggttttaaaatctccctttttgttttgggccgaaagtcggcccaaaagccctctctctctccccggcccaagttagcccaccagccgagccgccgctcgcgcgcgcgctctcgctcgctgacaggtggggcccacctgtcaggaccttcttcctcctcgcgccgtcgcccggccgagctctagccgagccgcgccgccgtctccttccaaatttggtcgcacctttcctgctccggccaaatcatttgaggggaaataatccccttgatctcctctatcttttcctctatagaaacttcggataaaatcgtttggaaaccgatggatttgagctcgattcggattcgtctctctcctctaaccctaacctttccatcgccgtcgccggtcgctatgggcctccgtcgccgcctcctagcccctataaaagcatccccgggacctcctccgtccgccgccaccctcgccttagcccgccgccgtctgtagcgccgcctccgcgtgagatcttgcgccgccgtcgccgccgtttgtccagccgtgcgtcgccgtcgctccggtcgtcgtcgtcgctcgggaaggccgccgtcgtgatcgccaagtcgtcgccgtcctcgtccacccctccgtttccaccgaggatcgccggagcatcgccgtcgtcgtcaagccgatcgtcgccgccgcttcatcctcgtcgccgtcgtcgtccggttgtcgtccgccgccgttcgtttctcggtaaggttcgccgcgtcgcccactacccgttggtgtcctccgtttgcgccgctgcgccgtcgttcgccggcgagcatgcaaggctgagccgccgccggtgatgacgtcaccgctgacgtcatcgacgccgtccgccgtagaccacggtagaccgagttgatctcggccgtccgttttggataggatagatctcggccgcccgttccgtagaccatcgccgtgcactcggtccaccgtgagccgagcccactgacgcaataattcccttttccgtttcaaaaataattctttattgcgtcataattcaattaaaatccatataaatgttttaatccggtttaatctttaaaaattcataactaattcatattagctcggttttagttggttcaagtctctaaagttgtataaaataaagatctacatattaaaattatccataaattgaattaaatttatttaatcctttttaaataggctttaattagattaaatcttgtaaaattcgtaattatttcatatgaagtcagaatgagcccgttcaagtctcataattcatctaaaatcatgatctacacatttgtttactttatatgtattgtttatttggagtttcttagtctttttccttgttttgcgttttagcttgtcgtttccgtcgtttcgaaggttcgcgagtgcgccggaagtattcaagaagattaattgaagacccgttattgcaaggcaagtcacacagatcccaaacacagttcctttgagcatgctgatcctatatttaaattctctatttatttcaactgtgcatttattttttaatgtcatcgggctctgtagacccccgtttttataacaggaatcaatcgtgtaaacagtaccatttccctggatcaagtagtctggtacacacgagttcatagccgagataccaaatgcacatacacgagagtctagtgcgaattattacaacataagtctgcaggcgtagtcttaaatcatcagaccgatgtcacatcctgattttttcgttttaggatttataaattatttaataaattattaatagaatttatattaaatgttctttaatttacaagaaaagttaaatgtgggaaataaaatttcctaaatataaagcatggatggatttaatttttattaaattctccatgattaagtcaactctctgaaattttctcggatttttcggagctcaattcctaaatgatacaaagaacagttcagtaattatttgatcattaatgatctaattatttttgttaagagcttttcttgtttaaaaatgcttaaattataaattgttgtttaaaaggaattgttagaaatgattttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaagtcggcccagtccgccgagccgccgctctcctctctctctcagccgctgacaggtgggtcccacttgtcagggtcgtcgtcctcctcgcgccgccgccgccgcccgaaaccctagcgcgagccgccgccgtctccttccaaattcggccgatcctttccttctccggccgaatctttagagggaaaatgatccttgagatctcctcttccttttctcttttggaatcatcggctaaaatcgtttggaaattcgtggattcgagttcgattcggatcggcctctttcctccgaatccccgatctttccatcccgccgccggtcgccgtgggccttcgccgtcgccttccaacccctttaaaaggacccccggtgtctcctctacccgccgcctctctcgccttcgcctaccgtcgtgtgtagcaccctagcctcgtgagcttttgcgccgccgtcgtcgccgctgctccagccgtgtgccgccgccgtttcagctatcgccgtcgctcgggaaggtcgtcatcgtggtcgccgtcgggatcgccaagtcgtcgccgtcctcgtccgcccctttgccgccgccggagaccgctggagcaccgtcgccgccgtcgacccgatcttctccgccgctttgacctcgtcgccgtcgccgtccgttggtcttccgccgctcctttggtcaccggtgagttcgtcgtgccgtccgcttcgtcccggtgccttccgttcacgccgtcgcgccgtcgttcgccggcgagcgtgcgccgtccgagctgccgagccgcccgagccgccgccgccggtggtgacgtcatcgctgacgtcatcgtcgctgtctcccgtgagccgccgtggacccgatcgatctcggccgtccgttttggatagggttgatctcggccgtccgttcccgtgaaccgtcgtcgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattatccataaattgaattaaatttatttaattctttttaaatgggctttaattagatttaattttgtaaaattcataataaattcatttgaagtcagaatgaggccgttcaagtctcataattcatctaaaattatgatctacatgtttgtttactttttatgtattatttctttggtttttattagtctttttcttcattttgcgtgatagttagtcgtttccatcgttgcgaaggttcgcgagtgcgccggaagtattcaagaagattaattgaagaccgattattgcaaggcaagtcacacagatcctaaacacaatcctttgagcatgttgatcctatgtttaaattctctatttatttcaactgtgcatttattttggaatgtcattgggtggaattaacctattctttgttatggcccttttgttcttgattactttattccttgataccttgggatattataacttgactagttgagctttatatattggttcagctagatattagctatgattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgcaaccacaagccagcgtgggcaacggctttacctttgtataacatgattcattgcggagcaccagactgagaagtgcgggaataagcccacgggggtcgctgggagtnccatgcttgtttataaagggggtgattatgatcaaggaatggtgcactgtggtgagttgtgttgtacaaagggtattgtcacagcctctattcgggtactttccagtatcgcgacgcatggtagacatgatgttgagnctgtgtcttgtgggtacagtggtacacctctggccagagtanaactattcgaatagccgtgcccgcggttatggacgagttgagcaatgtttttcgtgattagtctcacacctctcacaataattatggatgttataactggtaataatttgcttagctccggtttggaatggataattcctggtttggagattagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaataatcaatcaacctcagttgaagacaagttgcgaaggagaagacgtttggcttataccccagttgagctgcctgtgggagtggagccggagctgcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaagttggtatcagagccatctcgactgtaggataagccaaatggtcaaaccttaaggactaattttccgaaaacatgatttgtgaaagtttctcctttcttccttatctagaattctttgcaaattgtttcattgtctacttccctctctctttcaacttgagtagttctgaaactagttgttgaaacttgaagacgccaatgtggtctacttatggaggttaagtcaagtggatcgatgaataagaaggtgatggtcgatctgaagtgcccagatgtcaagatggaatgaagtttggatcctaccttagaacctatgccgccaatctatccttgaagaatagttagtagggaagagcgtttgttgtttgctttgtttgtaggtatggttgcattcccatcattggagtagttcattgatgagtgtgtaactatactaggttgcttgcttaatcaacttgaacaatataatggtctacgcacaccagatcagtggtaacctggttaaggtcttgtctttagtgtaacctctctccttctatcttctctaatatgcaatagatggtgaacactcgcgccagtggaagtggaaacaataacaatgaagggaacccaactcttgctcaagtcctggctcaacagactcagttaatgaacatgatgatacagcagatgcagaaccagctcaaccaagggaacaacaatgctccaccgccgcagaacaagttaactgattttcttcgtgtaaggccacctaccttttctagcactaccaacccagtagaagcaggtgattggctacacgctgttgagaagaagttggaactgctccagtgtacggatcaggagaaagttgttttcgcttcacatcagttgcaaggacctgcatcagaatggtgggatcatttccggatgaacagagcagaaggacaaccaatcacttgggaagagtttactgaaggattcaagaagacacacatacctgtaggagttgttgctttgaagaagcgtgagtttagggccttgaagcaaaaggatcataccgtggcagagtatcttcatgaattcaatggcacgttatgctccagaagatgtgcgtactgacgaggaaaggcaggagaagttcttggaaggcttaaaggatgaactgtcagttacgttaatctcccatgactatgttgattttcagcagctggttgacaaagcaattcgacttgaagacaagaagaacaggatggataaccgtaaaaggaaaatgattgtattccaggaggcacaaggtagtagccagaggcagcgtatcaagccactccaaattggtgaatcttcttccgctggtcaaggacagtcgcaacagttgaatatcgctggtgagatcaaatcagagactaatgaaagcaatgaagttaacatcgagcaaataaatcagccgatgccagttcagcaggatcagtctcgggagaataacagtagtagaagggagcagcaggtatgtttcaactgttacaagccaggccactttgcaagagagtgtccgaagccgaagcatcagcagccgcaaggtcaggtcaacaacattgtcgtcacaggagccaatgcagtaccagttgtgtcttcaagagttgcatcttcaagtgttacagctcagccactagtttcaaagcggcagtagttttctataaagccttagaataattatcggagttatggaataagatagactgcagtttacctatgcctttttctttctagccgttccgaatctcgggacgagattctttgtaaggggggtagatctgtcacatcctgattttttcgttttaggatttataaattatttaataaattattaatagaatttatattaaatgttctttaatttacaagaaaagttaaatgtgggaaataaaatttcctaaatataaagcatggatggatttaatttttattaaattctccatgattaattatactctctgaaattttctcggatttttcggagctcaattcctaaatgatacaaaggacagttcagtaattagttaatcaataatcattaatgatttaattataattatgttaagtgcttttcttgtttaaaaatccttaaattacaaattgttgtttaattggaattagtagaaatgatcttaaaagcttaaaagaaaagatctaattttaatttgttaaattctaagataaaagtgggctagataaaatttcattaaatactttacttgattctatagttcctaaatttttctgggatttatttgagccaaggaagtatttttaataaatggaattgcatttcatgaataatttaaattgaaaaaggttttaaaatctccctttttgttttgggccgaaagtcggcccaaaagccctctctctctccccggcccaagttagcccaccagccgagccgccgctcgcgcgcgcgctctcgctcgctgacaggtggggcccacctgtcaggaccttct

SEQ ID NO: 67141 - DNA, 74561 bp, Oryza sativa
tacttgcagctcggtgcctattatggttatgttggatttgtctacatcaggtctggttcgtatgaggccatgcagaagcccgtttggttgccggcctgcgccagcccgagaaccaggacgagacgatgcaagatagccaccgagtcaggctgtgcagaaacttaagtgcctgtctgaatatcggacatatcaccactggggcatgtgcaacatctacaagaacctatgatgttgatgaaatctcgctatgttcagggttactataaaaaaagcttttcattggcggccatatcatattttcgctgacagccggaccaaccgccaacaaccaaatgccaataaaaatagatagagtattttcacaagcatgaattaatcgcgtgcgaaaatatatatccactgtcagatacctaaagagcacaaccagtaaaaatcatccttcctaggcaggacatttaatctacccgccatgaaaaaaaaatacttttggcacaaaaaaaattcagtagatccaaaattgttcgcccccaaaacaaaaatcccttgccaaattcatcacaaacatcatataatccatccaacatattcattcgcaaaactcataacccattcacaaattaaactctcaattcattaataaatcacaatttcatcacaaagagggagatcacatagaggagcacgaaaaaaaaatccatgaccagtgagagctgagctagatatggatctagatcgtcgaagaaggagtgagggaggtcggtggggagggggggaggggccgaagcttgatctggatcctccttgtcgccctacattaggtgtgcaataatctacaacttgttgttttgttatgcttaatacacgtgaaatgagaagctacccattgcaacctgatcaaccaatcaaattgttctgcatctagggatgagccaaaccgggttcatcggaggagtagtaagccccggtgcctcggccatatctagatcttgcacgtccatgccatcagggagctcccaatcgaagtggtacaacaagctagcgatcaccatctccaatcctggcaatgctaagatgatgccagggcacaacctccggccagccccaaatggtatgaacttatagtcgttgcccctgaaatccactgcactgcccataaaccgctctggtctaaactcatccggtgtgtcccacgccgcagggtccctcccgatcgcccacacgttgatgaaggcgatggtcttggccggaatgtggtagccttggatggtggtcggcatcgttgagtggtgtgggatgagaagcggcgctggtgggtgtagccggagtacctccttgatgactgcttttaggtagtccaatttggttaggtcctcttctgtgacggttggtttggagccagtgacttgtatgatctcgttttgtagcttggacatcacctgcgtgtttcgaatcagctccgtcatgatccattctagggtcacgaacgaggtatcggtagctgcacccataatgtcctgcaaaaagattaaaaagaattttgtattcagtttgaatttagaaaaaaaagacccttttttacctataaggtatcagaagtagattctctcacgttactattcactgtgactaccacatgttagccaccaaatcagtgggaagttacgtcaaaggatctcaatcctaaggtatcaacagctgcaccaaaacgtcggttcccaaacatttgttttccttaccaatcggggaaaaatatgacttttttattgtgcccgtaagtatcaacatctacaccaaaaatttgtaaactaaatgaaagtctaagatttgccatgttattatgataaagttcttactcctagtaataaagaatttactcacggttaaatttgaaaataaaatttttacttacagttttattactcgtgctgacgtagataatcttatgctttcaaattttacgatagttttcagttttgcactgtatatttcccccataatcctttacctgccacgtgggtttatcgccagtagcggaaagaaacaactcactatattgacttttaaaaattttaaattttagtaaaatttgttcggtctttctctcatccctacatatggcattcaaaaccctgggtttttgtaaaacaaaactcggacattcgatgctggacaatggatatatcttcaaaaaatggtggatttttttcgttaccttgataatagccttgacgttatcctccgcgagctcgaggccgccggcggcggcggcgccttgtctcctcagtcgcaggagcacgtcgacgaagtcctcctcctcgccctccgccttctcgtcgtcgtgcgccgccaggatctcgcccaggaacctgtccgactcgtcggccatgtcgtctagcttcttgttcaggcccgtcagcttcctcgccgcccaccccgccgcctccggcagccggtccacccactggaacccggcgagcagctccgacgtgtccgccatcatcttcctgaacctctccgccgtcgcgccgctgccgccggccgccacgcgggtgatgaccccgttcgtgtaggcgtacaggagctccctgagctggacggcccgcgccgcctccgcggcgcggcgagcgcgggcgacgagcgcggcggcctcggcggcgcgggcgggcgcggcgaggggagaggaggtgcgccacggccagcttcttggtgcggcgccacgcgtcgccgagcggcgcgaaggacatgttgcgcccgccgtagaagagcctctcggcgctgtgcgacggcggccgggaggcgaaggcgaggtcgtggcccctgtacaggtcggcggcggcggccgccgtggacacgaccagcgcccccgcacggcccaggcggaggaacatgaggcccccgtcgctgccgtagcggcggtgcagggcgtccaacgagcggtgcgggagctccccgacgaggtggaggtggccgacgaacggaagcgacggcggcgacggcggaagcttcccctttccaagattcttgatcgcggcgacgacgacgacgacgaacacgagcaacgctgcggcgacgacgacgtacgatgacatcttggtggattttgccacaaaggtttggatttttactctgaatagcttggtgcttataaatcaatcagagcacaatgcattccatgtccttgtaaccaatcaacacggtggctggtggtggctatcagatcgattgcgagtctggaatattctatgatagatgttttttttttctccaaattggatttttatagaaccacatgtttgatgaactcttttgccatgtagttggggatattttctgaagatcatcataaatcatctccagttggatggctgctttctggctatagtgcacgtatgtttgtgagttgtgtcaggttgatctagaattacattcagaaatacatgtcaaatatttgcgttatcaagcaccagcattttgtgctgtgaagttccaaaatactctgtactgtttacagtcaaacacctttcttataatttttcaggtaagagaacctttcatataaaacacaaagtacaggtttcttcaataccacctgtattagtgcagtaaaattgcactttgacacatccacacaaaattcagtgcaaacccaaaaacagaagagaaaagaagagaacatgggaagaagctctcattattgtatagacccccatgcttttcaatccaatcctatgaataggcagtgccatcttaacacaaacctacttcttacattttcccctatttataacttctgtccctcatctatatctagatgccaaattattcaatctcaatgcctgacatggccttggcctggatcaggattgccaacaaggtaagcaagaactcctaccaatggagcattgatgtaggtagttggttcagatttcctgaaatcggcacggtcatcctcataaacatcatcctccccaggccccccaacaactgcgccaattaacgggtttgggttcgggctagatgaattgtagtaaggcgtgccgtcgttgcacgcaatgcgctggggatggctcttgatcgaaggcaacgatgatcctcgatggtgtatccgttgaggataccgatcgccgtacccgaccatgtatgacattttcatcgggttatctcctaatatataatcagcctgcaaataagtaaataagtacaatataatgttcagagtttagttagtcaatgttcctgcatttcatatttggatgttatgtaggacaattcagtagtcgctccctccaatataattacttttggatcttgacataatctttgtgatgctactttgacaaaaagttattttaaataaaaagagttgcatattatgacagtttgtttaatgataagtctagtaacatcattcttacataatcagtttataatcttttttattaataattaaagtttaacatgcttgacttagcattatttcaaaagttagttatattttgggatggaggtactacctgctttctggctagctgctgaagagtggcaggaccaaccgaaacatttccacagttgacagtgcgcgaggaattggagaggtacttggcataagtcaggagcaggaacgaaatggatgtaacatgctgcatgttgctgcctccaggcttgtagatcatgcccccgggcgtgtacgtgatgtgcggagacgacgactccggaatcagtgtgcagatgaatccatctgcaaactccttgtaggattgcagagatagcacctcgccatctatgaactcctgtaaccaaatttggaacccattttctctttgtgtcagctactgatgtttctctgaatttgttgcagctgcagaaggtgtgttcagaaactggaggagattgatggaggcaaaccttggagacaaggacattgatgccggcatgcttgttgtcccagccgaattcgttggtgctatcctctgctccaagggtcttgccgttgttctgaatgtagtcgaggtaggtgccttccttggaggctctccgtagccatgctgctccccacagcagctcatcctgccaagaattttcagtcgtgtgaactttgagatttttattcacccccccccccccaaaacaaaaaaaaaaaaaactatgtgatcaattatgagcttctgatggttgtgaagttctaattctggagttcgtaacaacagcatttgacgggttcagttttttttttccagaaatactagaaaacgctattaccgttgtaacggtttagtttatgtttgatggataaggtatcaggtttgatacctctgtgtatcatgtatttgtgtaccagatatggaacgtaatagattatgatgacatcagcattgtaactatatactagaactcgagtatcattttttttagagaagggtttttacccggcctttacatccaatcggatatatgcaaccgattatgatgacatcagcattgtaactatttactagaactcgagtatcatttttttagagaagggtttttactcggcctctacatccaatcggatatatgcactcattttatattaggaacttagcctatcaaataagaaacttagcccttaaataactcaatctgaaattcgttcatatggagatttgaactcaagaccttggggtgctactcagatcaatacaaccactaggctacatgccctttcgcaactcgagcatcatgtcacactgttctccggccaacttgtttttcaggtgaaatgacggcttcagtttcacatatgcctattccatgaaaccatgtcgcaacagttgcttttgccccaaagctcataaatagattagccctgtgaacaacctgaatttgtggagtttcagaaatagaaactttaatgttcccggactagataattgtttaccccttcattttggaaagaaattatcgtgtattcctagtttaatatccctgtaaaatagcatttacatgtacaatggttatcaatagtggtctcttagcgttgctaattaggaatacttgttgacgtggaagaaagaggagagacaaaacattgttgtcatgcataacaacggcttaacaacgactcttaatcactacaatatggaaatatggttgcatgagggtaaaaaaatagaaagaatattaataaaataaatattttttgagttaatgattagagtttttatcgtttcaactgttgtaaagatacggtctctaaataatcttatattgtttaagaaactatactcgtctctaccattgaatatgcccttctttcttttttttttccttgaccttacctactggaattctcatgctaaacttataaagacgtgcaatgtcagctggtactccatgaagcaaggcaccaaagctgctttgtttcttctgaacagtttatttatcgtttatttttatatgcgagagatatctaagcagcgtttcagttttgatgccaactactgaattgccagagcagcagctagcattgcagcaacagcatgcaaagctttttgtttctagtgacaaattaaagcagcaaaacacaaaaaaactgaagaaatttaagaacaagacaagaattaccctgacctgatatccatcgaagtcgcagtagaacgggcagccgccggccctgagctccgggtcgtcgctgtacgcgcccttgtgttcgtccgcgaactcgaacgcgctcctggcgccggcgagcagccgcgcggcgtacgccgggtcgtcgtcgcggaacaccatcgacgccgcggccagcgccgccgccgtctccccggccacgtccgaccccggcctcgccgcgctgatgttgtacaccgtcctcgctgtgtccatgtcctccggccgctcccagcacccgtggtccttcgttgggtcgcccacctgcattgccatcgacgccgcgctcacatggtcgtcgccgtcgacgaggaagacgacggtgcgcagtgcaatgtgtttgtgtgtgtgcttgcctgaatgaagatgacgccggggtgggagatggtcttgaggaggtagtcggtggcccagcggacggcgtcggcggcgtgggcgcgctccgcgggcggcatggcgtcgccgaactcgacgacgccccacgccagcatcgtggcggtgaacgccatcgggaagccgaacttgacgttgtcgccggcgtcgtagtacccgccctccaggtcgacgcccgccgcgccgccgtccgacaccgccgagtcccctcgccacgccgcgcgctgccccgccgccggcagccgccccgaccgctgcccctcgaagaacaggatcgacttggccagcgcgtcgccgtagtcatgccccgccgccgccgccgccgccgacggcgccgcgagcgccagtagcaagcagcagcacactagcaggacacgcacgcgcgagcggcggcggcgcacgggagccgagaggagcgccatgtcgtcgaacactcgccgcctcactagagcatgcacgtgacgtgagcacactgagatagctatagctctcgtggggcttcgtatttatagcacgcattcttcactagccagcaaacggcaagcttagctcacggctggattatggctccagatatatacgtaattaacacagatactatattctgatatgcaattatgtacgggatttttatatagagaaataataaatgctttactaaattcgtctcaaaatataaattggaaatatatgtatatgtctagatatatatatgactaaaagttagaaatatatatgtctaaatacatagtaagaaattattacatttccaaatatatgtgtccagatacagaatgagaggcaaagtgagtgtaactcaactgactatgtttctagaggtggaaactgtctatccaactgttcaaattttatatctgacataggtgctcgcatttacagctattttttaaagaaaaatggtaactgacgtttctattgacaacaaatcgtctgtagtgagtagtgacttcatgaatcttaaaatttatcggaccaatatttgaaagcgctcacagggatagggcgtacgtgttgtgtgctcatatgagtggtgagcgtgcacatgcttatataagtgtatgcgttttgtactttgtttttttttaaaaatggaacaagaagtagttgtatcttcggatgggggtacaagttatgctgatatgtcctaattattactcccttcgtattataatgtatgacaccattgacttttcgaacaacgtttgaccattcgtcttatttaaattttttgtgcaaatataaaatatttatgtcatgcttaaagaataaatatgataaatcaagtcacgataaaataaatgataattacataaattttttaataaggtgaatgtttaagcattaataaaaagttaacggtttcatacattaggaggaagtagtacaattttggagggtaattagagagaggttatggtgggacaaaatgtaggggtcacgggagcggtggtaagacagaggtgaggccaaaggtatgttttgatgggttacacgggcaggcagacattcagaaacaccttctgtgctcggtgtggtgtggtcacatgcagcggttacccaagagcatgagagaaacaacaaggccactagaatgatacgtagcactaggacccaagatgtaagatccacgagtaggctgtgttctaaagttctcatggatgactgagtttatcgcaattatttgagggcagagatgcaaaagaattaaatattagaaagttaaacaatcaattttataaagttatctaagaaatactctctccgtactcataaaggaagtcgtttaggacaatgtttaagtcaaacattggaaatataaatcatgaataactcttaaggtgttgagtttaaaaatgtaaaaattatatgaatagatttgtcttgaaaaatactttcataaaagtatacatatatcatttttcaataaatatttttatagaaataaggagttaaagttgtgtttagagaccgtatcgctgtctaaaacaacttcctttactagtatgaagggagtactggtttaggagtttcagtaaatgtgcccgtgatgatttataatatgtaaaaaaaaaaaggaatgtgtcctgaattcccagttattgatagggattatgatttttctactagtaagagaaactgaaccggttgatcccggttactaattatctcgtcggttgatgaaagctgagcagaaaaaggaaagcattgatagtatttattccgaaatggtaaccagatagtgctctttttttggggaaaccagataatgctcttaacgctgatacttgctggttggatatccctttttgacagattttaatactccgtccatttcaaaataagacacaatcaccttacaaaggctaaagacaatctccctagtttagatcaccctaataaatattttctctgttttaggttatgagactttctagcattgcccatattcatatagatcaatagatgtctagattcattaacatctatatgaatgtggtcaacgctagaaagtattataacctaaaacggaggtagtataatacatgcacccaatataattagagatcttaaaagtagagaattttaaaagataataatttagtggagaagatgggctaattaattgcatttgtgtatgcacaccttatattataaaacatcttgaaaaaaaattgagttgtgcattatattatggaattgagggagtattgtatagggaaatcatctttttaaatgtgcacatcaagaaatttaagactaaataaaaaaaatgcaaatacttattagtccagttattacttggagaaatgagtatacctccagataaattatttaagactaaatcaatttcaaggatcaaaatcagtgcacatacgtatctggcgaccgatacactcaactgcaacaacgccctcttcatgccaatctagcaagaggacaacacaaaattctcctgtgatctgcctgaaagacagcatgttctcttcatttctctttctctctcattgtttgagacatgtcaaaaaaagccaaaatgtggcgaatctatgtgatcgagaccagtgactctaagtgagaagcttgagcaccgaccatactgatgcgtacagtttgctgtgtttccctggaaaaaaaggaagctgttattgattatcaacttttggattggtgagtcccctccggttcagagtttgaggctggtgtagaatggaaatgtgaagcaacaaatttgagagaattgctgtggatggggactcctgtctgttccatttaggaatgtgatgtgagcttcctgtgcagcacgcaaactgaattttgggagcattcagcaattttttgttccaaatataattatgtgtagtactaaataacttcaaaattatttccatatatattactcttaacgaatttggtcctttgctcctgagctaatggtagtaagatgcgcgcttcccgatgcaaaaagccagatttgcaatgcatgtctttttggttgattcatctaggggtggaacttcaaccaatattgtgaaaaaaaaaatgaaagttcccacattgttttgccaattttaggcgtacattcgtaaatcagttagatgaagtgtacattattactactcagcagggtttacaaaaaccaataaaaaccagtcggtttccctaaaaactaaatctccctggcttggctcgggaacacaaattaaaccgcttggttttccattcaagtttaacaaaaaaatatatattcaaactggattttaaatattttacaaaatttgatcatatttcatcggcagtcaacaaattttaaacggttttcacaaaataataataataataagcattgatccggtttttgtgagtggttttcccgctactcaatactactactagtagtataaacttcagagacctcgtactccaagtccaacctgcttgaaacctccattttgctcctcctgtaagctacccagtgagcagaggaatcacatgataggtctccttggacggatcaaatcaatcttcctccttttcattatacatttgaggccacagaaaaagatggcatgcaaaagcaacgatccgttgcactttctgctgcatactgtccctgttccattcttcagttacactgatctaaacctttttgcagaagtgatgaagtagtagtttttcagagttgtgtctctggcaagtgacaagacgataatctgtcgctaagtatctgtgaccgtggctagctgtagatggtgaagtttcaacaagttctcctgattttaaaaaatgttttagttttatagataatctgacccttgatttaaaagatgctatatccacctattataataattgtaaatcttcatctgaatttggcgaaaatttgtggattaaaacttgatgatacgaagtgattaatgtctcactcggattaacctgaacaataaataagatccaaagttgagcttagatacacttcggtgtgcacactgcagaaagtcaggaggacctgtaaatcgttagattgcaggatgcactttctcaaggaagatcacacaattttgcgagacatcatgcgtggcccggatttttctttcttcgacaagttgtgggcttgtggcagctctttgcgtgcgagagtccaaagcttaagatcccgataatgatgatgatcaagagcaaagccgaaaagaggttatgcgttcttcagatatcttcagagaggaaaaaaaggaatagtgcatgtattggaaggaatagtgatcgatcgattgataggtccagcagattaaaatgttgaaaagttttacactgtcacagatcatatagtcgatggcaccgacagagacatcacaggtccccttattttttaaattctctggagggaaggttctcttattatttccatataatttaaataattatatttttttgcaagaatttaataacataaactaatcgtaatacatcactccataaatatataaatttaattatgacttttacaagtcgagaacaaaagcaaatatgattttgaatatgcacatatactactccacgtttaatttgtttttttttacaatatcaagaggttgaatttaaatttacatgtttgagaggtgaattcatcatggcatgctgtgaataggggtgaaaacgagccgagccttgcagtggctcgcaacaaactagacttggatcggctcgacttagttagggaaacaagctaaaacttgagcttggctcgggtcgtttcttggctcaagccagctcaagctggcttgcaagtattcttgtcgaaacacctcttcatatatattttataattattaaaaaatgcaagaataaatcattaacatgtaaaatttaaataagtttatatatatatatatattcaattcttcaaaatcttaatgataaatttcaatttgataaataataacgccacaaaagataaaataatcgatataaatacatgatggcctaggctcgcgagccaaaacaagcggctagcgagctagctcggctcggctcatttcagcaacgagctgaaaaggaggcttgggcttggctcgtttggtttacgagccgagccgagccaaccaagctcgagccaagcctgagctgagctcacaagcctgagtttttttttccacccctagctgtgaacaagaccgcatgtccgcaccacgtggtgctgaaggggatccaacggctgcgagtgcgtcgcaaagtcgaatgggccgcaccgctgaaatcccgttccggcccaatttaagtaggcccacacgtaagtaggcctaatttaagctagatgggccacatgtacatcggaatcccaatccgtcccaaaccgtaacgggccgcatgtacttggcaaccacgttacagcccaatatggataggtcggggttccactgtggcccaaacgtatcggtcctgatgtgcgtggcaattttttttcctagaatgactgaaggaggtcaatcaatgtgattaagattgaagaaaaaaaggttacctgaaaagttttacatcggcagctggctgtcgataaaggaagtgcaccagagcacacaccccgaaccatgtgacaaccgcccaaacacacgttacagagagggaagccgagtactgaactgaccgtcgcactgtgcatggaaattgtattgacccattttgtattggcccgattttgatgttagagtattaaattttgggggttttgatggtttcaccattccggcagatgatgtcaatgagggtcggagttttaatctccgaaccccttgggccttggctaatgtctgctgcatgtccgtttgttcctacctttggggtcatgcaggtttcccgttcaattctcaattaagacactctgaagtgaagtgcttgtatgagacgatcatgccaaaatcttcaccttgattcttttgatgcatccaaaagaataactaatttgaggtgaaatcctcctcctggaatggcttaaatttacagcaccgaaacccatcttgttcaaaacattattctccgaatccccttgatcagtattatttgggatgaaattctaatcttcgaccaccctttgctgctgctgtatcatcgtcatgccagcagcagaatccggttgtctgtcatggctagcagctgtagatcagtaggcagtagatgataccagcagcaatctttggaagagttaacaggattaaaatcagaagaaattgttcgaccagtaaatcaaagtcagtaacgaggaggagtttgcgaaggagacgagcctgtacgaaccctctttgcaggaagagggaatatgctctgaatcatctcctgctaaacttcatggacaaactattttgtttcagcaatcgccttctccatcagagaagaaaaatgaataattacgcgtgcatgggatgggtgatcgatcgattgatacgtccagcagattgaatgttcagtaattttcgttcgtgtaatgtttttgtttcaacaaatcgattacacaatcatcgcagcttgcgctcttgtcgattttttttatattttttgtgagaagggtatttttgcccagcctctatatccaatcggatatatacaacctttttaaattaagaacttatcctatcgaacatgaaacttagctctcaaataatccaatctgaaattcgctcttataaagatttgaactcagaaccttggggtgctactgagatcaactttcactcttgtcgattataaagaaggattaggcatgtaaaacattgtaaattttggccttttaaacgggaggaagcagagagcgctcgaggacaattcgcgcctgcaacctgcgcatctttccccgcctccgctcgtactcacaaaccctggctaccactgcagtcatcgctagcacgagcaggcccccaaccaccgcgttcttgccgtcgccgtggtggtgttcgccggcggagaggatgccagccacgcccaggcacaggagcagcgcgcccacgacgacgtcgaacgccgcgaacgccatggcacccttggaccaggcgaaccccgagctcgggcgggacgtcgtcccggcggcggcgatgtccgccgcgatcttgtcgccgccgcgctcgtccagctgccccgacgccaccagcctccgccgccactccggcggcatcgccccggccgcgaacgccgcctcgatctcgtcgtcctcgaagatgttgctgctgctcatgacgatgacgatggtgagagatgctgctgctaaggtttggttgcgatacctccgccgcgaccgggttggaatatatgataactccgtgctgccagatcgaactcgggctcggactcgttacaactcagaaaggaaatgagatacttctactccggcaaggctagtaggctacagagattaatgggcaaaataagggcatgttcagattgtagccaaaataaattttatcaagttttaacaatatcaaaattttgataagatggcaatattgcctaaattttggcagaatttcttatatattaatcaaatttggcaacaaactaaatgtagagcatgttcactttgatgttattttcaaccttaccagctaaaattttggcaagaaactaaatatagccacttttttagcaactttaccaaaatttggtaagtttgaaaatgacatcaaagtgaacaggcttgtaaacattttttttgccaactttaccaaaaaaaaaatggtatagtagaaaatggcatcaaagtaaacatgccctaaacctaaccaaattttggctatgtcaaaattttgataagatggcaatattaccaaaaatttagcatgatttcttatgtaattatcaaatttggcaataaactaaacttagacattttttttagcaaatttgctaaaaaaatggtatggtttaaaatggtatcaaagtgaacaggccctaaatgccacgagaaatcttgcacatcttcgtatagaatttcagtctttcgcagtgaatgatccctgacgatgtcatttccatttcgaagatgtcgaaatgtcgatcaataggatttaggctctatttgattcagcttagaattattgtaatctgaattattaggagtaagctgaaacaaatagatagcttattatgatagattattacaatctataagccaaattactataatctggtaagccactataaaggtgctttttctagattattggatggctaacaactaacaaacagctaataatccagataaacaaacagctaacagcttattctatgtcgacttattataattcagcttatagtaatctaattctataatttagattataataatattaagctgaaacaaacagggccttaaatgccaaactcccttcgtttgtttgtgttcgtccagtgatcgcgggtgtaatccggagtctgacactgatacagcgtcatggccgtcagagctcgacgaggatggcaatggcggaggcagcggcagagctgacgaacgctttggaatatggaggggtggtgccgtggtaggtttctccgacgagcaccgcaccgagcacgtcgtgtcgtgggtgaccgatcgagacggagaaactccaatcgaggagcatatgtgccctctttgcacgaagaggggaatatactctgaatcatcttgctaattttcatcgccaaactgttctgtttgagcaatggcttctccattgtcaagatcaaagtcgaaattaaagaggttatacgttgttcagatatcttcagaggagcaaaaagaattgtgcgtgcatgggaagggtgattcacccttgcaaatttactcagggcgatcgattagcagaataagtttttagtaattttacattgttcacagatcagacaggagatcagatcacaagttgccgcttctagccttctacaccactgttttgttttgtttcagcaaggccgatttcagagttcagaagaggtgcagtgtgaaggaggtttcagaaattcagagttaagcctgatatagcatttgcactttgctgttctactcctattttgctatcggtggatttctgtagtcgctcgctgttctgctgttatctgtatcggatatttagatgacgagctagcactgtgcactcggcaaatgggacaaagctgtccttggattgatttttcctttttaagcagcaggtctctgccatgtccaacttcggcagaattggaaatgcaaactgctaccttctgaagaaaagagaagtatttctttggaagagtttacagtattaaattcagacaaagtattcgttcatcaacgaagaggaatttacaaggagatagccctgcgctctttgcaggaacgaagagggggataatctgaactgtcctgctaattttcatcgctaaattgtttcgtttcgtttcgtttcaacgacggcttattcatatgaagagaggtgcaatgcaacgtgggggaggtttcagagttaaagagtgatatactgcttggtaagagacaaagaccgagattggttccaacaaataagtatctggcattgactaagttttactgcttgacatcactgatggctggatcacaacatcatgttgtaaagttcatagtgcattccaagtccaagatccgagagaattgatgcttgttctaacatacttatctattttgtcaaatgggcatgctcaagtatcatacaccgacaagtcgacagcagcaggtcatgagaaatctaacacatcttcatataggcaggaggtccaaggaggcatatccttttgggaaaggaagaagaaaggatcaaactagtgcactatttatccgagaagatgcctcgttacaactcatcacacctccatgttcatgaatactgatgcactaattacaagtaatatgtcctaattgcttattcttctccttcaacagccggtaggccttccttgaaccatgtgtagagtcctccatccagatggaacacattcttgtaaccattcaggaccaacaagtaagctgctatcagggacctgccaaaatgaaacagatgagatgagttagctatgttccagaggcacaaacatagtcacctttgtaaaacaacataaaattcagagctaaggtgaagaaaggagtgtgggcagacaacaagtttatagttttacatgaaatgaaacaatacagatgttgggcaaacggggtaaattggaactcagatgaacgaatagtataatccccttctagtttgcatatggcactcggatgaactaccgctcagcaacatggtagaaatttcaagctggtaatatcattcaactgggaaacattgttgacaaaagaaatgtgaaacaaaaccaccagtagaaagaaacgaaagatatccatactacaaaataaaattccaccaattaagagatgatcatgacactacagaaataccttatgcaaatattaggaagaatatcaatgccacaatatgatagacccatttctgatttcaaggaatacagaaaagaaaaaaaacctcatttgcgacagtggtattaagagactgtatcagcgctttcgtgtcagttagaacatgaatgttaattggtaaaaattgaatcaagtttactgataaagaatactaaggtaacatggcatacctcgattgcttcccatcaggaaagttctgtgttggtttcaatgttcctcctgtcgaacatgccacaataatctttgcatctttaccaagtttctcatcaacaccttcgtaaagataatatatgtcactgattgtaaactcatactccctccgttttttaatagatgacgccgttgactttttctcacatgtttgaccattcgtcttattcaaaaattttatgcaaatatataagatataaatcacacttaaagtactatgaatgataaaacaactcataacaaaataaattataattacataaattttttgaataagacgaatggtcaaacatgtgagaaaaagtcaacggcgtcatctattaaaaaacggaggtagtatatgagtaaccatgaagcagaaaacagaataaactaccatactttgtatgaactcaggattctcttctgttccagaaaatatgccaaagaatgcaaatgctgcccgtcttgcaatatcccatgctgtccattcctttatcaatctatatatttgcacattaacggcaccaggtggatgagcctgcataagaatgaacccatatgatggcatttgcaacaaaatctaatgaatctaagtatcaaacaccacatagtatgacagcaacaaagtttgagatacacttgcacatcattggaaataattttgttaacaaaattatatccatttttcaccgactgcagacctttttttctcttccaaacaaaattactcctatttctcagacactctaaaattgcgtaaagtcagaacctttggttcaatatacgatatttctaagggaataaatgccacaaaagattataattacatattaatgtaaagcgtaacctcaagttattgtgttaaacctaagagctgcattatggtgcaaaaaccgaagataagtggagaacaattacaacattacctctttaaagtccgctactggcctgacatcaagaattgcaaaattgttttccttctgaagacgcagtgcttccttcacatcaacactacggacctgcaaaaccaaacaacagaaggaattctaatgtaaatggaagccgcttagcagagaaggctccccacgggtaattaacatatgaaatcaacaaacccagggaaaacaagtccataattccaaaacagagcaatatgacatggaatctatggcttatctactcatatatgtgcaatacacactctctgaagaactaaaaccaggtattcagtaagatacttcatatatggagttgataacaaaatagctaacatttggaaatggcaggaaattaggaattacccgcttttctactagcacttgcctcttgatcttccattcttcttcagctgtatataaaaataaaaaaaaatacagcaaattaatatcatgcccagagaattactagctgctccaaaccaagaaaatggagagcgtattcgcagtacctggtgactttgcaggctttgtggcagtacaggttatctgcagcgagcgcacagctcgtgtccggcagagttttgcagcctctataggacgccaggagtagccagatgtgaagtctgagcaggaggatatccttgatgagcaaggaaggttgctgttcactacagagctagctgcaagcattgtggtcatgagaaaaaaggagcagaaagaactatggaggactctgagagaattagaagaggggtttgcctctaacacctaaggatggatcctgtaactgagaagatttttttttctggatggggaaacgtccaaagaactcaatggttttggatgggaggtgccagcatatctgaactggtggtggaggttgagctagtgttgtgatagacaatctggattctgaacttgtagcttagcctgaccccacaacaccaacaatctagacaggaacacttaagagctgcactttttttccatgacataatttatgatgcttgactaaaagtaaatatactaggatgtgcaaataaagaaaaatagaggatactacagcgacataatttatgtaaaatccaaccttttctgaatgatataaaaatctggcttttattggtactcagaagttaccacctacaaatgggaatcctaagatgcccaaacatgatgttctcaaaatcgacctgacaactaaacaagagtacaccagaggcccctggaaaatggaaccacttagacctctcaatctgaattcagaagacaaacaaaagacaccatcaccacagttccttgatcatcttcagctcaactctgctcagtgctcactcactccagtacccgtcgtcttccttgtccttcttttcatcgtcctcctcgccttcctcctcgccgatttccatcactgcctccttgaaccgcttgacatcctccaacgccgccttccggaacatcccaatgtccactgcaccagacaccatgtggtaacccctcagcttgagctgctctgccgggtcgttcggcatggcgaatccgcctagatatgcgacattgccatctgaagctgtcacattcttcttcctggcatccaacaccttcttctcggcctccctcagcctggctcgcaccttcctgttccctgggtcccacaggtaccccatgctggctgacaagtcgagcggtcccatctggacgacgtcgacgccgtcgacggcggcaatggcgtcgacctccgcaatgccagcggcggtctcgacctggcagatgattagcgtctcgtcctcgcagcgggagaggtaggagtcgtcgaggccgtacgcggaggcgcggacgatggggtgggcggcgccgcgaacgcctcggggcgggtagcggcagtgcgacacggcggcggccgcggcggcgggggactcgacggcggggaccatgaggcccgcggggccgaggtcgagggccttcttggcccagatggggccggcctcggggaggcggatgacggctggggtacgggcggcgtcgagggcgcggaggcaggccagcgcctcgggaacgccgccggggccgtgctccatgtcgacgacgacgtagtcgtagccggcgagggcggcgagctcggcgagcgtgggggagaaggagaggaggaagagcccgtacagggtctccccggcggcgagccgggacttgagggagggtgcggcgtagaggaggtcggaggcggcggcggcggcggagatgggccgctgcccgcgccgccgcggcaaggggagcagggcgggggcgcggcgggaggggagaggcgcggggtctggcttgcgcgcgaggaggaggtgggagagggaggcggtggcggaggcggaggcggaggcggccatggcgcgcgaggcgagccggcgcggcggcggagaggtttggggatctgcggcgagtgagtcccagtcagtgtggggggacagcgtgaggcagtgacgtggcgttgctgcttcacgtgtcgctttgccacgggccttattgggcctcgcccactgacgttggtgggctctggcccgtctactttgtaaggcccaggaattgtatataacttaacttttaaattggaataagttcactttaaatcaccgccgagttcgattttcgttgttgtcctacaaccgtataataccagatataatgagattcaaagaagtatactgtatgtttttggctcacgtggcgagtgggttatgtttttggctgacgtggcgagtgggcctcacgtcaggcctatttattcttcctccaatctcctctctttttccatctcctattctccaaacctcctctctctcatccgttccacatcactgataggggagggcggatgtggccaacggcgggccgccatcgtcctagacaacactatatgcaccgcatcgccgtcattgtcgatgccctctgcatcgccaacctcctcttcactggacttgccctggatgctgccccaacaaccccgattgcacaaccactgggcggcatacgcctagctatagttgaggcaacattagctccatcaattatccccgcggcaaggctcctccggtgagaaggtgtccttctcatcatcgtaccccccaccatgtagaagtcttggtgcatgtcaaactcactaagcttgagcatgtgcttcatgccaaaactatttgctgacatgtcgaggctgttggatccatgctccaccatcgggaagaggttcagtcatcctaggatagggatgaccgctgacgagtgcatcgacgcaacgttccactcccagtggaggaagtcagtgctccgatacaccaaagcagagccagtggcaatgaccttgacatttgttcttcgatccaccccaacaaccccacatggcaccgcgcttggctgaccatcatggagacctcggatgtcattaggcctagggcagtgaccgcacactcaaggccacaaatggcatgggtgtaggtgacgatgaggtcagagaacatagcagtgaagcgcgcgtatgtgtagtcaaccgtcggtggcccaaccagagccatcttagatggtggttgtcaacgtagaagatgacggtggtgcgggtccaagagatgtgtaggagtgcgtggcgacgatggggtcgtcgaaggggaggaggtaccgaagtagtgttccttgcagctgcaagtgcggtgctgccgtcgcctccgtccctcccttagccgatgatgggaaatggaggagagagatgggaaatggggaatataggagatatagagggaggggaggttggaggaagaagacatatgcctgacatatggggcccactcgccgtgtgagccaaaaccggggaaccatactgcttgggaccttgggtacaccagttttgcacatgtcatatctggtattgctgttcaagaaaaaaaaatcgaacttggcgaaagacgagggaccttgaacttattcctttcaaatttcgttgtggatcagaaatttggtgggccttatccggattccagcccagcaaatgatgggccccgcagtggagagaccgtggcccaaacatcatcgcctctcgccgtcgtctcgtctcttcctctgcggctgaactagtcgccgatccagaggccgtcgtccactcgcggtcccaccggccaccgcctccgccgcctctcaccggcgccaccgctgctctgcctccaccgcgttcctcctctccacaagcctcggtcgcccagtacgcatcccatccgtcgccgtcgacctagctgcctggtggaggtggaggcgagggggattgactcggctccggcgctccgattgagcccgcagccgaccgatccggatacgatccgctccgctcctcgccggagcggaggctgtcgcgaacccaggtaacatccccgccctaacctcccacgccgcacgcacgcgaaggccgacggcggcagcgccatcccctgacggccgactgcgcagcggcgctccgccccgcgccccggcctgggcctgcccgccttcggccttccccgactcgcgccgctgctgcgccccgccgtgcagccgttgccttcgcccttcgcgtcggcgctgccgtgtcgtcgctccgtgcagcgccgtcgcgcgcggcgcgcccgctgcccggcatccggccctcccccaagccccagcccccttggactccggtgagcactgcctctcgccctctccggctctccctctacctcagtccctctcccccttctagtagaccacagtattatccccttcaataatcaatttctttgtatgattgtatctgtgattagccaattagggatatagtaatttgtatagattactacaaaattatgtgcaacaatgaacctcaaatgaaatttttgacttgtattgtaatatcctatttatctaagatgttatgttatgtttgaacaatttacattgtcctttaggtaagattcaaacttgtttgttattttctacttgtattgaaccatttagagttatataccgtatcacggtatcgtttataatttatcagatatcttatcgaatcataccgtattgcatttagatttttttttgctaggcctaccccgggttcaaatcctgggtccgccactgttagaacacacgcagagaactctggccacatcgaatcgatcgccgttcacgagatgtgctaattgattccatcggattttttatggaactgcagccaatttagactaggaagcatgaggaggcgaccgggaatcgcgggcttgcagaacgcagcggctactcgtgtatgtggacatcttgcttgaatagcttataatgttttttttttctttttctgtggattctgagatgagtgtgctcttggaaaatttaaggaccaattccggctggttggggaaaatgtggccaaggtcaggaccgatgtcatgaaggagcagcttgcgacgtttcggacacagctcgaagaatttgcacgcaagcataaggtgattcctactcctgtattctagttgagttttacagaaaatattaccgacgctattcgtatgtcacaaattgaattacacatagcatgctttcacaatcttcttaatcttggggatcaggatatatcagtcattcttgcagactgactgaattcttacattttttttcaactgcccagcgcaaatgaaatgaatgttctaacaaacatgaaaacagtgaagttactgctattcacttgattaaagttgtctatcgaactgggaaatagggaacctaagtagcatactagtccatggtcaagtgctcaacatatactaaaactgaggaacggtagttaaagatggaaaatgtaccaaagaaaaggtgttggagttaccaaggtgccaattgatcttgtttcttgtgatagatttcacttgtctcatggcatctagttccaactgggttgacatttgcaatgtaacactgatgttctaggtgatcacaatagagctcaaatggcacagcatattccaactcttaagtaactttgtgtacatggtgtgctagtgcagaatgatatccgtaaaaatccactatttagacaacagttccatgagatgtgtgcaaaagttggagtagacccgctggcttcgaataaaggagcttgggcagagcttctagggattggtgacttctactatgaattgggttggtatacttaatttaagctaccttgtatgttttgatcctggaattttctgttattattggaccatttacgttctgcttggcatctgtgtctattgcaccaggagttcagattgttgacatatgcatagcaaccagagcgaccaacggtggcttgattgacttgctagatctccgtaaactcctctgtcagaagaggaaagctgatcttggatcgttaacatcagatgattgtttgcgtgcgataagtaagctgaaggcaagtattttaaggaattctacagctacatttttttgggaatcctgtaattgcattcatgcaagttttacaagattgcattcgaatctatggccaataaaattttatttgatgtacttggacagatcgttaattcttctggtcctttgcctgtgaactctcaggtccttggtagtggttttgaagtaatttctgttgggaagaaaaagcttgtgcgttctgttcctacagaactgaataaagatcacaatgggatacttgagctagctcaggtttgtaatcagcttttaatagtgtataataccacagtacacttaacaagtatgtggatgctgtcataaccttatcatgcttacactgaacaagtatgtggatggtgtataacctttggttggaagtcataaagccccctatgttccacataaacgcttatttcagtcaacatagagacatagtacaaaactaagttaaaccgaagctttcaagttgctgccttgctcaatctgtcaccttgccacaatataaccgtacctgtccagttataacattatttcacatgcaggctgaaggttttgtcaccgtagagcaagtcgagagaaagttctcgtggtcaactggccgtgccattgacgtccttgaaactttgctcaaggtaaatcctgctcctgcatttccactctttaagcaacctttgtgcttcatttctgtgcccaaagaaaagaaaaccggcttcctttgatgcaagttatgtattggtgaatggtgattagatctctctgttgaatccacgcttaagccattgcaggattaccttctttttgagctatccataatccatatataaataaagtacttttcgtatgtgcatctgtattgacacttttatgaacgtcaaattttttggcatctatatccaactctggtctctattacataaacaggaagggcttgcgatgatcgacgatgggcacagggatggcaagcgcagatactggttcccgtgcgtcactctcagctctgactctactggtgcggatgccaagtcatgacctgtgccgtgcctgttccactccgttgttgtcacctgtatccttttccattggttcatttctgtaggcactgaagcacatatggcatgccatttaccagtacagctctggaagaatcatgagatagcaatacacttttcagggctgggctgccggcaaaatttttacattgtgattcgtgcatcaggattctggatgtatttgtactagtgatctatactatactagctcttctttcacgaaattactcgtaatcgtaaatgttcaatgctatttcctccgttttataatgtaagactttctagcatggcttatatttatgtagatataaatgaatatagacacatatatgtctagattcattaacatctatatgaattatctatattcatttatatctacatgaatataagcaatgctagaaagtcttacattatgaaacggagggagtaacttgctaatgtgagcaagagaaatgctcgcaataaatatgataaaaagagagagatgctaagtaacggtatcttattcggatgaaataataccttaaagatttcgtctctaatacctaatagcggctgataccctatttgaaatagggtatcacacgatacttatgacttatgatatattatttcatggaaaaagtacaccgaaggtcactcaacttgtcatcgggataaaaaacatcctcaaaccacaaaactagatatgtgaggtcccttaactatacaaaaccagtcacaataggtttcttagcggttttgatcctggttttgtcttacgtggctgctgagacagcgtgagccccatatgtcggcctctttctttcccttcttctctcccttcctcttctctctctcttctctggctctgggcaagccggcgccggggcgaggccgcgaggcgggggaggaggtccggcggggcgaggcgggagaggaggtccggcggccggcgacgtggcggcggcggcagcggagacgacgcgggatcaggggagcaaggcggcggcgacgacgacaacgcgggagcaggggagggcatcggcggcggcgagggtgaggagccgcctccgccaccatcagcgacctcaggacggcgctctgttcctccttcactctcgcgctggtttcccttgacttccacctcttcctcaagggcaccaagctcatggccgacgcccgaggtcggaaacctccccgtcggccccggcgagtccatctctttcatccctgtcaactccgctgcatcctcccgcttggaagccgacgtcgagctcgagcacgccgaatccatggagaaaacgcaagttttcttggcacgacggcggcggtgaagacgtccacgccaagaagccaacgagcccagcgctgccgccgccgctctcctgccatggatgtgtagttcggggatgtgaatgggaatggattggatcttgggattatggtgtccgccgctgttgccgatcttgatggcgccagggttgagctcaccagtgggaggatggtgaatgcctggatcgagtactcgcccaccttgtcgtcgccgtcgaagccatcgccacgtacgacggcgcctttgccgccgccggaagcgccagtttcatccgccgttccgcctcccgtgagttttaatccaatgcttccctcgcctccgcagctccccggcgtaaccacggcgccgtcgccgccggtgtccacggtttcgatgcctcccaccagctccgccttgctcccctcgccgccgccgacgcccctcacctgctcccgcgtcgtcttcgccgccgccaccgccgccacgtcgccggccgccggacctcctctcccgcctcgccccggtgccggcctgcccagagccagagaagagagagagagagaagaggaagggagagaagaggggaaagaaagaggaggctgacatgtggggcccacgtgggcccacgctgactcagcagccacgtaggacaaaatcaggatgaaaaccgccgagggatctactgtgactggttttgtatgtatagttaagggaactacgtggttttgcagttcgaggatgttttttattccgatgacaagttgagggacctttggtgtactttttccttatttcatccgaacggaatatcgtccttaagcattccaattcggcccacgggcctcaaggcttcaacccatgacaattgacaaccggacaggtgtgggcgttgactagtcttctttagttttccaccggacaggagtaattggcaagaagaaacaaaagggaaaaaaagtggcggaaaattcatttttgggaggggaaatggccaccgcagaggcgaagcgccggcgccaccactcaccgccggcctccatcgccgccggcggcgattcctccacccctacctcggcggcgcccgccgactcgtcgtccccgtcgctggatctcatccccgacatagcccgccgcctgacgtccctggaggatttcttctccctgcgcgcctcctgccgcgcctaccgcgcgctcctcccggcgtcgcgccgcctcctcgcctcgcagtccccgctcctcctcgtctccctctacccctccttcgccgaggcgctcttccacccgcgcctccgccgcctccaccgcttccgcctcccatgggggcaccacctgcccccctcgcgctacaccctcctctacgcccacggcttcctcgtcacctccaccaccgccgccaacaactacccgccaaggctcctcctcctccgcctcttcaccggcgagcagctccgcctccccagggtcttcgcgcccttctcccgcgtcatcctcaccgcggacctcctcgtcgtcatcttcttgcccggccgggccaccgtccagcactgccgccccggggacgcgctctggcgcgttgcctccgcccctgcaccccatgtgttcgacgatttgatctctgtcaatggcaccctctacgcgctggttggcctccgtcttgccacgctccagctgtcggagagttcgctggagctgtcatttctgggaggagagcatgatgacgcgaacaggccggagggggatcggttcatgctcggggagtgtggaggcgaggtgttgctcatcagcgtggagcatgaggagagggttgtgtaccgcgtgttccgttgggcatctgagaaaaggaagtgggagatgatcaccaacttgggcgggcggtcgctgtttcttggcttggatggattcgcagcttgcgttgatcaagatcatccaggggttcgaggggattgcttatatgcagctgggcgacgcttgggtgagtggcatgagtattccttggctgatggaacctgtgatgtctgcaatgctgactatccaggcgcgccacccctgaacaacagttcactgatcagaccatcagtttggatctttcccagcttgtgttgatgcaagcctgagtagggttcatcctagatcaatgttgaagccctattgctcagttgctcacatgagagaaaagaatggtaatgcttgatcactagcttgcttactaggtcatttatgtaaacaatatattcatacggcgatcagtacttgcatcttattcgaccagtcaattgttgttttggttgatatagtgaatacttttccttaggattttgaccacaggagcaaaataattttgttccctaaatgctgacagcattactttatgtgctatgcaacttgttgagatattatgaagcttcttttgcgtttattttcctctgatactgcagtaatagtgagtaaagcacataatacatcaaggaatatgctagtaccataatgttaattggttatatttgactatgtccctgaagttgcatggttgtaacttgtgtagggtaggcagtagcagaattcttaaccctgtttgctttgtgatttatacaatgctgcaaatcctgcggagttgtcacagttagtccagtgatagtgataaacaagaccaggaatgacacacatgtccaatggatgatatcataaattatagctgatcatgtttatgatttgtactcctaaaaatatgacatatgccaggtcttagaaccacttatttatatgattttccactcctataactgtaactttcattcctgaatcctgatagaacctgtggtgtatgacctccaaatggtctacccaatcagtagttggcagcaagcagatgtgaaggggttgggcatgctcttttctggtccatcagtttaggctttatatttaaagtgttcttcagttccgtgtttttggactacccttcagtttattcttttttcgggtctcctgtctctcccttccttgttcttgctgagtgctgacacgagacacaacttggttctcttgcggttgtccgttttgcttggtccgttgttgtttctctgtcttaatacaaagttaagccaggcttttgtgtgcttcctgtgtttcagaactcctcttattatctcaaaaaagaaaaactcttcttattgacttcagagggattggaacaatttcaagtttgaaagcatgattcgctgacatatggacctcaaacttatgtctgtgcaatgttacctggcatctcattttgttagcactcgtaaacatgaagtctggttacctgcaattctgaagaacactgtcttataacctctgacttgtgtgcaggttttcaagtttattttttgacctttggatggtatttgcaatgagattcagtcatatttccttatacatgtttccttattacttgaaagttgaaactaactttgagaatgttcaacccttcaaacacttgctctacctacttggtgtattgatatttgcatgtgttcccaagaatgttcaagtgctgcatcaatttgtgccaggatgccagcttagcgagtgcatatttgcgatctcaagtctgtcgatgacatacgcacattattcattttggatgcctactgaatttgttctgtaatcgcaaatactgtactcaatttcaggttgcatcactggctttcaggtgttctctttcttctgacatgttgctacttgcttgcaaatggatcgctgaataccaaccgtccattctggattctgccacttgcagttcttgctgatagccttgcagttctttctctgtgtagctcttttgttgatgtctgaattctgatgcttcaaaaattcagaaatgcagtaataaacagtagtagtagcactatttatttattgacacctggaagagaggtcctgtgcctctccagtcactgacatgtgggcccactttgcagtcattgaccaccctactgctacggaggtccacaggcggtctattgtggggtccacctgcagtgggtcaaacgggccttcgctaactcctcgccgtcctcttcccatccaaacctccgcagcagagctcgctgccgcggcgaacgcacacaatgcaacacctcgccctcctccgtccgctcatccatccctctccccttccggccgcgagtcccctcgctgcgcgatgccgcggcggccggggccgaggccgaggccgaggcgtccgctggagatgcgcgacggggggaggcgcgggcggcggcgaggttgaggagggggagggggaggggaagcgggaggcggcggcgtggctgagctcggcggtgggggagaaggtggacgagctgctgctgcgcgaggagaaccgcgcgctggtggaaggggtcgaggccgccgagcggcgggtggagcgggcgcgcgccgcgctcgccgacatcgagcgccaggaggccgccgcccgcctcgccagcgaggaggtccgccgcctcgagaggcgccgcgacgaggtatggtgactgctgcccgcgttcaacctgtttgatgctttgcctgctctgcattcgcctcaatcaacgagcagagtgcctgccctagcgagtagtgggtctctcatggcctcatggtggagagcgacgtggcctcacctagctatagtgctgtacagtgtacacacgcgcggtccaatccccaccccgacgcggtgatgcacgcatctggtggcaatagacgtagcatgaaccagcaatatggcaccaccagggtgttgcggtgcaatggcgtgctagtatggttgtggttgtactgtactactgtgtcggtgtggccctagatgttctgtgactgccgcctttgtgtttgagttaatgtggcaccgacgagcttgaggaatgctctttaattagccgaacagtagtacctcaccacgggtgcatgtgatttacgaaatgtaaatatgtaatgcacggaaacagaaaattgcgtattgaagactattgtcagagaatatgaaaaagctccagttattttctcctatctatatactgcctaacctattactccttgagcgttttctacaagcaggcaaaaaatgctatttctgaaagcaaaccctgatatgcattgcaccgccttacattgaaccgacttttccatgccatttcgctggattcgattctttgaaatgccttttggatagaagtgccaagcacaatatccctacagtcgataaattgtagtttatatattcttgctttgtcatggcttgttatgcatatccagttggagatgtactgtagaaatcagctcatttgatctatgctgaacagtttgttagatttagaaaactagatgaatttcccctacaaacgcttagctggatactgaaacaaatacgaaatatccttatgtttgaagctggtcgcgttaatatatcaatctagtacctgaggctgaaaataactgtatttgtacactaatgtagtctgtaaaggtgcaatatctgtccacagttttgctaattctatgccattataatctgaccttagcaaatcatctgtgtagtttccatcattttttctctaggatttttttattttacaaattaacaattgaatatcttgccttcttagcatatcagatgctttgaatccttccaactgtttatattctccatttctgtataggagatggttccatgtcttttgagaaaacataaagtactagtagcatgtgtcagattcatgtggtcccatgacgataaaggcagaatgattattagttgtgatatcaattgtatgacaattcatttctgtaatcatcaaattatctttccttcaatatacatgggaaggacatgaattatttgtagcttggtgtttcctatgtgctatttcctcttaataatgttgtttacaatgctgcattacataaacaagatcacagagtcccaacgtgaattgctacaagcaagagaaatgattgatgaagcacaacgttccttgtcttctagtcttgaggatcaaagctttggagatgtaccaagtggagatattgatgaagatagtgaaagactggaatctgtaaaagctgcagcagtttcctctgtagttggtgttctagctagtttacccatatctttttatgaagcccatgattttccacaattatttgttcagttgtcagttattttcataagttgtgctttgtttggagtaacattccggtatgccattaggagagatctggacaatgtccaactaaaaacaggggctgctgctgcatttgcttttgtaagaggtaaaactcgataatgctatttcataaaacttctcagcacatattcaagcacattgtcattttgtttatttgaactaaattatttgcaggccttgctatggtggaatctgggaggccctttgagctgagcactgatgccttaatatcacttgcccttgatggtgcagttagtgtggttgagaacattttgacatttctacctgctgcaattgcactggactattgttttaagatgagatttttgagtccatttcctacaagaaaacagtagttcctgcaaataatctgtaaggtccataatgccatttgttggtccaatgattgtagtaaatataccatactgcttatgtcttatattcatcatgccaaatactcgtggaatcaaaaaatcatgttgtttatcaaatagttgctttaatgtaacagctggatcttgtcctgtttctcagatattctgagatcgataactcatagctccactatgtgcttgaatagacatccttcttaagtgccctacactttgccaggactgaggcatatggacttatctgtttgtgtttctcctgtactattgatgttcactcccaggaattttttatttccacttgaatcaatgctttgggctatctgtttcatatcagcttttggtgaaatgctgcaatctgcgtaaactgatatgtgcttcatcagtccttgcccttatgcaaagagaattctttactctccatgaccatccattctttctacacaataatctatattctaatgtgcaagcacaagaaacatggtacatatctttcttcggtatgttgtatctgtcatctacattgatttatgcctgctgtaccttgcttgtctattagtgttcttccctttatttcagtattgctgtgaagcaactagctgctgaactgtgctataacctgatacagtattattctggtcattcataatgcgccaaaccggatggaactggatgacatatcattgcatcacaaatatgggtccgctggaaggtcggtactgttgagaggtggatgcagagcatgtatttctgttcttgtgagcctcagctgtcattcttcatccgtcaagccagatggaactggacacagcttgatctgttgaagctttcggtgtcatgaagaagatgaagtgcacaggtcttttttgcatactgaatgatggtggtgggggattgtgcagtgaaagagcttcatgaaccatcatctggacaaggttaccttctcaatagtctatttttattaggttattgagatgattacatgatcagcccagcattattttgctcatccccactggtttgttggtgttggctggtgctttagttctggcacaaacaactgcacgaggtctgtcatagcaacatctttggatacattgtatgtagggagctaatcaaggatgagagaactaatgaaaaccacttctatgtttgcatcctgttattatatctagaacatattttgttccaaagcagtccgctagaattttccaagctatttcagccagctgtctttactgatgtgttgaattgctcgtctggatttgcttgcttgagtaagaaagaatgtagttttgaacattttagttcctaaacaatattttgaacatattaggaatatgtgatgaaggtctagaaatcattaacaaattcttgtggttcattagtctaggacgtagggatggagtgtcaagcttgtgattctgactcagtatcatccagttggcctacaaaattgattcgaagtaatcaaatgagaaacttttatacaaataaaacaggattgaactaatggtctttggtgtagacaacatggtctaatgatataggcatctaaaagtttaaatattagtaagcagatacagggaaccttcaactgaacttttgctactacaggattaaattgcatgcctgtccctctgccagctaatagttactctgtacacctggagtcactacttgctgatggcattagataccataatacattgctgttaattgcaaacatgcaggctactgcctgttgccagctgctactggcctatgaaatcgcagcccactgtcagtgactagtctgctatggataatgtgcaagatcactagacaccaagagcaaataagcatgtgcaacttactgttgaatgataaacttggtgctacaggcctgcagtgctcaagaatctttagagcaagaacagattgagaattccatctctttggaaagctggaataatgaccatatttgcacagatgtcgagtatctcataaagtaatggctttcaatttaagcctgagtcttgatacttgcttaatctggaacaaatcttggcactcggtctaatcatgtctatatgggaatgcacatactcttccatgctatttgatataagtttgcccaatattacacaccaatttgacctgatccgttctgtcagtggggccccaacttgcacatgtaataggccacatttcggtggttggaatttttctgaatcattccctacctggtgtgattagtgactgatgtttgctgactttgaacagaatgtagcatatggctgtcgaaagtgtgcttatctaccttggtgaaagaatttacttcagtgagtcaggccaagccagttgcaaccaaaagtccattcttctgtctcctggaccattcaatcatgagactagtgtctttttataaaaccatgccatgcatttgaggatctgagctactgtctggctttctcttctggtttcatattggttctagagagatggctctaaaggtacacagttagttcatgctgatacaccatttgtccgtgtatagtgtatgctgtaaagtacaggtctttgcagtttctgtctctcttaaacaagtgcgttggattcaactcactgttcttatatctaatgagattactggtgatttatgtttttatggcactaccaggtgttcaattggctgaatcggaagaagcattctaatgtcgagtattgcaccatcaatgagaacaagggtaaggataccaggatatctctcttttatgtaccacatgttttgttgttctcatgttgtcaactcttgtttcttctcttctattttttttcctgatggagtagccatggaagagaaggaagactctctgcgtgcaagtgtgactgagcaagacactgaggccctgctgctccgtgatgtgcttattaatggtatacttgcaattggcacgctgggccacaatgtaaactcactctgtcctgagtcctgtattgaacaagatgagcccatcatcatgtgtgatgagaaagtggaacaagagaagtgcgaagaagaaaaggctgaggctaaacaggacacaccagttacagcaccaagtgaaccggcatctgctcttgagcctgccaagatgcactcatcatcgatgaaagaagacaacttcatgtgctttgtgaaggaggaaatcctaatgcatggcatggaagtggaagatgttcctaacatccaggaacgaccacttctgatgttagagaaggtggagaaagtgagaactacacttgccgatctatttgctgcagaagcattctcatcaagtgatgcagaggataagtgttacccgaaaatcgtcattgttgctggggcatccacttcaaagcctacgtcgtgcatggagaagatgcatcacaagaagccaacaaaaccaacgtcaaagccgctgaaggctacaagaaaattaagtcgagtatggttttcttcgtctctgctttatttgttaagccttgttacattatattttactagtctggaatttattacactttgttccatggtcagtgcgccacatcttacacatatgttttaccatatagctacaactggagtaagcattatgcatctagccagtctttagtggtaaatgatcactgacctggaatgcacctttttggtttttgtcatctgtaaaataagtaggtcatgaggaagatgttggggaagaagatccacccagagcagctcaatggacgtagcaatgcagagggccctgtcactgcataatgctaggtttgtggacaaaagtttcctttctctatctggcaatttattacctagagtttttttaaagctgtctgttgaactatacagggctcaaggcccttgtgttttgcatacgattttgtacctttccaaattttcttgatttttacttggattccattgtttgtaataaaattaggttaatatctgaggtagtatttgcatagaatggataccttctaccaaagttatatttgtttgtgggtcctagagctagcatgacccacgaatcacattcaagaatatagtaattcgtttaggctacatttcactaggaatagaacatatgaatattctcaggtttaataaggcagatgcaaaaaagaactgaatagcacaggaaagtaatttttccatttcaagcttctcacagtcaaaaacaagtaatggttcaaaaattgaatattctatcacctgttgcctccatttatgtggaactcacaagagggtctaagtgctgcttgacactctgacctgtatttaaataaaatgttatcacctattgcctctgcttattattgggatctcaaaacacaatctattactgtgtatgccttggcattttttaaaatctgagctgcccccttattcttcacattttctcagaaaaccatataaacttttagataaatgaagcttttattgatctcagacaattacatcaagttgatagaaccaaactaagaacacttctggcctctgataatggaactgctgtttgtttaagtagaaagaatggtgtgtgtattttaacggttggtgattgggaattgggatgcagtgaccatggagactgtgttcttcagaatatttttaagaaatagtgttttcggtggatcctatcatggaactgcctatggtggaaagagcaatacgagttgaaacatatagggattaggaagcatgggttcggactaaaatgcattcgttcctgccatgatgcaaagcttcattcgaagcaaaatgagcacatgccatggtacagtggcgtgcaacgagcactgcaattgcacacgacgtgcatgttctgaaaaaggccagtggacactagacatgcagctaatcctcttttgatgaattctatcatgaaaccaatggattcgttgaaaatctgaacaaattgatggatttggtcccagctgtagaaaggttggcaaactcttctcgctcctgtattattgtaggctggagctatgatggaccaaatcatcagaagcaaatttcaccatatataagcatctacttttatctttttctctattttaaaatgtgatcatagtgaagttatatacattctatctgcttaacgctccacattatccaaaaaaatgcatcacactccatattgggaacacgttggtggttctgaaccaaagtcgatctcttgatgccaattttttttttgagctggttgagtagtcgaactgggaacaattactgcttgaggctacaaaatttctggccgacaatacgtcttgatcaggaactgactaaagaaattccctttcaccttttgcgggatttgttggatccatcctcacgcttcggattccttgctcaagagaaacatccatgcatatcgtcgacagcgttcgttcagtcctcttccttttgttgttggtgctgttgttattattgttattgttattgctgcctattcgctcgccagtgatgaagaatagtcctgcctatatttgcctgtagtacattgtaaagctacagttgacgtgtcttgtaagacccttattattattgtccataccacgacgtctcatcatcgtgttcctgtcgagattaataaacctctatcctatccgttctgctacctctcctaccctttaactgtgtactcgtttactaatccactcaatccctgtctcgtccatggtccatggctggattggctgcagcagctgcaactgctgtgaataaataaataaactagacgagtggttgcagtggtgctctgcaccaaagcagttcagtgtttatacaacaaaacaaggcgaaactgccaaagcagcagcttagctagcggaatggcagctgatgattgtaagcgtaaaggtaagcatcggcgcgtgaagctcataccctcatgcttgcttgctgctgctgcacgttgctgttcccgtctcgccatcggttcgatctagacgggtcgacggcgagacgggaggcgatcgattatcgataccaccagcagcaatactggtgctctccatcggtgggcgccgtgtcggacttcggttggtcgccctcatcatgccggatctgaaacctgacgcccacgccttcttcttcctcgtctcctcttcttcttctagcggggccttcttatgtcggcctagtctgacagagatggagaatttcagttgagatgcgcttgatattacagtgataactgacaagagtatgtgatttcaaccttaagatcatgtttaattcttaagacgctcacagtttcttcttatttatttgacaactaagtttcacgcgaagtagtttaatttttgttgtctaacaaaggcggataatttcatataacacgttcttgtagtgatcaaaagttacctcctcttgaagctgcaaaggggtgcagccgatggcaatggaggctggtaaggagtgagaggcgcggctaacggcgggaggccggactgcacgatagacgtgtccggtggtggagaaggccgacgtggcgcgatgaggcgtagccagcggtaaaggtggcgaccacgatgtgaggaggagctgtcggtgagtgtggcgctgtcttcgacgcacgaaggctagccggcggggggcgttcccacatgtcggcagaggatgagtggtggtggagcatcggtgcgacagccgtggactcgcaggtgatgagcagcgggtgaaaacccagcccggccttggccggaccgacaacgatgattctttcccccctcctaagggcgttgtcgtgccgtctcgtccttcaagggtggttgctgggtaaaagcccagtcgtggctcctttaagttcctgacggacggcgcggcggttttccgtcgcttctatccttggagacgtcgtttaggcatccccttgctgaaaccactcgaacgattggtgcaagcacgctctagatagagttgggctttgtgttggttgtaagggcgttttttggcattctcggctgtgttcctttattggcctagcggcaattggtccgttgctagctttctcctggacctgtgtgttgacgttgtctgtgtatgtggtggtttatttttgtccttttttctggttacgaccttccaggattgtaatcttgtaatttttttcgctttatcaatagaactttgcaccgtctcgtgcaagtcgttaaaaaaaaagttacctcctcatatttcacgtgaaacaattcaattctcgtagcgatcgaaagttacttccgttgcaaacggagatttgtgagttgtatgttgagtgccgcactgatcgacagtcactgccactaaactgattgatgatggggtgtcttctcaaattctgggcgttgtgctcatagcctttgcgacgcactgatgatggattctgtttctatggtaacagaggggtgacgatgatgcagcactgctttgtgcgcttcccaaaagcaaagatacactctgtcacgaaacagattaaaatctcttcatgtgttatctctcttatgtgcgaaatctctccatgtttatctaatttatgtgccagtagtgcctgaacgttcatagttttcgagcaaacggttcagaacttcatatcgacttctcctaagaaattgttcaaaactgtactacgttcttcgcatacagtagagttgagctaagtgttagttgggctgcatataagcccaattacatcaaacaaattgctggctgggccaatcttaaattggagcagaagaacatgaacctaaggttgaatgcacggattatggggatttttcgtctctctctctcctcatttgtcttttgatttatcgactacagttaaatttaaattttaaaacttaattttagagctgattttgaggggttttttaaatatatttttcttgcctttggcttttagaccacgaatgatatagatataaagttctggctataaattagttttcgtgttgcttgacttgcttgctttgttcatatttctacactttatcagtcgtaactcagatgatcagagccatactaaccccttcaaacatatatcttgagtgaattttatattataaagtacctgaattttcctcttccattagtacacatgttgagccgcccatatagagtaaaaaaaatcatgagcatataagggatgaggaaagactcaaaaaatatcgaaggttcgtcaagtcaaggactggggtccaaaccgtttaatcctctttttttttttgggagactgctatacagcagaatcccgtttaggtgagacaataccggttaggtatcatgttctggtattagtaccagattctagatgttaatacttgttgatatcacctgatacttgttgatatcatagcgatacctaccagatataaggagtcaagcaccgaagcgtcatcgccggtggccgtatcttctgcgttgaccagatccttcactgtcacgccttacgccggagctcgtcaccggcggccctactattcacaccccacgtcggagctcattgccagcggccgcgtcctcctttcactgagcaggtcctcttccccgacacacgacggaggtcctcacaagcggccacctcctcctcgctgctcagcttgtcgggacaaggggatcccgtctcgccgaagctcgtcgccgatggccatgtcctcctcccgctgagcaagccctcttccttggcccgcgttgaaagtcttcgcaggcggccaccttctcctcgctgctcagctcgtcgggacaaggggatctcgtcccgataggatcccggcatgtagcatttccaagtgctaattttttcccttatatttacctgaattaaattgattcttataaaaaaaatctacaagattatataaaatcaatgtatttcaaacgatggttgaaattgaaagcctttttaagaaattcaaggatcaaaattgccgtcccgcgaaaattgtaaatgcaattacttagttgaaaaatccacaacaatgttgtgctaaatattcatttcattcttgaacaagaagcctattatattattcttggaagctttggcatatttacactttctcgagatccccgcatccaagccgtccatctcgatctggacggtacagaaacgtgtcacgcctctccatccacctgtcgcatctaccattagcccccacctcctccccccctcttataacgcgtcgccttcccttcgccatgtccgtctccgccgccgtcgccgccgcctccacctcccgtaccctcgtcctcgcccgccaccgctcgccgccggcgtctagggtcgcggcgacaagccgcgggcgtccgttctcctccggcccccatcccctcgccgtctctcccgccacccgcgcccccgccatggccaccgacggcgccgccgccgccgccgcggcagggtcgaagaagaagaaggaggtgctcatcttcgacgccgaggaggacctcgcggtgtccctggcgaagtacacggcggagctgtccgcgaagctcgccgccgagaggggcgccttcaccgtcgtgctctccggcggatccctcatcaagaacatcaggtgattttgattgcttggaccccagagatcgcgcgtttcttgggttgcttcctcttcctccgggtgttctcggatcgcgtaaggaatctctcgccgttttggttggtggtggcgcaggaagctcgcggagccaccgtacctggattcggtggattggagcaagtggcatgtgttctgggtggacgagagggtggtgcccaaggaccatgaggatagcaactacaagctcgccttggatgggtttctctccaaggtattccctcgcgagctctggatttcttctttccgaaactgcttgtcctagtcgtcgtttcggcctggatgcatgatctgctcggggcatgatcaggctatttagggatcataatatttttgtggtttagagtgatggaaattcattcaggaatagaattctggtaatgcttgggttaactgaagatgaaaacaaagaaccgtgatgaagaacagattcaggttttcagacttagagcatctccaatagcctctttattccactctccaagccaaatgttagcaactttggacaaaaaatacactccaacttagggcctgcttggcaacttcgaaaaattttgcaccggtaaagatattacacttgtatttttcggggtcccgaaaattcccttttggttacggaggaaaagtttttccaggcaaatgatgtttgggcaaagagcaatgggtatatcacaatatttccattactgcagcaataggtacccattctgaaacatctttttctataaactgaaatcaaatagaaaaccaactgattataaagaattttcattacaaatcaggaagaactgcaatcgatacttgcaatttataaaagaaataagaggcaacaaatttgaatgagaaaacaatgatcttgaggaatttcaatcttgcctgctaagatctgaaataacaaagaaactcaaaagctgacaaaccagaactcaatctttcatcttgtgaaaataacaccaagcttctccttccaatccctcggtgtggcaccgggcgtagcgctgtgaaacgagcttgaggctgaccttgcccatcaccggataggagagaagcagggggaactgttgcgccagcctccgaagagggctaggtgagggtgcagagtgctgctagagctagaggaaagcctgctggccactggtaagaagctgatcgagctagaggcggcggccatgggatagaggggagaggagcgcagcacgagcacaaggagaggcgaagcggcgagcctgacttctgtcattttatttgtgtggcctgaggaggtgttactgttcttccgggtgtaatgggcattttccggcggattttaatccgataacagcccatccaagcagtcctttccagcccgtccagtaaaaactcatggaccggtattttacaccggttttgaaccaaaaaccgggcttccaagcaggcccttgtgggaagcggttgattgatatgttttctgcagtgtactagatctgtaacaaaaacacttgtgcttctcatccagtttacagaacctctactgctctctgtgagttatcggcataagcattttgattgaccaatgatgaaacgctttattcgactgtgggcagtgggattttataatctgcttgcctgtatccatgctcaattgtttgaaattgtgccaaccatttgaaatataccgtgaaatgaactatagtggttttttgtggataatggataatgaatcattagtatccgcaactgtgaatatttaggaaataagttgttgaagtggtgatccgagatgcattcttgtgtctacttattgcattttcatcagttttctggtgtgcgtgtaaatttctttgctgtgtattcagaagtactccttaactaggttcttcctttcgaatttctaggtcccaattcctactggccaagtttatgctataaatgatgccttgtcagctgagggagcagcggatgactatgaaacttgcttgaagcaacttgtcaagaatggtgtgattgcaatgtcgcaatcgactgggtttcctaggtttgatgtcatgctcctgggaatgggccctgatggccatattgcatctcttttcccaggccaccctcttgttaatgaaaacaagaagtgggtcacctacatcaaggattctccaaagccaccacctgagagaattacgtttacatttcctgtgatcaactcatctgcgtatgtcgcaatggtggtcactggagctgggaaagctggtgcagtgcagaaagcactttcagataagcagacttcgtctgatttgctgcctgtagaaatggctgtacttcaagatggggaattcacttggttcactgacaagccagcagtgtcaatgttacagaacaaatgaggtccatgcctggatattgtttaagctttcatcttaaataaagatccaggggctaatcccagcctggatactgcttaagctttcaatccaaagctgggttgtaatgatcttctgtctaaaaaaggatccaggtgactgcatagttgcattcctcttttatgcatcacttgtaaggaaaacatgagcatgtatgttgtatgttgttcagagtgatgtatctgagacactcctggtttcgacttagtaaataacctttcctggcccttgctcaagtgtctatgtttgttaaatttgcgcggttaataaaccggcgatcaacttatctacatattttgcaaattcagatagagaactcattttgtgcatgttattcaaatggtttcaattcaagacacaattctttttgtttactgattgaagtgatgccaatgctgcttgacaaagtgaggtaaactgtgatacaagcttggagacctgcatgattctgcattattcactattaagaggagtcttattcagagtgtattgcgagtaccttcagtttccagtttagtaaatcacctcttttgggcgttgcattggaaatatttagatgttcagctgccacttgtcaatacctgtaattgttagtttattgtgtatactgttccatccacagacaatccatatctttttactgcatttgcacttcagaacggcaccaatttcgctcgctttcagctgcctgtacatcgcaaggggctagtgattattcaatttttagagccatgcataggtagtgtacaggttgatctgtaagatttatattttcaggcagtactgcacgaggatgaatttacttaggcagcagcctaaatggctgtacgttcaaggcagggaactcagaactgattagcaacatggcctttctacccaacataaatcgcgcattagttgtgctgtctgacactgacctcggtacatttctggcatctaaattttcatagacattcacattttgggcaataatagcatgttgacccgttgacaaattatttcacatatttaaccgtaaggaattttggaggaatttcataagaatcgaactactcgttaataatatttgacgttaggagtactagtactcttagcatattttgaagttgggagcactaattgtaatactggaagtagtgaattttatgaaaagttctataaattccatactcctatgttccaaagaagccttaatcatatgataattgaacttattcctaaggccgagtttagttccaaagtttttcttcaaactttcaatttttccatcacatcaaaactgtcctacacacacaaactttcaatttttgcgtgaactgaacacgccctaaaagaaattataaattccatccatttcaaagaagccttaattggataattgaacaccacgttttcgacatgatttggcaggccaaccgtggtggacacatccagagtgaatgcagggagacgagacgatggaccatggctgcattcccctcgtgctgccacgggctctcggccggccaagccaagccgccgcaccgcccatttcggccatttgcaccggcatttgcagccatggtcctccatccatctgcaacgcactccaaaaatcccaacaaacaagcagcagcaacacatgattccatgagctgctccagtgaaagcttctgctgccactcgatctccagtttgcagcaagatattactaatccagtacctaacctctcacccaggttcatgtgaggtgtgaccctatctcctctcaagactcacatgagctttggagcaaaagaacatggcctagaatctagggcactcttaaaaatctaacctattagtttcaaaagaaaaaaaaatctaaccttggccatgttagaggctcatcatggtgtggcatggaattctttttttgttcggataaataaaactgaaagattcagaagcctgatcttggggacacgttgctcgtcactacatgaggagagctccatcgttgctgctgttggtttccccacaaaactactccgcatgttcaactgtctcatgtaagatcatattaaaattcttggtgttgcaacttgcaaattgtgactttgtgactgaactcatctgtccaaattttgtgtgtgatcgaattaagaaggatactggatatatagagaattgttaattaacatgtggtagcagaatagatgataggatctttcattttttttgccgcagcaattgataaagagaagagaaaggtaaaggtgttcgtcaaaggtgcgaccagtgcagaaaaaaatttggggtggttatgattgccggacagacctgaccgatcgatttgcttttgtcttaaggttttgtgcttttttttgggcctgctttattctaaccatgcgtattgaattaaatcaaaatttagctggagtacgtaataacttgaatacgaaatacatacgaatttctgaagaaatttgcagccattacatgagaaaacacgcgcgttattgtcatgtatgattgcgtatggttgttaatttggcttggctgcatccacaaaagattttgatgactcgttcaatgagtcggtccacgcgaaatattctccaattttttcttcgttttttttcgagcatatttgatccgttgacaaggtgaggatttccatgagctaaacgtgtcaggtcacaagtcaatcagtgttgatcacgcccatgccattttatagttcacacgtacattgacctacctgaaattagtgcaggattaggttagaaaaaaaagttaattagtggttgggattttcatgggcttcttctcctggataaaaccgtgtggatttggtccactctgaatggttcattcaaaatttagcattgcaagtacacaccttttagacaaacatttagacctattataagcctaccaaatctcgcatgaattgagttaaaatacactcaagtagatgcatataaaaaaatcagaaaaacaaacacgctattaaagtatgaacaaattttcaggtcaaccaacccagtctccttttgtccttacaacctaagcttagttattcagacaaacataaaattgccaaagaaagagttcaagaatgtatccccactttgaatatttttttaaaaaattaaaaaaaaaatcaaagaactaaccgaattcaaaccaaaggtacatcggttctattcgtaccaaaaattcctttgaaactactagtatatgattctcatcctctacttgttttgtttataagctgcaactaatatcgaaacgtaaccttagagttgatttaagatttttttcttttattctactaaagctattatccagtcttaataacctctataatataatttttactatacagacataaaaagttttacctaaactaataacctaataacatgttctttttccaatggtttatcaaccgacaagagcccaagatttaccaaaccgtttggattgggactactatcaccttatgatataacgattatcacgaaaaccacgtggttaccacgaagtatatcgtggttaaaaaactgaaaatgttatttcacacgataactgcacggttttatagacatttcgggagcccaaaagtttcagaacagatccacaaatgtggtgggcccacaccgccagcctctcccactgacacctaggccccacaagaaggacagggccggtgggtcccacgtggcaggccggaacaaagacccgtttaaacgcgcacggcacccacccactcctctctccctcttcttgtgtgtgtgtgggtgtggctttattggcgtcacatgcgccctcttttcctctctctgtttttcttctttttctctctctatctcttcgcttacgagcttaaagagacaacgagttaaagccgaggaagaaaaaaaaaaccaaccgatttttttttaattaaccggcgcctcctccttgcgcggcgtgcgttcgccggcggcgagatcctgcggcggcggaggaggaggaggaggaggaggaggagggggatggagtggtgggggccgggggagtggtggcgctggtagtggcggggacggggagtggttggttgggtttggggagtttggtgggtgagagagggggagagggagaggggacatgaaggcgctgcggcgatccagcacctcgtcctccccgtcgtcgtcgtcctcgtcgccgacggccgcgtcgtccccgccgtcctcgtcgtggatccacctccggtcgctgctcgtcgccgcggcgtcgtcgtcttcgtcggcgtcgtcgtcggcggcggcgggaagctccgtggccatggtgtccgcttcggcgcccgccgcgtcgtcgtcgccgtcgccgtcgccagcgcccgcccccgcgccgtcctcgccgcactcggatcggtgggttttctccctctccttcggattggtgaaaaggaggagtaaaaatgactccttttttagtcctttccttttgggggcgtcttgatctgcttcccgtggagtctagcctcacatgttctgatctaattggtggtctggaggctgcttaggtgctcatgttatggtttttttgtgcgcctcaatccaaccaagtctttggatttcagcttaagagtgcagtaaaacgttagagtgacagcctggcttaattgtgtgcctagcaattcctgcctcgtgcaggaaggttgcggggcctgcaatccaaactgaggacaccggatttttaagagcgaatcgattatgtgttcaatctgttgacatgatagtgggggagattcggtttgttgattcagagagatcatggattctgttgcagagtggtttgcttactctaaaggtgccttccgtctaagttctagtgtgataagattttgtcatagtttagtggcagcgttagtgctgaatgcagcttgcacaattgcctcaagatatgttgatgatgtgatgctgttggtggtttgaacaagggacagcttgctgctatcttgaattatgtgctttaggttgttggatggcatggtatttaagaccttggaggtgatcctgtcccctaaggtagcaaatttagtttctaagaataatagggggggtgcttgatgtttccttttggtttgggagtgaagctgtggcactgtaaatgctacctaaaagtttggatcttccatgagttgaacaattttgctgacctgaataggtatcaccgtaaatcacaagagtttttagatgatacacctccagttttcctgtgatctgctcttgttccgtagttatctcttgtcaagtttgctttcaacttatttgttcactgatctaggtattatattgaactgcatgttgactataacgattcctttttgtagcccaggtcctcagataactcataactatgaatcattgcctagaaaatcgttttatgtggtcatcttttcttaatccaattaccaagttcaataccatcaatttttttcactagcgtatggtgttagggaccctgtttcatccacagattccatagtattgtctgatttatgcctcttgatcgatgtatgtattattcagctatgtagttttgtttagataatggataaaattgtatggttagttcaaaatatggtagaccatactgcttgattaagaatcagttcatgctgcgcataacgaatgtatccttgacgctgcacaattatgttcttaacagcactttgaaacaataactaggaggaagtttttcagtatcacgtttgtttcgtaaactaattaataccttaatatctgtctattttatgaatttgttttatatccaaccttttcgtgtgcatacaaattatatgtgaagttggatttatgaggactcaaagcattccctcttcggatgctgtagcttagagagtgtgttaaagatggtactattagttagtctgtcagttggtatggcagtgttatcttttattgatccatatcttccttgttgctccactttctaaaactattctttaatcttctttcaggggtggaataaagtctccatggtctcgaaggaaaagaaaacgagtactttctcgtcaacaatgggaaggtctgttttctgctaatgggaaacttcgtgatcgaggaaagaagtttctgaagaaagttcgcagcggggtaagtttgattatctatttgtttagatgtcctgcatatgtttacaagaatacttgcctattgttttgtttgttcaaagatttagacatatatagtagtgatattgaaagcatgttctgcatcttactccgtacagtctaattaatatactggccttttttttctgttgtgtcagggcattgaaccaggaatcagggctgaagtttggcccttcctgctaggagtgtgagttttttaatctcttctatgcatctagtaattcataagctttcgtttctttgaccaagtttgaggtcgcaactacatacacgtagacttcctatagcacctaattggttatgtgaccacatggagtgtgcatgttttgtgtagctctacgggacggctccgattcatggactagggtccttccttactgtttcccataatgaaaaggtttaggattatcagttagagaagatagttcttcatggcaatataatacaccattcttagtatttgaatccaggataattaataccttcatactacctctgtcccaaaaagacttcatttctcagttcttgtccaggtgcatagccagaaatgaagtctttgtggggcagaggtagtaacatcttttccagtttggttttggttgatgtgataaattgtatggttgttgtcataaagtctgttcggattgttgtgttgtgtttaatgtattctgtcttcaaaccaagagagattgacgctgtcaattcttatgtgcagctatgatttaaatagcacagaagacgaaaggaataccatcaaaatcaagaaaaggtattatattcattgctctgaaaggctgttcaatttaagtaggattgaaacattttgctcaatgtgctgtgtttccatcaagctacactaaaagcccaaccactaatatgtaacatagcagaagatccccaagtagtttcagaacatcaatattgttattttgcaatggcctaaagaaaatgagactatgatattctaaatgcgaccaatataatttctaatctgataagaacttgttgattgatgtggcttttggttcaggaaagagtatgaaaagttgaggcgacagtgccagcaaattctgaattgttacaagggcaatgggctgaaagtaataaatgaaaataatgaggagtgttctggtatagagtttagtgctgaaggatcagaatcaccttgttttgaagatgtcaatattgcaagggcttctgtgtcacatgaggagctgaaacctgaatccgagcctgagcaaccagataactcaatgtgtgctgttacagaatgtatggaagaagacacgggtgaattaatttgtttagatccttgcatagcagagtcagaatcttctgattctgaatcatctgatgaagatgaccctggaaggatatcgatgtctggtgaggaaaattgtgatccagatcctaaatttaccaggactacttcattcaaggcagacttttttaagtctagcaagacttcagaggattttgccacgtggcaacgcattataaggttggatgctatccgagcaaacacagaatggattctgttctctcgcaaccaggccgaaatttctagagagagagctttgcagtgtgcagaatctgttgggttaagagattatgaccatttagatcccagtatgatttatcatgctgctcgattagtggggcttcttgaagcatatgcggtctatgatccagaaatcggttactgtcaaggtatgagtgatcttttatctccaataattgcagtgatggaggaggacgatgaagcattttggtgctttgtgggtttcatgaggaaagccaggcacaacttcaggcttgatgaggttggaataagaaggcagttgaagattgtctctcagattatcaagcgaaaagattcgcacctgtacaagcacctgcagaagctgcaagctgaggactgcttctttgtgtacagaatggtagtggttctcttcaggagggagctcacctttgagcagaccgtatgcctttgggaggttatgtgggctgatcaggcggcgattcgcgctggtattgggagatccacctgggcaaaaataaggttgcgtgctccaccaaccgacgacttgttgctttatgccattgcggcttgcgtcctccagaggaggaagctgataatcgagaagtatagtagcatggacgagatattgcgagaatgcaatagcatggctgggcaactggacgtctggaggctactcgacgacgcacacgacctggttgttaacttccacgacaaaatctgatctgagggatgcgtttctctttgttcttgcggtagaacaaatatagacctcgacattttttttttttgggggggggggggggggtttctttgctgcttgcagaaaagtgttatgttccctgtagctcgtaccggcatagaacattagaacccacttctaagtatagagattgttgtaacttaaaaagagtgaggactcgagtgttcctcacacacgaagatcagcaatactgcttgatgttactgaggctctgcagactactactattcattgtttaacctgttataggcacggacagatttttcattgaaaggtatatctgtgtatgcctgtatggtctgtcatattgttttctccaataatttgggcttcgtttgggatttgggagaagtttcttgttcatgtgggaatcaaattgtatcgtctgaaatcgatgcctctaaacatttggcttcaaaacgcacccttctgtttcttgtttgattgatacctgggacttgggagcagcatggcaagcgaattctagcctgacaatcgtaatcctttatgcaggaaaataaaggtaacaaaaccaagcaaatttgagttggccgatgacgtattttgctttgaatcctattattctggagtgctttcagcatgttcaattatatactctctctctctctgatttatattataaaatattttgatttttttctaagccaacttctttaattttaattaaatttgtagaaaaatgtagaactacttttagcactaaacagatagtctcataataccctgcaaaaaatatagtctcaaaatacatttaatattagatttagtgaaattaattttttgttatagattttggtatgattttttcaaaaatatggttaaagtcaagaaaaattgacatagaaatgaaacaggagagtacttttttgaaagcccaaaacatgcatacaaagttcttaaaacgaaacagaaagcaaaacatactggggaattggggataccggtttctatcacgaaaccaagctggggcagttcaattatatacttaaaaagacatttaccagttctccttttactgtgattaacagaacgattttcaatattactattagaccttgttcggtttagagggagttgaagatgattgaaggggattgagggggaataatttcacaccacaataggtgtgaaataaatcatctccaatccctccctcacagagattaaatgaacaaggccttagtgagtaaaactacaacgctatggagaagtactactccgtaaatcaaggatacaaattagtatatcatacatgggttagtgtcaaaatttggccaaggtatcatacaagttatttactccccccgtcttaatataagtgtaacctaggataaacgtgacatatcgtagtgctacgaatctagtatatgtttcatccaccataggttgcacttatattgagatggagaataaaatttagtaatacactacttcctctgtcccgtaaaggcgatcgttttatactcacaaaatatcctatatagattatcataccagttttgtcggatcatatagtacttgaattattcttgtccacttgtttgaattaaatgcatgtgcgtatttattgttatttctcaaccactcaaaccacctttgatgaaggaggataaattggaaatttacacatgagctaatttatcctataatccttagaacatcaatctttctgggacagggagagtaatagcttatcttacatttcttttctaagagtttgataaaacaaactagctactactgtagtaaccatctcaaaacaagcccacagcattctgctaacagtctatcagatatatatgggtatcccgtacacgtttcgattgtcttctttctgccgcatggtggattgccctgagtgacaagacaaggaacatatcaaatcgtagtatgatgaagctctccatgttggggtagccacaagttgtcgtagggcataactttgttgtcggattcatatttctaaacaactttccaatgtggcgtacaaaatttcatggcgtattttttttccaagttacatggaaatatgtaaaatatgcatgtacaattcattttattttctaaccttttaaatataattttaaaataaactcctcttaagcatatttataaatctgaaccatttgcctactgtaatgttgagatagaataatgttgttgcgtcacttaagagaccaatgatatggcaaatcattgttgtcattccatgccatgaacaatagttctataatattttttttcaattattgatactttttaaaacaagttatttaagagtttagtttttaaaatataaaggaaatactatctccatttttaaataacttgtagctgaactattcatgcttaaactttaatctctcatttttttcttaaaaaatacaaatatttaagaaaatactatattatcgaagtatatgtatattgcatatatcttaaacataggcataaaacttcttccatttattacagtaaaaataggaaatgaaaatgtgatagtcaacgctaacaattattcgaaaatggatcagcaagcaatacaattcattgcatcagggttcgaaattttgtttcaacatttcggcccccaggaacgaaactatagcatccgaaattctaatatatccgtgaatttagctaattttattcagattatgacatgtggatctaatggtaaatccttaattatcacttgtatggcaaatagttaaatatctcaaaattgaaattatatcagaccgaaatatacattccaaaatttctgaaatttcggatttatcgtgaaccctctgcaaatggcatacgtacgaaggacggagcgcacaccgtcgatagtgagacctctcgactgcccaccgctttgcaagtctcggcttcttcatcaaagctcaaacgaccaaagcgatcatatcgcgacacagtcgagtcaccctgcacctaagcctgcgcgctactgaagatctctcgatctcatctcatgcgtcaactgatcgagatctgcagctagctacagctatagctttagctatcggtcgccacctcgtacgtcgtctacctctagctacagctcccatggctgacatgcgagcacgacggcgacggcgagatcgacagccggcaagccaccgtgcgtccgggctccctgcaggtgaactgtatgacagggaagcctcatcgactctcccctcaaacactagatgccgttgctactgtgtagccctattaccctatatattcctgagcctagatatccattacaaattatgaggttgtacatatcgatattatttcaaatcataccatttttttaagttgttcaatatgtgcatctatttagtttcttttttatcaaactctgataaatatataagaagtcctgccaaaacctggcaatattgctaaattgtcaaaattttggtattgtcaaattttgataaagtttattttgagtacaatctgaacataccatatatttcaaaacctccaaatatagtatgagataaagataaaaatatgtaaattacactagttgaatcttaagttccgtttggtagaactccaattcctaaatttaactccaaaagttaggtatgtagtaaagttatagaacagtctaaacctagctccactactattttagatggaactgaaattgtttggttaggccccaacttcaagagagatgaagatgaagccagtactgcaccaacatgctcttaggcaagaaaattctggctatgccttcaaacatgttatagcaacaacatccagctgctgccatgcatgtctaagttagctacaccatacgtttcaaattatttatagttatcattttaatttatcctaaatcaaatatatttataaccattaatttttattcgtgtgattcaataacatgtgaattatacgcataaaagtatttctcatggtgaatttaaaaatataaatcttatggtgtaaaactatatgagtttacagaaaatattattcaaagagattaaaatgcttgaattgggataatcctaaagcgataagtaatttaaaatgtgggagtaattaactgtctagacagacacaagcatggtggagatgatgagtgattcgatcacttgcgcaatcggcaccagcaggtgggttggatcgatggttcgttcaacttcaaatcagaggttcggttcagaagatacggcagtatcacctatctgcttctctgataagtggattggcatgcatggtgagctaatgtctactaatactttaaatttgaaagattgggcttattcgtttcaaaggaattgcaaaggaaaagcataggaataggaatgggttttaaactaccattcgttttataggaatgcaccatagaaaaactataggaaagttttccattcctccatttataaaggaaaagcataggaaaaaataatccactccaacctaatgtttgcattcctttggttggattgctcaacaacataggaaaaattcctgtgtttctcaatccataggtttgcacatgtattcctatagtattcctacgtttttcctattcctacgttttgaaaatcctgtgaaccgaatgagccctgagtgaattgttgctgcggctgatctacttaattataaggacaaattgaatattttaacaaataaacttaataaataacttaaaataagtacatgatccaaacaatacgataaattttttttataaaaaaatatatcttttaaagcatgaaacaaatcattcgtttcatcaatctgataaacatttcgaaaagaaacattcatcttgctgaatgctgatgagctatatcattgcttcaactggcactacacagtggctacacacctacatacccactggcctggtcgatcaatctgcatttgcacgtgtggggattgaactgcatttgaggttgcaaacttgcaatgggggacagagagatcagaagtgtctcaccactggagtctcttctcgtgtgtgtgcgcttcaattctctgatcatttgagccagaaacctttttgtgcatcaccccctggtagtgatatgccagtgcacagctatatacagcactgcaaaagtgcagtaggaacaaagcttagctgaggctttagtagagtggagaaagtaatatttgcaggtggtgaccaagcattagcttgggtttcgattattctctgtctgtttccaccttgcatcgtgcggcagcaacatatgttccgagtggaaacactagtactcctggattgtaacgagatagggggctttgcccatgcgctgagctgacgagtcaccagaaaaatgtcttctcttgtttggattgcaacgcattttcccattttctataaaaaccagcaccgatatagacctcaatagccgcacgcgaaaaaaataccatggaaatctaatcgttatgaagatgagcactgctatggtgctctctacttgtagtattctactacaagtagaagcaatctgagccattaatttataagggcaaattagtattttactaatttatggttaagggtaatttttaacttttacttttttttcttaatagtaggatcagttcgtctgtgtcaccgcttctttcgttctcgcgtgcgcccgactccggcggcagtgcccactccggcatgtgcgagctcctccgttgaacagataatactacaaagaactactgaacaaagctatatagtcaaatcgaggagcaagagcaaatgtgctgttataaactcaccatgattatctttaaaacctatttattagtttctccacatgttgtgttttcagttcttaaagaattaagccattaacatcgctaaatttgtccaagatggtaccgaagtatttaagttcagagtggtcatttgctcagttcaaagcgatgctcaaaacaccgtaatattgattggcttcgatggcgttgaaatcgttgaattgatctgacttcttgtcgtggttcagggcttcaggctcgctagttatatgtctccttctcgggcctggcgtggaacgcatactgatctctagcatttgagccgctgggcaaggagtagcctcccgaggctgatcccccgccgtaatcccgcaacgatctcatggaagcacgccgccgatctgctcatcgcatctgctccgccacactcaccctaaacctagcacggcccaacgatgctcaagtgtttctaactgatatgcaaaattacgaattcaaccatcccgtccatattttttggacgattataccctctaacgtttctactaccgctatttaagataggagtataaatagatctgacccattagatataaaacgatcaacggtttagattaatttatactccgagtagaaagcaccggagtgggactctatgaagatactaacatataatatttgttactgaggttaacgtaaaattagtgttcgcctagaccatatagtttagacggtctagaccctaaatgttgggttaacttggaattagactgttcgactgtccagtcagtcaaaaccaattcgaacactatctagaccacataattagacaatatatagacaagtgtaaattgtaaacctgtcgttttagactatggcctaggcaatgggccaatgcattttttgtgtggcaggagttaaaacttcgagcccaatccaaagtgcatatggtttaaggttttgacctcattccaaacctttctcctctactctaagccagtcactgcaattaacttacgtcgtctcttctctgctattcgtcattgtggaccttgctgcatatttgtccggcccatggctttactcgagtggttgtacctatataaagctgctagttcttcaatatttatggaacatgttaagtgtataaaaaaaatgacgataatatagtgtacggcatatcgtctagactagctagactctataccatgggtcaccgtccgtctagcgtttagcgtctaggtgaatactgggtaaaacatacatccctgagacactaattgcaagcactctttcccaatctgacataattacagtgtatcaaggtatcaacaaatctcaatctgcttgaaccacttgccattgttcccttgcatatgttactgtccccatgcagttatattgtgtttgtatctctattaagggagagtttaggataagagtcagactatatttttttatcttgcatatgttataactctaaatcctacttcctttgtctcaaaatataagtatctagcttgtttttggagagattaaggattatggtgcaaggtaaaaatttattatattctaaggctaggtagttggtttgatatagattgctaggggtagggtgaaaaagtaagtgaaaaaaaaaatcaccttttacaattctaggtagctactccctccgctcctatttgatcttcatagaagtttttttcatcaaagatgaggatggcttaacttccatgcatttcatttaatatgagtatgttttcttgtgtttctatgttgtcctggatagctggtagccccagtgtggtcacgcccagaaattcccgaatagaattccaagcagaatgtgtattaaaatccccgtccaggaccggccggggtacacaaacgacaatgttgacattcagatccatatcttacaaacatcataaaagtcttacataaatacagtggaaaaacgaaagacaacaggagctaagccttgactagaactgcagcgggaacaccactccacaggcatcctcgatggcacggacgaagcctactcctcggagaaacctccatctgacacatactcgtactctggggttggggaaaatagagcaagactgagtactacccactgtactcagcaagtcataccggaataggggtatgatgtagggaattatcaaaagagagctaaagtggttcatttgcataaagcgagcatttataaacagaagttgaaagaattaaacagttgcaataattaattaatattgatcatcggctgtccaacgccatcccacgttgcaacaggcccaaccatccacctatactatccaatttcattagactaaactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagatgccgtgacaggaccctttgcataaccccctctaaccaagcacaccacacctcaggtttcacccccactcctcgcaaggcagcgggcagtcccctctcgtacctaggtgaatccagaagcgacagaggccgtcgcagggcccgccccgctccatcacgcccacccttgcctggatgcgtcagctagaggaaagctacactacaagcccagccgttgcccacactggcttgtggtaagtacgataagttcttccagggcatcccgcgaaccggtccttaactgccatgggtgcgactagcaaaatcatgcacccacagcccaccgtgtgattcattttaattaaccaacaccaaagcggtggtactaaaccaacattatcatatgaacctacagtctaaacattaataggattttccccactgtgtactagttgaactaagcatggctaagcaactcctagtccaacgtctattcatgttataacccaagctaaaaaaggagcagggtaccaaaatagcatggctgtaacaataggtaaacatcccatagtgatattgcaaaacaaatgtagtatttgaaagaaaacattagaacatttgcaatatagtatcaacatgatcaagtgacaagcatgacttgccttgctctgctgctggagaaacctcggcgactatttcgaagtacaccggagcgtcggaagaaccggaatctagcgacatacaaggcaaacattgcaaacaggctataagactactgaaacagagaacaaaaccatttttaatggattctacacatttttcttgatttactgagacttgaatgggcttaaacggagctcggatgaattagttatgaattttagaagattcactgtgtttattactataacaaaaagtccttaaatcatttattgcgcaataattcccagggctgacatcatcaagggggcggcgccgacgggtgggtcccactggtcagtggctcgggagagaggggaaggggcggcggcacgtgggccccactcggcagcggctcaagggggggcggtccaccgtggaccgggaccacagggtgatccaccgccggtccacgggaccgacggcccagatcggccccgagccgatcgggcggtggcgatagaggtggccgccgggctcggctcagcatcaaagccggccggccggccagggctagcggcgatgacacgcggccgacggcgacggcgaccggcggcacgggaggcggcggtggcggccgaaggcaacggcgcatgacttgaagcggcggcgcggcactaggagggagagggaggggagtaaaggggagaggacgcctcaccgagggtggccggcgcggaggaagatgacggcgaacggcgacggcaagccacgggaggacgacggcaaccggcggacgggcttcggggtgccctaaggaaggaggagagagagattagagagagggagatgaaccacggcggccggcatccatggccgaaggcggcggtagaggtagaacttaccggagcgcgaggggatgcgaattccggcgacgaatcccgacgaaggaagggcggacggggtggagttcgtccttgcgaacccaacggcgacgacggcgcggtgcggcggcgagcctagcggcggctagcggcggccggagcggcgggaaaggcggcagcgggtgggtgcacggcgcgggagcgatggggagcaagagggagttcgacgaaatggggaaaaagagagagggggcgacggcggagcttaaataggggaggggagtcccggacgtggccggtaggggcgagattccgccggccaacgtgggggagtgggagaggagagagagaggcgggattcgaaaatcgaatcccagccatctcgggcgcgggcgcgggcgggagagagaggggagtgggcgcgggaggtgcggcgcatgcgcgggcgtgaccgacgtggcccggaggaggcggaggcgtgggcgtggcgacggttgcgggcgcggcggcgcgggcgcgaggtaggagacgggcccgacaggtggggcccacctgtcggcgtcctgggtgggaggagggaggcggccggcctagctgggccttggccttcggctggcccagcggaggggagaggaggaaggggaatgggccggcggcccactcgaaaagaaaagggggaaaaagaaaaagaaaaaggaagaaaaggattttccctggaattaaaatattgcttgctcaattttaattagttaaaattatttctagggctctgaaaattccactaaaaatcttgttagcgtatttcgacatgtagaactcaagaaaaattccacatgccaattctgattattatttgcattaatttattaaggttttctcttgatttacacaagtatttttttgagaccatttataacttcaatttaggcttgggaaagaactttggggtgtgacatagccccagtgtagttgtttactatggttctgcccttttgggccttttttcacttttagtgcagcaaggttctcttgtctgcttttcatgtatgcacttatgttgtctcttgggcttggtttccaagctgggtaacgaaagacttacctgttgtacaaaaagtggtagagaataatcaagaaacatatagacttaaacttcctcatatgcacaaggaaagagtgcttaagggcaatcccaacctagaaatcatatagtgatttccatacttaccttatcatatagacactatatatagaaactatgtacccaataagtagtttcttcaaaatatatttgtcgacgggggatacccgcggatcgtatttggagggtattggggtacgttggtacgaggatctaaacgatacgacatcaagcatacaagaagaaaatgattatactagttcagacccctcgtaaggtaatagcgctaatccactttatataagattatggaagaaaccacagagagtacagaagagaacgactgaactctgagattactgacgagatccttgtcgagaggggttcaacgagatctatcggcgagtaggcttcaagtcctccggattgcgtctatggtggcaggtgtcttgcactaagatttgataccctgtatcccttagggggtttgtatttataccgtagatcaccttagtctccaagtagaagtcggagacaacggaccccgtacgaccaaactatatcctaatcctctccgagtaggactctgttactttccatttcacaaatactatttccttgatttatacagatccttttcgtgtacttatggatataccgtatccgtatgtctcatgaccctaaggatagagggtatgacttatccataaccctgacaatattcttgtccaatcacctttattctctctcctcatcctcctatccccttgttcttttttttatgtagaactagtttgttgcataaaaatggtttcttcatcttttttccctctctactcattaactcttttgccaccttatttttttcttatgtgacaatatatttaatgatgagtaaattgcacccatgatgcatcaacttagcaggtgggtgcaatttggtgcaagaacttgagaaatgagcgttctagtgcaacaacttggcagataagtacaatttagtataagaacttcataagtgatcgtataaatacaacaacttacaagatatgtatgattttgatacaataagttaagaagttattcaacaacttaattatttggagcacatttttacacatattagatttttaagtacttattttgataatatactagcgtgggtttgtatataagtatatttatatttttattctaataactaataactgaaagtcaattaaactggatgtagaaattattatatttcggttgagatttgggaaggtgaagaaaacaaaaattcttgaaggtaattggatgtgcagtataattcttaaagattaaatttaatattgtaagataatatctgtaggattgctatgtaacagcatattgacatcgtgaaaaaaaaactcacctagcatatgcttagctaagttgatgcaccaaaatactaaattgtcaagttcttttactagaacacacccacttgtcaagttgttgcactcgaatgtttaattcttaagttcttgtactatatcacagccacccgctaaattgttgtactatgggtgcaatttactctttaatgctatagaaattagctcatgtggagggttgggaccgttctaattaattacccccatttcatgcaaacttaatttgcatgtatagacaataatactgcacgtcaaatgaagatgtcagtgttatgtgacgatcagtttgaaatttctgaattttttttatgtgatgattaatatggcatggagggagtatactagggacatttaaacactaaagtagctatatttttggatggttgtgtactttgtaaccgcctttgtgtatatatttggcactaaattaaattagtttctgtcaaattcttatgggacctctcctgcgcttccgacagaatcttactgtgaaattaatttctacaaaaaagaaaaattgtttgctccaaacaaactcctcacagtgtagctgacctcactcgattacattgcactgtcagaaggttgcacttgtgacttgacagaatactagtgtccgagctccaaacaccaaacggataggcttgtcgacgatgctttccactgaaatgatcggaggattagatacatgatagaaaagaaaaagaaatgaaaccgataggaacgcccgtgtaaaacagaatattgaaaaacacaataattctatataaatatgtatttgaatggaacatatgaaaaattaagaattttagaggattttatgctgctaatgttgtgcgaacgttgtactaactttttcaataaaattaatggtcaaacattatgcgaaaagttaagggatgaaaagaaaatcaagagctctgagtgaattcttcttttcctctggaatagacagggaaggaaactttctttatgctttccttcgattttcctttgtgccattaattacgttgatccaaacgatgttacagtggttaaatacataggaaagcaaatccttggttttctttgcttttgctccaattcaaaattggcctaaatgtgagaacttctaccgctaatcttacaccatacaattcaaaatttatactttggataaattggaaaacttctgaaattttgaactcgataagtgaccaatttacgccagtgaaatttcagtttaaaaatacactgtaactgtttgtttttagtgctgcattttcagtggcaagtgtgtactgcatgcactgaacatagtacaggaaagcgtgtgtgtgtgacactcgatggctcgacatggacgtcgagacctaataacgatagcaacagcttcaagagttttcctagcttttctttactttcagagaaaagtgtgctgtctcgcgtttgctgtttctgagtgttgtgtttatatctgcccttttttagtgactattagaatatgattacacaacttgctttttatgcaggtcttttttttctcgtagttgatagtgttgagattatagacatataatgatttaatctattccataaataaatcatgacattacagatgaaaactagtatgaacgcatcattagatctacacatgtaaactacacagtataacatgaatagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattaccgccttctcccggtgcagaacgtcgaaggcagaggttccggagacctgctctcccgatcgccggtgcacgccggcgagcgggatggagtagtctacgagcgacggcgcagtacagagtaggaagcaaaccctagattgatttttttgtatgttgcgtgaagacggcaggtcggtttatatagagaagggtcgcttgatcagggcgcccgcacaatctctactgcgcgtaaccgaaccggataagtcgcgcgtaacttatccggactccacgccgtttgcacgcaccggatctttcggaacgtttccaaaacaaaaacgaatccgaatttgcaacgaaacaaaactgcaaaaggaggctgcatctgcgcaagggtgaggagccaatttttcggaccattcgacgcgtacgtcgtgcacgcgcgccgcctgccctgccctgccaggcgaggcgagcgagcgcgcgcgtgtgtttcccctcttctctccaccacacatgcttcaagcgactaggagggcatcctcccttttaaggaggtccccctctcctagaataagcaaggtagtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtattgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaattattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggaacttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctcccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgattagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcaaccacagagtgaccctgatctgccatctcttaaaatgcacaccggtgaatttatccggtctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagattaaatatgcgcaacatattgaacacgtaccgaggtgacggaaagaccggctgcttggtcgaaacttttcgcaagtgtctacgaaggcacgaaacacgcgagcgaa

SEQ ID NO: 67142 - DNA, 4823 bp, Oryza sativa
gccgcccgttgcaaaccgcgcgcgcgtgctgagtggcctaccgcccggtcgccgccgccgtcagcctatgcacgcgtatgtcgcccgtgtagtcgcgccggtccaaaccgccccgcggtcatcgccgtcgtcatcgcccggcccccgccactccgcgcgctagcctccaaggggcggaggcagagagcccctctccctctgccgagtcgccccgctccctcccccttttcccgaatcggcaaaagggcaagccccttttctctcccttctttttccccttttcctcccgccgacgtcatcctcccttcctcctgtcgccgttttggccgctagccggagcgccagctcgcgccttgaccgccaaagtcggtttccaaaccgacattgccgccccctataaacccaggcgccctcccttcccttttctcccattcttccctgtttctcgcccgcgccattgccgtccctctcgccgaccgcagccatcgcgtgtgtgccggaggagccggtgcgcactaggacgcggaaggggactccgggcgctcgtcttcctcctcttccccggcccgaggccggagagatcactcccgcgccgtcggcctctcgtcactgcgccccgtcccgcacggtagtgtctctctccgttcttcctcctcgctccatctcctcccccctagctttcggtagtagcttgagtagactccccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacctctcgtgacctcgtcgccgtttccctcttctcccgccgccggttgccgccgccgcaatccgccgccgtcgagcaacctccggcgaatccgagccgttggctcgcctccccttgtcacgtgcaaccgcccggtgtgctcgctgttgcccgtatcgccgtggttcgctccgccgctcgccgccgccgcccgccgtccattcgcggccgggtcgtcgtctacctcccgccggcccgcgtggcagccacgtaggcgccacgtcggcgccaacttagccagaccgggtcgggccgaccccggtcggtccctccgcgtgcgcgcgatccaccgcgagccgtgaggctgcgcgtgggcccgccgcacctgcgtccaccgtggaccgcgcgcatgcaccgcgtcccttccccgcccgcgcgcgtgcgtcgcgtgctccctccgcacggtgagccgagccgctgacaagcgggtcccacccgggaccgcgcgtggtgagcccggtccaccggctctctctctcctccctcccgcgcgcgcgcgagtttgggccgccttgggccggccggcccatttagctcggccggaccgctccatttctcttgggccgcgccctagccgtccgagaaaagtctatattccctccctcccttcttttctttttcttttccaaaaaggatttaattaaatccttttcctttagatcaaaaattcaataatcttagaaattcaatatcttcccaaccgtaaatccgtttgactccgttcaacttccaaaattccccaaatctcgagatctatctaatggcgcttagaggtctttaatagggctttattttcgccgtttgttgagttgttccgtttcgcgtatagtttcagagcccgaagacccgcagtgcgaggatttcgaggatcaagctccagatctcgagcaaggcaagccacctttgaacatcttgagcctatatttgaaatttaattatgttgcttgcaaaatattatgcattgatagatcgcacttaatctgtttgtcccgtctgcaaggcagattggcggacctacctaatttgtcgcatttgatccttcctttgttaattgctataccatgtccccttgtaaccacccagttgcgcctcgatactcgtgcactctgtgcaagtatcgacggtcgtcttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtggaatgggacgcccctggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtatcgactttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggacatgggcggatgtgaggtgattcctagcgtagttttgtttgtctactgcttgtgaaattgctgttgtgaaaaggggttcgatgtttgaaaaatctgcagctgatgggatcagctaggcccgggtggccgtttggaaagttgttggcccgggtggccgtttaaaaagttgttggcccgggtggccgtttaaaaagctgttggccgggtgccaaccttgttgcaatcctaaagattgacacattgcacatactccgaccggacgagacgcactgtctcatccgtgtcgtttgagaagcactcacttagttgttttcagaaaagagttcaaataaaatcaattgcaaaaactacagccttcccttgaagcctgcattaaacacttatttcccctggcttgctgagtacccccgtactcacccttgctctatataaatatcccccccagttgctgaagaagatgaagcggatcctgctgatgaggagttcttccaggagcaagccggctacgatgagttttagggtttcggcctagttcccaagtcgcgcctgtgatgtttggcccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgattaacaggctaaattggagcgtctcgggctagttccggtcgggactagttcggggcgtgacattgttaaactgagatttatgtataattgggacttttgttaaattggcacctatgtcaaatggagatttctgtttaattgtgactgatgctaaattgggacatatgttaaattgtgacttatgtgaaattaagttattgggacttatgtgaaaataagttaaattgtgacctatgttaatttgagatttatgtataattgggacttatgttaaattgagatttatgtataattgggacttatgttaaattgagatttatgtataattgggacttatgttaaattgggacttatgtcaaattgagacttatgtgaaattgcgtaaaattgggacttacgtaaaattgggacttatgtcaaatttttttacgtcaagttggaagatgtcgaacgaaaaggttccatcgaacgcaccaatagcgcctcaagaaggtaacgctcctcaaaatttcggtagcaataagcagccagacgcttctagtgaataaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccgtcgagccaccgatagtgcggttcaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaatagctgaagcattggctttgaggaaaaaaatgtccgagctcgcgaagaagaacagatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagact

SEQ ID NO: 67143 - DNA, 26728 bp, Oryza sativa
gaggtctcccgacgtggctgatccccacgggctgggtgacccgggttagtaatgtcgtgtgggtaaagtgtaccccctctgcagaggttaacaaactgttcgaacagccgtgcccacggacatgggcggatgtgaggtgattcctagcgtagttttgtttgtctactgcttgtgaaattgctgttgtgaaaaggggttcgatgtttgaaaaatctgcagctgatgggatcagctaggcccgggtggccgtttggaaagttgttggcccgggtggccgtttgaaaagttgttggcccgggtggccgtttaaaaagctgttggccgggtgccaaccttgttgcaatcctaaagattgacacattgcacatactccgaccggacgagacgcactgtctcatccgtgtcgtttgagaagcactcacttagttgttttcagaaaagagttcaaacaaaatcaattacgaaaacaacagcctttccttgaagcctgcattaaacacttatttcccctgacttgctgagtactcccgtactcacccttgctctatataaataatcccccccagttgctgaagaagatgaagtggatcctgctgacgaggagttcttccaggagcaagtcggctacgatgagttttagggtttcggcctagttcccaagtcgcgcctgtgatgattggttcaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacagccactggccaagaatgctccgcccccgcatcaccccaggtgcgcataataacgactctctctctctctctctctctctatatatatatatatatatatatatatgtgtgaaaatagttctatacaccggggagtacgtacacctgctcccatccaccgtccatccattcaaccagcgatctacccgatcgaacctccccctaacgggtatagttgcattgacccgttaacattttaagtaagatttaatccataattatccagggataatttaactaaccatcgccgattatttctcactaaagcgacacatatctctcgcaatacagacgcgtgggcgtgcggccatggcgcgatccatcggcgattcggccacgacgcgaggcgtggtggctacaggcaatccggcaacgatggcgtggtggttcatcggccgatcggcgtcatgacctgggcacaactggcgtcggaggagatcgtcctcctcgttgttggtaccaatccttgatttctgactgctagatatatattctgattcatggtcgcttctaaatctctgctatcctttcccccttttgcaatgagacaaggatcgtacgagaaccgtatcaatcatggcagaggtttccggccaaaccgtccaacgatggcagctgctcacacggatcctcgatcaacgatggtgtgtctagtcaatgaatcacggcaacaacgtcctgtagaaacacgtactgcaccatgtttatggttatttgatttcaggttcagagctaatatcgatctgccgaaagtcagaggcgacacctaatgcatttgttccaactcccagagaactgaatacattctgaatttttcagcagcatatatatctacctctcggcgtctcggagggggcggcgtgattcagcgatgacgggacggcggcgagattcatccgcagcggcaccaaatccacctcgtcgttccctggtgcggcctttcgttcaacgcgatggtgtcggcgggcgtgcaaaacgaccaccggcggcgccggcaatcagcacgccaggcccaaagattgcagtccaaacatgggcagcgcgaggttctgaggagcagcgacgccgtgcgcggctagtgccagcctctaaagcagaagcggcgtagctggatccaagcggcaacggcgtgtcggcgtcctagcttccagctatgaaccgaaggcctggatggctcatgcaggcagcgacatgatcgagcgatggccacatgcgtcaagcaaggcagcgacggcggattatctaatgatgctgccatgctgtggcctgtggcctgttatatattgcttctctgtaaaatttcttccgatatgtagtagtgaatagatatatatactgcctcctaaaacaaacagtaaaaaacagtatactgctatgcacaaagtagtacatactgctgctttatttgaaggatacactacctgctactgaaagaatcaaagtacattacctgtaaagtggtatatactagtaatgcagtgaatttggtatatatactactatctcgaattagtggtatatatactacctttgtcgaaagaaagtatgtatattgtttcagtgtatacttacagaaatcaatatatactcatttcatgaactcgttctgagttccgagaaaaattcagtctatatactcgttctaagaagaaatcagtatatactcactccgagaaaagttagtatatacttactctgaaaaaagtcagtatatatatcactgttttaaatagcggactaaggcatttagcggttagcttctaaaacggctatagcggcagctatagcgggctaaatggagctatagcagctaaatagtacatgagagcaaatagctagaacccttctcaaagagctataacggaagatttaaaaccctgatatatatactcattatatttggtcattccagtatgcaagtaccaattaagaagaagcaatcagtatatacttattaattccgaattcagtgtgtgtgtgtatacttctgcaatgaaaaaaaaagtagcatatacttgtacatgaaaaattaaaaaaagtatagcacataccagtctataggaaaaacagtatatttgtactccaatgagacatatactgcacgttaacaaaaacagtatatactgcttgatatcctaaacagtatgtacagctttttcaacaaacgggtatatacttctttttatcataggcataaactgccttttatcgtatatactggttttcaatagggtacatatatatgctgcgagtagaaagtaactgctgtacgtacgtacttatgaaatttgaatctaactgcatgcatgcactcgcagttcaaatgtttaccaaaatcaggtgcgtcacctgccgtgcatgcaagcaacatatgaagcaatttgattttcagccggttgaattagatgcaaatggattatccgctaggaagaaggagtatatatatatatatatatatatatatatatatatatattgttgagttgtgatccaaatttatttgcagttaataaaggccagctccggaggtgcgggggcggagctcccacgaaacggatcgtcatcctttttagggttccaccatatatatacctcttgtaagccgccgtgcggcgttgtaacctcacctcagatatagtgaagatattttgctggctaccgcccgtggttttttctctcctgatttggaagggttttccacgttaaatctcgtgtcttctgtgattgatctattgttttttatcgtttgtttgcctatcgttttctaacatagatcacatgctcatttaactgtcaggtctttcttgtgctggaattgccatggatgtgatgtggtgcctagttggatttgttcgtgcgctggatgaaaatgccaacattttgtttcatttggtggatcttttgtatgcaggattagagctattacgccatatagcgtggcgctggtgggagtgacagcatgccctcctcctcgccgctgccgcagccacgaagaactcctcgccgtagggcggtggtgtaggacttgttgtcggagatggtctggttgatggcgaggtagtccgcgatgtgtttgtggccagtgcgccgcatgacattgctcctgcacgacgacgtccccatagttatcgggcggcccgtccggggacacacccaccccgcgccgtgccatggtagtgtccttcgaaggggaagcaaaccaagcagtaggggggaagagagagagcgcaagccctaatttttttttcttctcacttatatgtgggtcccatttatttatttatttttctgattaggatgccacgtcagtaaagatttctaccataggatctactttgcatagctgtatagtttagaagtgaagattatattttttatattggggattaggatgttatacgataggtgaacttattcgttgctacgcaacttccgcgccgcccacgggggatcaggtcctctgcagtaactacaccgtgccattgtcactaggtcggcgtctgtaacagtaatcgtagcacgtaggtacgttcctcttcctgtactcgtgtaaaccagcacagtgccgcatgcagtatgctctgtgcgcgcacgcgacaccgcgtcaaagattccagggttctctgttgcaaccggcacctgcagcagcatcgaccagcaacgtactactagcgcgcatataaccggtgacgactgacgatcggcacgccgcacgcatatctcgcacatcgcatgagttttcaccgcgaaggacggcccgccggggataatttctcccaacttaatcaccacgtaccgcacgaacgtgacggcgcgcgtgggtcggctctcgcgggcggcggctagcgtccgacgagatctcgcgcggtcggccggtacagcatggaggctgggcgtacgccgcatgagcgcgcagcaggggcggatgtgaatgtgatcccgtgcaacgctggccgcctggccggcgccagatcacgacgttggttgcgtgtggctgcggcatcgatcaagtggctaccgtacaagtagtttttactctacttccacggttctaaaatatatactccctccgtcctataatataagagattttgattttttttacttgcactgtttaaccactcgtcttattcaaaaaatttgtgcaaatataaacaacgaaaagttatgcttaaagtactttgtataataaagtaagtcacaaataaaataaataataattttaaatttttttaataagacgaatggtcaaacagtgcaaataaaaagtcaaaatcccttatattatgagacggaggaagtatatatatatatatttaatataataacttattctaaaataaagctattttttcatctatttaaaatcatataatattattactatttatctatttagaatcatatcattatcagggatgaagttaggatttgagatttggggaggataagccacaggaccaaacggccaaagtccgtaacaaccagatacatacagtatctagtgtaacacactataacctccatggctccattgtagctagataattaaccaaaatgtttttagagatagaaaagaaggatcaagtgttcatatagctcctgcagcctccaagacgcaaacatcacataaaccaggctgcatatgttttgccataaaaaaaacgtaactaggcaagcaatcgagagttttcctttctatcttggctgaaattaagataggaaataaaaaaaaatccagtactcaccaatcaactaaatgtatatattatctatgtttctaaattagggacaaatgactaccgtacaaataaaagaaatgagaaaactaaaagtcaagcaattaggatattttgctgtattgggggataatggagaagaaacacacctccgtgctatgtccgatggcgacgtttggtgtgctgcgtgctcaatggctgagatacacgtgatctcgattgaagggtgagtcacaaattatggagaggagctcaccgcgtgcgtcttgtatcactttgccaatggccgctcccatgcatatgatgtgaagttgaaaagataggacgaggattaaggaagaagccgagtcgtcgaatcgctattctctactcgttgatcgttgattctctcgaccggacagatcttggactggaatcttcctaatgggcttcacatggggtcttggcccatatcagataggagggtgccctgcctcctctcccacccatcaattaataacaattgatgtgatatgacttaattaaaagaaaaaaagagaaatataatttagaccatagattaatcatttaagcactaagtgagtatgaactatataagtatatagggtatcataaaacatattaaagatatacattgaaacattatgtgaattatgttggatgataatttaatatgtttgtatttgaaaagctcttaaattataaaaactatatagatatagcatgtttgcatgatgtttaaatgtgatgattgttagtggatgatgatgtggcatcttgttagtggatgatgatgtggcatcttgttagtggataatgatgtggcatctttacatgttaagcttaaggagttagtgggagataactttatagtaagataggatgtgagatataccattttctaccctttaaatattgttggagccatatgaggccactgtatttttatagagaaaattccttacatacccttgaaattttagccgattccttctatgccctgaattttcttcactcccttgtatacctctgaattttgatttggatccttccatacccttgccgtcaattgaccgttagttgaccgtttaataggtatagaaagttagttttacccttcaatatgtgacgaatatgtatcaatttgtaaactatattgtcggaagtatagaatttgttgtgtgattatcatattcataagtttgttgtacataaaaaaattaacatattagaaaagtatgtgtagcattttttaaatgataaatatagttttggaaagcattccaatataatatatacaacaggagaaaatatgttaaactaccataaaaaaagctaaatatactcttttaataagtaaataaatattagttttatgtcattatgtaaaaaataaactttgccatgaataataccttgtaaaataaagtcatcaatataatagtcttatataacaaaattatacacttcaacaatatagctagtctacaatttttagatttccttcacgtctaagggcaaaaaggtcattttcattagaattaaacattcaactagcggtcaactaatggaatgggtataaaagggatcaaagttaaaatttagatgcattcaagggagtagacaaaacttggggggcgtagaagggattggctaaactttaagaggtattaaaggaattttctcattttcatatcgtccaaaatacccctatgtgcattggataagtgagatatgtcattttctatgatgaatgaaacagtatttcattatcttaaaaatagctactccctgctcctgaatagggatcaatcagacgtgtgactgttctaaaaaaaaaatcagacgtgtgactctgtgttgggagagagatgctacgagtaatcgtgtagaccacaggacaagctgtcgatgccgaatatagccagctaactcgccattccctaggcttgaaaatgacaaatcgttcagtccaacgaacacattgccttctgtccatcgtcttcgaattcgggtacttcgaccatctgcctaaactgatgtactaataagcaccctctaattcccattcctgttatattaaaatttgatgagacatggtaaccacaaggctaaacatctatacacacttcacagttaacaattgtcttatgccagataggacaagaaatgaaatttaagcttgtacctatcccaataatttgatgcttagactctgcaacttgcttcccattggatggaactttgcttgcctgataaagttataggagtgtggagtatttcttaggttatataagttgcacccaattattcagaatttgctgttagaaagctacatttctttttggtactcttcagatgtgaccataattgcacgatcattgattttggaacattctgaggctacccgacatggcaataatgttcacgtactgatccatagctaacaccaaatgttatgttgatatgattacatcatgatgtccatattaagcactttcaggctcttaacccagacctcagagcatgcatgggttggccccatgttgcccagacgtaacccctccaaaaacctcaattgattggtatgtgtcgacatctccatagaatgtgaccataattaatgtccttgatgtgtaagttgtgaccaaattagaatcttgggcttagttacattcggaattaatgggttatcagataatcgtttagtatactcagatttgaagaattaagtaagaaggatgattttcccaacatagcaccacctctgaagttgaaaaactagtaaaagattttaagagacattatagctgttagaatatctccaagctaggccacaaatactggaggaatagcccctgatggcctgatccatatcaggattccactctctttcaatgccaaaaaaatcgacacagaacaagaagggaaacacttctgctggacaaggaaaaaaatagggttaattggatccacacaactacaaatatgctaaattagaaaaatatcactcctattcgcgatatcggctgccactgaaattttggaaaattggatctatgtcactccgtcgcgtttttcatccactgtccattaatttcctaactccatgccgttttccaactccggtcgagcggtggcgaatgagctcggcgggtacgcatctaccagcctcgccaccctgcaggtggccgtcgtgcctcctacgctagccttgccgccctcgcggaggaatccgcgcacaaggcggagcatgaaggggacgtccagcctcgcgtcgggcgggtcgcagctgtagcggaacgctgggatcatgacggcgccgagcgacgcctggtctagccgccacgccgcgcgcgcgtcgaggtcggcgaggagcgtcgcgtcgggcccggccatgctcctggcgtggagaagctgaagcaggaagtcgcacttgacgcccttgcagagagtgctgtagtggtccaggcaaacgaagacccgaaggtctggccggcgcgccgccgcggccttgacgcagctgagcacgacgtcggtgagcgccatcccgtcgtgcgcatcgtccaccacgacggcgccttagcgggtgaggagcaggtcggcggcgagctcgtggaggtgtacttgacgactgtgtcggcgtccgaggagcggtcatcgagggcgatggagtaccccacctagcgttcgagctcgacgcgcatgtcggccgcggcgtgggtcgcctcgagcacagcggcgaggctggtacgtctgggagaagacgacgcagccgtggccggtggcatggagcaggcacgggatctggctgctcttacctcttgccccgacccctcacatcgacagcctcatcggcaatggcacctccgccaccgggagagggccttcgatccgccgccaccgccgccaatgtcaatctcgcctcctccccttacttggccgaatgacggaatgcgtcgacggggctcggagaacgcggcggctccggcgactccgccgctctgcctttgccgttcactgtccgccgcccacgacgccagccttcgtgcctcacctcctggaaaaagtgacgggaaggatggaaagagtgacggaaaggacggaaaacctgatggagtggcgtggattcaatttctcaaactttcagttgcacctagcctagctgatatcgcgaatagtagtggtattttttctattttgccatatttgcagtaatatggatccaattgaaaaaaaaaatgctgccagtagcaacagtactttcacggccttaaagttaaaacttgcacacactgttggtctgttgctcattcaatcgtttgcatgccctgcaatcctgataccctgctgttgctcatgatcagtcagttgctcccgagacgcaacaacactgttgctgctgctgcatgaatgcatcgatcatgtagcctgcacgagcagcgaaggcagccaaatttatgctttttttttccctgagaacagtgcaaacgagagctaccggctacttgtgtggtagggcaaatagtggtgtgatcagtactctccatggcaggcgaactggcggaggctgggctcgccatgccgctctcaccttggctgactgcgctacggctagattcagccaaactgcacactgcttcgcgagttcgcgtgacggcccgggctgccacgagaacacactccgcggcgtggatttctacgggtctctgccgattttctgcagagtcgtggcgctagctagatcactgcctcactggcaagcaaagcaacaacacagtggtatgtgcatggctccaaataaccaaccgctgtaccgcccagtgcccactatggtctacttgattctaccggcaaattcttgagggcatctcgatcgatcacataccggagagtgctaggcacatgggttgcaatttatacctgtgatcaacgtggcggtcgtacgtgcatcaccaaccacaatatatgtgccgtgcgtcagtgtgtgtttgcatagggaataacaggaacttgggagttctatatgctcggtctggttttaaaatgtccattcagtgaagcaatggataaaataattttttcaaactaataattgcacatgggaaataaagacatcttgggatgtgtccaatcaagatttttaaatttaagagagaaaatttattatggagtattacctccgtcctaaactgttactacttcgtctgtttcaaaataagtacacatagtacatgatgtgatatatcataatactataaatttggacaaatatctctactaatgatagcaaataattttgacaaaaaatttaatccaatcctctttttttctatagaaaagtgtgagaataatttcacggagttcgtgatgtaaagttcctatatttcaaagaaaccataaggggcgtaggattttcaaagcatttagctcaagtccttgaaaacactcataactcttccattccaaagaagagtttgatcaaagtgtggcatggtgcttttaaaatccccttaggaacaaacaatactcactccatccaaatatatttatacgagaatgctaaagaaagtttcccttccaacgcatgtgcacggtatccgacatccgctatcgcgcctaccacccacgtgcacgcttctgttcctcttcctgttcgctaccccaccatgatcatcgatatcatcgttgttttctcgttgcgaagaccacaacaccacatagtcccgttggtgctaacctcctctcttgcggtggtgcccttgccacccttccccttccacaacttgatcattgttgccatcccgacctcgccgtttggtcaagtgccaccacaaaggccatggcgagcgaccagccgccgtcgacgttggctgcatcacaagctaaaacatgtactccatgccgaccgccttcttggactagacctacgccatctttgcctgatggcaaacacgagttgtcgatccacctcgctagcgaacacgagccatctcttctcctgcaggctaagcctcttgcggtggatggtgagggcctatcaccatgaggtctacccacctgcgcccctaccgctcaattccacagttgacgagctagatccagatgagtgaggttgtgagtttcatagatggtggcgttggagcacaaagcgttgtcgttggcaccattagggtaccgggtctagtacccacctgatatcatcttgttctagaatagattaggattcagcatgataaggtgtatttcatttcattatgataaggttttgaccaacaaatattagaatattttttacacaaatttgatgtcactatatttgtactcgaattaagtacttactattattcttcttttgtattacataaataatatattaacggaataactgccaatcaaagctttatcctaatgaactattgaaacaccatacttcttgtatttggacgggcggtaattcacagtccaatgataaaacaatccactgatatttttgttccaaaaaactttaaaacggttggaactcggaaatgataaaaaaaggataaatattcttcatcatcttagccatgctgggccgggtttttgcaggcccgtccgaggctcggtaaaagttccgttacctttttgggcgacaaaagtacgtcttaccccacacgaccaaattatggcctaatcacaccaaaatccactcccttccaaaccctcccatcaatcactcctatagtatactcgtactatactacactctcatctccccctgctcgttgtcatgctctcccattccatggctccatccatttcgattcccaaacagccgcagctagagctagagctgagctaagctagctatttcacgtgtccatcgagccaaagccaacctgttgctacaaggtgagctgctgccgcctacaacaaccgcgcgctatccaatggaggaaacctagcttcttcttgatccacagtttgttttgtgcgtgcaaaaggtgtctcgttgagaggtgagatcctgcggaggcatggcactggaggccgtgctgctctcgcgtggtgatctgtttggtcgtcgtcgttgcgccatggaaggaggaggaggtggttggagcagcccgttcagtggcttcgagggagtgatggatttggacggcggcaactgggacgccgccgcgtgctcatcgatgcttctgcatggcttccaggagctagagatccctgcggccgccgctgctgctgctgccatggcgccgccgccgccgccggtagagcctgctaattgcgcggagaatgcaggaggggttggtggtcatcaggaggatcaggctgcggtggcggcagcggcgacggcggtgcagtcggggaggaggaagcggcggcgggcgagggcggcgaagaacaaggaggaggtggagagccagcggatgacccacattgccgtcgagcgcaaccgccggaagcagatgaacgagtacctcgccgtgctccgctccctcatgccgccgtcctacgcgcaaagggtaacacagctagcttgctagctcacctcactgccggtcattccacggcttcgcctcgccggccggccgccggccgccggccgtactgcttttgagttttgatttatcttgcatttgcatggcgttctctcttcatgcatgtactgcttatgtgcgcagggtgatcaggcgtccatcgtcggcggcgcaatcaacttcgtcaaggagctggagcagctgctccagtcgctggaggcgcggaagagttcccggcaatgcgcggcccacgacgcggcggcagcggcggcgccgttcgccagcttcttcaccttcccgcagtactcgatgagcgccgccgccgccgcggcgccggtggctcccgttgtgaacgagttgcacggccgtgacgacggcggagcaggcaccgccgaggccgaggcgtcagggtcgaagccgtcggcggtggccgacgtcgaggtgaccatggtggagagccacgccaacctgcgggtgctgtcacggcggcggccgaggcagctgctccggctggtggtggcgctgcagggccaccggctcaccgtgctccacctcaacatgaccagcgccggccacatggttctctactcgttcagcctcaaggtaaaaaaaaaatccaagtacgactactacaaatctacaatctactacgcattcctcacatctagtaccattactaaacaatttgatctgattgcaaactaaacatatgtgtggctctcaatccaagatgcatagtacctatatctggttagcaatatcacactgaaacaagttgttggtgcctaggtttccgtgcattttgtatcttgctttgtcttgcacaactgctccaaattcccccatctgtttactttaatggagctcagctggagtagctaaaaggttgcggttccctaaaaaagggccattgtttgacctgccaatggatcgtcatctcaagtgatctcgtcgtcaatggcaggtggaggatgattgccagcttacgtctgtggatgagattgcaaccgccgctcatcagatcattgagaagattcaagaagagcagggctgtagtttagattagcaattagcataccaaccaactacgtttactagcatgtatgaatgatgatgattagttgttctagcaagtgaagccacttccttgtgcaaactaatattattgtgcctttatgtacttagcagtttcattaatcattagtgttgaatcatttcataataatggactgatttgttcatatgtggagtgtgcaagtgaaacgcatgcatggttagctgtgtacgttacgtttgaaaataaaactacgaatacttatatgctctagctagagaacaattgcatagtagacatgacacatgacattccttgtgggtgctaccatgttccttaggacctgacacaattgacaggagctatttcaataccttcttgcgaggattctgtttcccttgtgaagcaccaattactgccaaaataccaaagattccccatcttgtggccacacagcttgcccgttactttcctgaacgttcattctgctcctccatcctgtgatcaaccaagtgaagttcatgcaaatagccaaaaagccctctctaaaaatagttcttcggtttattctgctgtgtataccgaaattctaaatattacgagaagttcagataccatgtaaaggaatagaagcccaacaaaagaaaatgctcaatcaggcctttagttgggcacttgaaagtgatgggtttaaaaagtttcagtgtaccataatcagttcgttacaataaacaagatagaagcctttaaaggaaagcacaaacatgaacatcaaatcagcaaagcaaagcaaaacgataccaagaaaacgataagaaagaaatgaaaataggacgcaagctgtgtcctctcattgacccaagaaaagattctacaacagggtcctttacctgattgaccttttaccgtttctatctaagcatgattgatcaaatagtgaaagagctgcacagccatttcacctatgtgatgcttgcaccctgattgattcgaccgacaggacaaaacacatgtgccacttgctctcatgctgcatgtcgttttcgctcttcaaatgttctgctccatcgaagcatcatctggtaaaataaagaagtggagccacctgagagaaaagaaaaggataaacagcaacgtcagtgtggagttaacttcatgcaccaaccaatcaccccaaagttcaccaaccaaccgttcgcccaaaaggtcaagttgctagggaaagatgtgcaactctactagtatcacacaagtaaaatgaagaaaaaaagatgggcaactcgatgtgtgcgtataaatgtatctgtgcacgcatgtgagtggccatgaaaatgacagatccgtaaaacaaggaagcaaaccaaagaacacaagatatactggtaggatcatcgagttggaccatgacagataaacttatgcaccttatgcctagacgtatgcataatgcatatttgcatagatggaaggatcgcatctcatacattgattcaatagaatgcaactactttttgcagtatagggacaccaaaaaggataaaaaaaacatggctcaaaatctgcaaaacaggctgtagaccgaaacaagatagttgttacttaagtagaataaccatagcttattataatagtctctgtgacaaccaatctccacagcagacatagcatagatcacaaatctttataaagacctactcctgagggtctataggttagaggcgacttatcttcctattccaggactccataagaataatgacagaaaaacctttatgctccaagttgaacacttgaaccttgaaacaagcaaaagcacggtgtcaggaaatttataatcctctgtgaattgaataatagactataaagtaatatacttcagacagaatttcctaactgactccattcagatgaacctgattcataataaagtggtcccatcaaactaaccacgcatgagatgaaaatgttagtgcttcatcttaataagaaaaaccttcggacagacacctacatgcatgctaatcacaactacagggaaatgcaaaaatgtaattatttagtagtacaaaattatcaggctaagacttctaagcagacaactacattgaattctaaacaagattgatactaaccgtagttgttgaagatatgtaagtagaaccataccgcttgactaaaagttatatgtaacaataaccaagaaattgtagagtcttcccacacctattagcatgtcatacacaacaaataaaaactctaaggttttaactgtacaattaatttttgtgaataaatttattctgaaatgaattgtttgatggaagcagtgcccaaatagcacacaaagatacaccttaagaacaggtttagttggctagagagagagagagagagaaacatctgtgtattaaatggaacggaaagcataaatattttagggggaaaaggagtgctgttcaagtttcaaacagtggaagtctgtcatacatattgaaatatatcagaatagaaaagcgagaaagctaatataacaatgcatgtcgaaacaaatgaatcatgccaacctaaatgggtgcatatgttacactataaaagtacacttttcctgctcatcaaccaaagtagtcagtggacaactggaaaacagcagcgcaaccccatcatgtagcacagaaacaaaaaaaaaaaagacagcttaacagatgcataatttttgtttgcttgcatttttaataaataaccccatttgaacaaagggttgggaacaggaagagatgaaacaatgattgacaaagaagacgtaaaggttgcaacaaagtcaagcataactgcatcagtggatttttcagtggttgcaaaggtagctaaaagaagaaccagcagcagcaactttgatgaagcacgagcgaaaaaaaaaatttggttggtgtgatattttatcaaataagacaattttatctatgcattagctcccaaacaaaaaatggtctactatgcagtctgcacatctatcaatgaagaaatttggaggtacatgagagctgaattatagctgtaaaatgtttgttgcataagcttcaacatattaacaatccaagttccttccagacatgtccattccttaatctgagatctcacccaagcatgttaaaggggcagtaggtagaccatcaagtaaactaacacaggaaattcaaaacacaagtacaatcaatataaagatatttttgttcatctatcagaatagcgaagtaagtggtaaaaaacaattagtcttttagatgtttgatagaaagaatttaacatggttgctcaagtcacatttatatgtgctgcagtgcttaaaagtgaactaaaggtatgattgtagaaggtagttatatattcttaaattcattataatccagaaatatatggattcttaacagaattccttgacagttgggcatattgatatttaccagaatttggaaggtggaatagagctttaagagaagacacatcagaatgttgatatagtgatcccatatcttttcaaaataaaaaagagacattcattgcataaaaaaataacaggggaaaaatatttgttcaacttctttaagcatgaattgacaaacttgatcctcactgaacaggagaggaatgccgagacaaagaacagagatattgcacagaaacacacaacttcactaacatggagaagctgcaacagagagtaaatataaatgtgtgatttttacttttactaaatcatcttaaagcctgcaaagttataaaatgaatagttttagcgatttctactaatgtaatttgttgagacaaaaaaaagagcatagatggttgcaatgctggaaaaaaaaacaattcctttttctaattaaacacaacgtcaagttaatttataactgtcaagttgaatgtctttctttgagataaatacgatttaataagagtaaatttaaatcagtgttttaaccaaatatcgcataagacatttaatgacatagccacagccggtcagctactaaacaaaggccaagagaaactgaaaaaaaaaatggcaactgagtgatacttactgcatctaaatgcagaagttttgcaaaactctgaatcctatgctaaaggctaaactgcacatggagaagcaggagaggagacaatttgaaagttatagcccttttccaacctgacttactcacaaaaatggttagctgatatgctagttctccacaaccactctttgcagtttggcctcccctaaggctgtcatttgctttgtctctaatcccacttttgtacagatttttggtaaagcaattactgtaattcagtgtctcatacaccagcattcaggctatactctgaatcagtaacttagaggttttcttaataggaacttcttgacaggctgactattatggaaacagaggtacaacaaataaaaggataggagtctgattacaaaaacagaatagatcagagccttcaagtgcaatttgtctaatttgaaatgtaatggaacttcttgaaatgcaccttgctttgggctccaaaactgatacttataaagaagcgaggaaagtggaagagctgatatgaggtaccttgatctggtgaatccttcctaaatctgcaggagaagccacagcattactttttagttcatgtatatcctgccaaaaaataaagcctcattcacaaaagctattatatgttagctcattagtgtcgaagtaccaattacgcataatatttcagagcatccacttgataaatatacgtaccaaatttcataacatcgattgataaataaggttagcagatgctgaattactaaccaagccctcatttctatatgtcctcaatgctatccatggtttcatgcaaaagtaaatgtctaataatagcatcagccattgtcagcaaatgttagtttacacagctatagataaattgttttagtgcatgtgctattttcgtaggtgataatccaaccctacttgcattgtgttactccctccgtttcacaatgtaagtcattgtagcatttcccacattcatattgatgttaatgaatctagacatatatatctatctagatttattaacatcgatacgaatgtgggaaatgctagaatgacttacattgtgaaacggaggaagtacatgatatagagagaagacaaacttgagtttgttccttcaaattcactagatcccaagctcaaaactatgatacaggcaacctgggaggtacaaatttacacgagctcatcaactcaagaagtacttatcacctccacagttacaattgtcaactcatttgtctcagaaggagattttctccaagagctacttcagctctctggttatctggtatacgctttctatcaaaagacatgacacactaccagctcccagctttgctgaggctgcaactccctttgacagcaaaatcatgccaactcacagtggtaacacagcactactggagcgcccattccgtgagaagaagaacccctgcccactgctcgacatcgatctgccaatcccaaaccgccctgcctgacaagaggaagaagacgtccctgttgcatccttctctttcacgctgaataacttcatctcttgaccattcggaaattttcgatcaccccgcatggcatcgtcctgcgcttcaggcacaaccaccaggaataacggtgagtccatggacgccgagcgccgtattggcttgggcatcaccctcccaccatcctctggtgaagctgctgtgtcctcactttgagtgtccgaagaggtgtcagaatcctcggagacatcggcacgtgattccgatagcgagatttcatcaaacacctggtgctcttccgcttgcccaccaccctccgcctcaccttcggtagccgtggcggggagatcggagggaacgacgactggggatctgcagagcgggcagttgacgtgtgcgcggagccaggtgtcgatgcaaggcgcatggaacggatgcgagcagcgcgggaggaggcggaccaactccccgtcgcggaactcgccgaggcacaccgcgcagtcccctccccacccaactccggcgcggtactccgcggtggctatggacgtgatggtggcctcgtccagccccaccgtgcggatgtaccacacgtggtgcacatccccgccgccgccccccgcctcctcatccccgtcgccgaacccgtcgtcgccggggagcggcgcggtcgcggcccggcgccggcggcgcaggacgacgcggcggcggtagagcaggatcgtggagacagagagcgagatgaacaggaaggcggagaggagtgagacggtgaggaggaggcgtacggggaggtggtggtcgtcgacggccacgtcgacgcgcgggaccaccggcgacggcggcgggggctcggcgatctcgtagcagctgccgcctgggcagaccgggtggcagtcgagcgggtaggccgagcagtcgacggtggccgtcccgttgacgcggctcggccgctccgggtacaacatggcggcgcggaacacctagcgacgatccggcggtggcagctcggcggcggcgacggcggcgcgcatcggtgtgagtaccccgcggcggcggcggcggcggtggtggtggaattggggtggagacgtggagtggattggtcgttgttgttgggtttggtaaaggtttgggggggaatgcgtggaggtggagctggagagcacacacgctacgagtgccaaaaaattaaagcacagaatgacctaatcttttgtatgcagtcactgatactgtgggtccagattgccaagacacaaattggggcccactactcagtgacaagcaatcggttttgctgtaacgtatggtcgtgcacatagcagcaggcggcgacctcggtttacggaaagtcaaaggcgataatcctaattttgaatggaaacactgcaggcgaaaggaaagctgaaggagttattctcccgtatctgtagaacggcagtagcaagttgaagagatctaccccgttggttttggcatctgacggcctcagttcgttggtgagagaggcagcgagatttcgttagtggccctatttggggccatgacagtgaagtgtcactacttaatactacgagtaatggagaagacgacgactgcacgggttaattatgtggccgacagtggacgactttgtgacgccgccgctgtttagggtaatttttgtccgacggaatcgggttggctctgttaggcaatatatttaatccaaatcctaacgcaatcagtgggagatcaatcgcaaaatcaccatcatcgataagctttttctgaaactttccaccgccaagtatttgatggtctctgaattctccttgcgattttgaaacgacactgctgcgtttgactgggagtactggaccaagaggggaggactaaaatatgacccgggccagcataagaattgctgggccgtcccgaaggagtacgtgccaagtcggcccatcaggcccacgtaaacgggaggtaattaaggtctgcgtcacgaaagcgattgattgatcatcaggtaatcctcatgcgtaaattgtactcgttcctcttcctcctctactactccaagtcgtttttatcgaatttttaatgcggatgactaatcacttcatcagaaacacgatagaacacggcaataacatatgggtcgtttcttccctccgtccacctaccgcttgttcccctaattgatctctccccatggcaaccctcacgctgccggcgaccggagccgccgcgcaacccggccaggaagacccaaggtatgcgttcccttggttgcttatttctaaagaattttacctttaaccaaagttggatgtgaaatcgagtgatttgttggatttgctccgtctcgatgcagcgggatcaagaatcctggcgatggtgcgggagattcgagcggcatcgactccgggtatgtggtctctgagcaagaacagcgctttctcttgcttgatttttggagaattttaggtcaagggcttgtattaagatggttggtttgtgtggtcagatgggttgttctggggaaatctgacatagttccggcggatttggctgccgctgccgctgacgccggccaccgacagcttgggttctcgccgttaccgatgcttccaatttggtaggaattgggggaagaaataccgtattgtactgctgttctgagaaccattgcgattgatatctctcgtatttttctcagggtgcagatggtgcttggaggcgtagtctacacggccgtgccgttctacaatagggccaggaaagccgaaggtgcaattacacaaatccaatacctggttgctttagagtttagacccaatacaactgctaatttgcaaatgttataggagtaaatcatttccccttagctcattaattgtttgtgatcgctttagatccatacaactactaatcttgcaaatggcattggagtaaatcattttcaccatagctcactaattgtttatcagttattcatatcaactaccccttaaatggcatacccatataactctacttgtgttgctatgttagatgaggtgacaaaaaatgtggaaactgcattggaggttgtggagcacgccgcggaggtgacagagaagttagctgctaatgtggccaatgctctaccagagaatggtaccctgcataagttggccgaggaggttgagtacattgctgagatagtggataaggatgcacagaaggttgaaatcatcataaagaaggtatgtatgtcaattgttgtgtatatatatcatcatgtcaaggatatatatattagtaatgagaatgttatgtccacggtacatgattagcatgctttctgtttagatgtagtagaagttacagttagaaacatcatatgcaattacatgtttctgaccatttcagactattgaattggcttttgactaaaggttagtttgttgttgcttgcaaggaaccatggacagattcaattctttttttcagcagcttcataaactatgaattggacagattcaattctttttttcagcagcttcataaactatgaattagacatggctttgggctggggaaagcatatgttcactttgtactgggaaagaaaacaaagagagttggacatggcttctctcgaaacaagctttggtagctcaattataaattttcaagagaactctagcatctagatgagatgaaaaacagcttgcttttgttactgtatacactatacatagtttcttgttgtcattacctgaattatcaatattaaatttgactgtttaccattatcctgttcatgttgcagattgaagatgtcagcaatcggatagacgctgctgtggagcctgtcattgaagagctcgaaaaggaattcaaaccatagccaagcatctggtggatcagaaggcccaaaattattcttgttgtaaatatcgttattttctattttgttctttctaagcatctattgtgtacatatatattgtgatgccctaaaatgaaaccacgccgtagttctagcaagactaggtgatggtgtgttggatgctcgaagctgaagcatcctgtaatctcgttgtaaaatacaactgaagatctaaaacagtatatcggattgaaacttgaaagaacatattcttctgctgttgtttcatgcgtgctaaattactcttttgatgttgctaattattttttccctttgtttgaagggaggccatgaaatattaatcagggttagcacactcaaaattcagactgattggattgtagtaactcgactatcaattgccttgccaccaaaaatctagtccagaaatctttatgtaaactggaagagaagtcaatcagatttattacttcaatattgacattccaagatcatacttctcacctagcttatgaattcaactgctcttctcacttcaaagtttcaggcgaaagagactctgtaatgttttccgtttcagatatgcaaagcatgtctttcaatttgcatgcgtggtacgatcaaatatgttcacatttgtggatggtatatttgacctagagatctggcatgggaacgaaccctctacgacgattagccaagattctcgtttgtctgcctgaaggaaaaactgtcagatgcatcagcttcataaagcttgtcaattcaactcgtctgctcatttaacagtctcagcgtgtctgtcgagtgaaggagacgagaaatgcctaggggtcttccggctagctccacaaggtggtgggctagacgacctggattcaaagcctcacccctcctaattatttgatattaggtccttccctaatattctagtttttcgagtgaaggagactatgccatgtttgtttttctgatatgcacaacagcacaagttgtcttctttttgcggtcaaatgcagtatgactatgagcagacatggttatattatagacttgaaatgtttgcattggtgagtgatgacaggcgacgaggagttcaatctgcactcactattccgccgccagctgccggagcaagagctcgggccacatctcagaatagtgaggtgttattggtgttgacgacgatggtcaaggagggcggtaggaggaggatggccactgaggtggaggaagaggacaaagcgctgctgggatggaaaaacggatctgggagatactaatatttagcccttatgcgtcaagatcatccctcacacggaatccctaggctacgtatctgaagcgcgcaagctcgatctaacagacaaacaagcgaccggttgagagaaatcccatcgatatgagttgcacgtgagagccatctccaacagcctccctaaatctcactctccaaatatctatttatcaagtcaaaatcgttgtttgctccaacagtctttccattcaccctctctactctaggtctatagaaaaaaatggtggaataatttgcatgggacccactagcaataggtggagtgagggagggcatgggcaatggtggagagagaaaagggaaaaagatgatgggcccacagatgtctagttcgtgtggatggccaacggctggccaaatttggctagcttgagcccatctttagccattgctattttttggctagggggatagccattccgttggagtacattttttgtccaaagttgttaaaatttggcttggagagtgggatggggaggctgttggagatgctctaactacgtaagtcgacatctcaacgcacgtaatccacaaccccgttgttaatcctccaataatccaactccctttccgacccaacaaatatgggcgcagctggttagtcgaaacctgttccggcctaactaaaatgggccgcacgtaactccgaataaaggaataagtttatataggtctcttaacttgacggcgcgtttgatcattatcattgaaccttaataccagataccatgaggcattcaactgtcaaaaccggtggacggcacaggaaagccgaaagctatacaagctcctcgccagcctacttcatcatcgccgtcgggcacaccgcatgccgcgcgtcgcgcacggatgcatcgaggtggcggcacgggcatgccacgccattgcccgctgccacaacgctgctatctgacccatcgccgctcctcagggacacctgtgtggtgaggcttgcgtcaccgcacccgcgctctccaacgcgctcaagcgggcgcgtacacgcaccaccgccgcaccggtagcgatggtgtcaagccagatgaccaccacatcggcttcgagatgaagagggatgtgtcgcttacatgtgaagccagagcagctcggcctcacagcttgcgtggtcgctaccaccagtgttgccgccgacgttggcactagcctaccccctttgtcaccctcctcgttggcatggatgccctcgccatccaagtgaagagaaaaagagataggtgaagagagagaggagtaaaaaggccttgacatggtgaggcccacgcttacttaacgctgttgctcgggtcaaattgctacgtcagacaaaccacccgctatattgtcatgggacctatattacaccagttttgatagttaataaacccattgtatatgttattgtggttcaagaatgagtatcgagctcgttgtcaacttaacgtgtgggccccacatgtcaggtctccacgtcaactctctctttcccctcctctctttctctgtttctctcctttctccctccctctcgctctctgctctcgcagggcatggggatgccggcgctagggcgcccacggcggcgcgcgcggccggggttggcgtcgtcggcggcggcgggaaatgggttgtcatcgtcgtcgatgttgtcgaggaggctgaggaggtcgtcggccgtggagatgat

SEQ ID NO: 67144 - DNA, 20058 bp, Oryza sativa
tacacggccagaggaaatatcgaggcacttgtatcctttgtgttgattactatagccaaaaaaagcacaacgtttagaacggaattgaagcttatgtgcattgtatggtctaagattaggccaacaagcacaaccaaatactcgtaggaagtgatagtcaggtttatggccaaaaagaagttccaaaggagtagaaaaattgataactctactaggaacacgattgatcaaatatgtggctgtgagaaaagcttcatcccaaaatttaagaggcatagaagcatgagcaagaagagacaaccctacttcaacaatatgtctatgtttacgttcagcagagccatttttttgatgtgtatgaggacatgagatatgatgagcaatgccaatcttctgaaagaaggaattaagcttctaatattcaccaccccaatatgtctgcatagacagaatcttcctattaaactgtcgttctacaagatgttggaaatttgtgaagactgagaaaacatcagacttattcttgagaagatagatccaagtaaatttactaaaatcatcaataaagcttacataatacttgaatctccctactgattgaggtgcaggaccccaaacatctgagaacactagatctaaaggagcagatgaccgactagtagatttaggaaaaggtaattgatgactcttagcttgttgacaagcatcacacaccacatctctatgaggctcactaacagtaacattgttttctctaagaattttgctgacaatattaaaagaaggatgacctaaacgactatgccatctagactctgaagaatttgtagttgcaagaacttgacgtgtttgacgagcatctattttctcaggaagaggatagagacgtcctcgagctctaccttgaagaagtgttgtcttcgtgacctgatccttgatatgaaagaaatcacgatgaatttcaacaaaagcatgattatcagaggcaagacgatgagcagagatcaaattctttttttgctttggggacatataaaactttattaagataaagatcacgagtaggggtatgaataatagtttttccaatgtgacttatgctcatacctgtgccatttgctgcatgaacttgatcactaccatgatatttctccttcgttgtcagcttatcaagttctgaagttatgtgatcagtggcagccgtgtcgacgtaccaatttgtgtcaacaccatatgatgatgccatagcagaagaggctgacctctgaacttgtctttcatctcctctgtaagatcgatcaaatctcttccaacaagattgaacagtgtgtccaatcttgctgcacaattggcacacaggacgtgtatcttcgccaccaccatgacctcgtccaccacggccgcgaacaaaaccaccacgcccatggccacgattctgatagcctcctcgtgaggcagtatttgcagaagattgatagcctccatcagcttggagcttgagatgtgcctcgaacgagagtagttgtgcatatagatcactcaatgacacataatctttagcagaaactgatgcgacaagaggattataatctgcatctagccctgcaaggatatatgagatgacatcgtcatcatctagcttcttcccggccgccgccatctcgtcggccaagctcttcatcttggtgaagtatacagcagccgaagaatctcctttctgctctcttgctagctgcgaacggatctgaataatccgttcccttgattgcgaggagtacatctccccgattgcagtccatacctccctggcactatctagatgtgccacttgaacaagcacctctcgtgtgagagatgagaggagatatcccaggacttgttgatcttgagcaatccaccgagaatacgccggattgtcgatcatctccttcacgatcttgtcatcgactttcttgacgacgctgatcatcggtgacggcacctcctttgtatcgtccaagaaaccagtgagttgtaccccacgcacagccggcaaaacttgcgcacgccataccaaataattgtctctggtcagcttttctgagacaggatgacccaacacgctcgaaaacgatgaggaactcgacgacgccatggctagatgaactatgtggaagggaatggctctgataccatgaaaaaattgttgtagcgttcctacctccaaagagaccgctgtacgtgtttatatagcaaaaacaggaagagtacaaatcagattacaatccgagtctgaataagttctttacttctatctacagcaccaacctatagcaggagtacatgactctatatctctgaaacagagtcagacaagaaccaaactaagactcgacaacaagtctgaaactatctctatgtttaacaaggcatatgtggtacgaagatacgtacgaaatcacgcagcacacatcacattaatttagatctttgttattctttcatgttcgtttaccgatttaaattgcggggccggttttataacatcgaagaccccgtgttcgtaggccgtgtgacgatgtacgttgttgtcagtccttttcagtgttcaaacaaatataatccacaggacaaattcgttcatatatactatattattatgtttcttcttttcgctctctcatacaatctgttttattggcaccaaccggaattcagctggaacactgaacacacacgttcgcttcctgtctcgtttggagaagcactgcactttattgactatatactccgtagatatgcatgtattgtcttcaccttacaccctgcaaaccacaaacacattggtcgaacgaatgatcagccgacatgcattctatcatcttctgatagtagtaccagataaaaattgaaaaatagaagtggatcgatgagattgagaatttgagatgcatgtatgcgagtatatatgtaacgtactggcggtagtcgatcttgatcttgccggcgtcggggttggcgatgatggcgaaggcctcctgggagaggtcgatggtgccctggcagccggaggggcagtggtcgacgatcttcacggtgacgctccggccggtgcacggccgcggcaccccctggttggtggcgcccgtgcacgtcaccacgtaccgcttcccgcacgccgccccgccgttccagaacacgtcgctcgccgccgcgatcatcgtcccctgctcctggaacccgaagcacgccgatgctgcacgcacgcacgcatttcacacacatctccacttttacttcacgtacgtgtacccagtggatgcatggtggagagagaagaaaaaatactgaacatacgcgtgtaaggaggcgtgtagaaagtcgcagtgccagagatgccagcgaccagagacaccatcgccaggcctaccacggctgccataacaaccgaagtcaccttaggcatcgtcgtcgtcatcgtaatcaattcagggtgtatctggaaactggagtacaagatcagagtgtctaaaagattagttctgcaggagggttgcatggtttagtgtgcaccggccgttttatagccaaaatcagaaggtcgatcgggtagaaaaacacgcaagggtgggtcgtgttttcaacgtttgcgtctgcatgtactgatgtacatggcgcgaagatgcgatatcttccaatgcgaagagaagacaggcgatgtactgttgcccgtggagaaaaatatgtgagatagcaaatacgaccggttgctacgcgtgactcaccacctctcgtcttgaagctttgcacgtcgttgtagtgtgtcactgcacgcttctcctcgaaacacggcgcagccggctcggttgtccgatgcgtgcggcggcgagagagagcaggcagccacgatgattaccaactgcaaactggggcgtagaatcgagcgcgcgcgcgcgcggctctccgaggtccaaggcaagccgcgacgcgagcgtgtgccgcatgacttgcaatcttgcacgagctacggcccggctgcttggagtgctggaggcttcgtcgatgggccggaggccttcgccgcggcgcgcgcaaaggctctcaaaagtccaagaaggccgatcaatgacagcgcgccgtcggacggactggatgtcttcgcagctacgagcgggccgggtcaccgcacggtctgaaaagcccaggaaacctgcaaacgagcgccgaaggaataagatcactttgactccctcaactgacaactgaatctaaattgtatccctcaactgtaatactagaaattttaacctctaaacttaaaaaaccggtgcaatttgactcccttagtggttttggagggcggttttgctgacgtggcgcacacatggcagtgttgatttactctttgtcccacgtggcattgacgtagggtttatgtggcattaaaataaaaaaaatatgcgggcccatttgtcattaaaaaaaagtgtagggtccactgacatgtaggccccacatgtcatattctctctcactacccttcttcttcctcctctctcctctctccactaacatgtattttcatccatctcatctgcatttgcatctgtttctccctctcactcttgcttcgtgttcgtcctcgtttggtctctgtttcttctcgatttggtttttctgctatggagcccatgaagcagcgagcagcagagctcctctagctcagcccctaacaacctaaactcctgaagaaggcacttacgtctgcgccgagcgtccatctgtacacacgttctttgttgacgatttctttgcctgttgctgaattgagcatcttgaggatgttgttgattcggtaggggtggagatggatgaggagtttgcagatgggtgggggcgtcaagccggagttgtcgggggcggagacggacgagcggctgacgggtgactgcaaacataagggcggcgcaaggaaggtggttcatggcgagcggggacgccacgggcacacatgcgctggtccttccttggctcgacggcgagcgcctcggcgtcgtctgtctccggcaccaccgggagcagcagtacggtgtacgggggaagcccacggcggctgcctcctcctcggccatcttcccattggtgaagcccacggcggcggcggcgtttctcggcctcgaggcagcagcgcgaagcgagtggtctccggcgacgccttccaccgagccattaccatctccacccgtcgtggccgattcggagttttggatctgggctggtggagcttggtgctacgccgcggagtcaccatgccctcctgagctcctcatgcatggctgcgcgacgccgtcgacggcgccaccaccatcgtggtccaccgcgacaagccaccgccgccgccgccgctcctgcacccgcttgccgcacacggccgaagaggtcaccagtgacggtcggtggcacagcggcggcggccatggcgtggctgcccgccctcccgcccgccgctgccgctccgtccatcggccaccgtcgccgccgccgatccggacgccgctccccacgtaggaagagaaaaagggagagatagagaagggaggagagtgaggaggaagaagggataagagaggatgacatatgggagctacatgttagtgggtcgcacacttttttttttttgtgaatgataaatggacccgcatatatttttttattttaatgccacctaagcgctacgtcaatgccacgtaggacaaagactaagtcaacactgccacgtgtgcgccatgtcagcgaaaccgccctccaaaaccaccaagagagtcaaattacaccggttttacaagttcgggggtcaagatttctggtattgcggttgagggataagatttagattcggttgtcagttgagggagtcaaagtgatcttattccagcgccgaacgcgtggctaaccctcccagcatttccacgcggaataagttcacttagtgactctcaaaggtgatcgaaatctaatccgtgaccctaaactataaaattggatatctcgacacccaaactctcaaaaccggtgcaaattgattcccttagtggttttggagggtggttttgctgacgtggcgcctacgtggcggtattgaccgggtctcctttacacgtggcgttgacgtggcgtttaggtggcatttagaattaaaaaatatgcgtgagacccgtttgtcattgacacaaagaaattgtgggacccacatgtcccttctctctcccctccgtccggttccttctccctcctcgccgctccctctctctctcccgctgcgggcggagacggcggcgagcggtggaggcgcggacgtggcgcggcggcctgcgagcggcggagacgcgggagtggcgggggcaggcactggagtggagacggtggcggcgcccgggccgagctctaccgcctcgtcactgacggcgaccaggtgttctacgccacgcgccgaggcacccgcatgctcaacatgtccgacttctgcgaccgctcccgcaccgacgcctgggacttctccgcgttcgtccgcacctacgccgcctacctcgacgaccggctcgagtaccggatgcaggccaagcacggcggtgccgcgcaccagggacgaccgctccgcgagcagctgtacgcgtcccccgggaaccgcttcaactacgacgacttcatcatgagagacgacgaggccacgaacgccgaggccgacaaggcgatggcgctcgtagcgagggagacgccgacgagcgagatgacgctggagcagctcctcgcgaaggcacaactcctcgtgtagtaggacaactttctttaaggatggccgcttttcactaaccacccgattaatccattacttagttaattactgtggttgcaatattaaaaattggagttaaaactaaatttagccgtgattgaatttggcttgcagctggcgccgcattgtcttttgctgccagtggcgatggtggtggtggttcttgctcttgagaagaagctgctggtggtggtgcttggaggagcacttgtagaagccggaggggtcggaggacatcaggcttctcgaggagaaggcatccgtgccgtcgtcgtcggagatggtgaagccataggggttggacgacagcttcggcttcttcccaccattgaaatgcccatgagaccgtgacggtgggagcaatgccggttatgctcttcttcttctctggaggaagcgggtggcggaggaggtcaagcgtcttagagaagggtcgacgcgggggaggaaggcggcggcggtgacggtggaggacgtcgttgtcgtcgaccccgccgcgtgtgcctcccgccgccgccgcccgccgtcctcctgcttgaacgcctggtcgccgtcggcgaggaggcggtggagctcagcccgggcgccgccgccactcccacgtctcccccgctcgccaccgtctccgcccgttgcgggagagagagagagagggagcggcgaggagggagaaggaactggagggaggggagagagaagggacacgtgggtcccataatttttttccgtgtcaatgacaaatgggtcccacacatatttttttaattctaaatgccacctaaacgccacgtgtaaagaagacccgatcaatactgccatgtagacgccacgtcagcaaaaccactctccaaaaccgtcaagggagtcaaattgcaccggttttaagagtttgggggtcgagatacccggttttgtggttttgggtcacggattaaatttcgatcacttttgagggtcactaagtgaacttattcctttccacgcggcacacggccgggtgcatgcggaagggccgagagcttgctactcctccatcctcctataaaaaacaatcaacaaaaatagtacggatcgtgatgtattctaatagtataaatttgaataaatatctatctaaatttatagtgctataatatatcacatctcatatttttttatagacgaagggagtagctggcaccattaataacccaacattttcatgctacacatacataaacgacatagtagcacacatatataaaaacgcggatatcactacgtaaatatgtataagcaaagctcttagacacctttaaatggacgaaagcctagctgtactaaccttaatatggggtagaattatatttcaaagtatactcatatatgtgtaatatttaaaggcatacaaattttaaccctaatatattgaatcatgtccccacaaacttaacaccacataaactattacatcgtttccaagctaggtgcattcccatgtcatagagatcttcaacattatcaattttatagtgaaaatgtattcgcatgtgtatactgtaggtgcatccaaatttaaaaccacggacaaataattatatcataaatttttttatgtatttaaaagagaccttcctaacacctatttccatcccggaacttttgtgtggaaccaaaacttttgatccgggaagaattcaagacaaagaactcccgctggaactaattattagaaggtgggacgtggaccggaacttctactccgggaatgattcgaggcggagagcttccacccgaacttctaggtgaggagtgaggaccaaaacttctagtcaaagagagatccacttagagcaagtttaatagtatagcccactactagctccaattcatctatagccaatctaatagccaattcatacaataattgcttactatactattagtatatggtcccacctgtcatacatacattacatcttggagtccgtgctgcagctggctatagatctgtaacccgctgctcttctctctcatcttatctcattaaaatatgcttgtagctggctaatagtctgctaatagagacattggatcgactgtaactttaaaaagacattaggtcagttttggataaatcagagttcaaatttgatggggttttaccctatatacgaggcaagatcacccctcttataaatataggaggagatttattgaacccctaaacaatcaatctactccctccgtccactaatataagggattttgacattttgcttctactgtttgacagcacgtcttattcaaaaaaatttgtgcaaatataaaaaacgaaaagttatgcttaaagtactttggataataaagtaagtcacaaataaaataaataataattctaaaaatttttgaataagacgaatggtcaaacagtgcaagcaaaatatcaaaatcccttatattaggagacggagagagtacttctttctctttctaggtctaggagtaatttagctttttttttttgctgttttatatgagtaaatcattatctactcagggtagccgaaaattaccatgtattgttttgtcctataaaccatcctgaatctccaggaaaaccagaaagctatttaccactcgaattggcgagttcttgctgatgtcttgctggtccgaaacttcaagaacttacggtccatccagagttcgctagggggctcagcttatcggtgtgctactgtgttctcgcgctaacagcaagtactagaataaccctaacatccataacttgaccaccatactaaagttgcttccccgtgtccgtgtgtatatatctcaactattataaaaattgataaaaattgaaaatgtttactttgttacgtcactcgtataggagtcggtttttaatttcgttcgctttttgaaatgcatatccacatttgttcgcttttagaaatacagaaggagtcatataagaaatcttctttaaaaaaactcgcatgctaatttgagataatcggactcctaattaactacaactcatgattatatatatatatatatatatgtgtgtgtgtgtgtgtgtgtaaattaactggtgctacatggagtatgggctccaagattcaaattgagtatatacccaatttaaatgagtatgaattttttttaaatgtttaggtatgaacattaacttctttactaacaagttcaaacaagtttgaactgagtttgaacttttttttttggttagattttggttctaggtatataacatccaaacatataattcgctaggtatgtaataatgaattgtgaaataaagttgagtttgagttattttgttttaggtattggtatgaatcaaattcatatacctaggtatatactcacaatttaattttttaaaaaaatttgagagattttgttttatcacggtgaattttattttaactaaaccatatgataataataaggttaaaatagccttcacccgttgtaacgtacaagcatttcttttctagtggagtatatgtgtatagagctagtatatttctttggtcaaagtcagactgctttaagtttgactaagtttataaaaaaaaattgtaacattttcaacccaagacaaatttattataaaaatatatttaataattgatttgattaaactaatttaatattataaaagttattatatttgtctataaacttaatcaaactttaaacagtttgaaaatgtcttataacctaaaacggagggagtataatgcaacttgattttaatttattggataaatgatccaaaggtataaaaatttacaacactatatacgctcttgcacacagtgatcattatacatgagctatacactaaatacactaccatatgtatttaatttcgtccaaaaaaatacactaccagaacatttccagtatgtagtttactaccgccatctgcgaatattttgcatgtacgtttaccccaccagggcacaaccgcctccacacgtatcatgagctgccgaaaccctgctcagtgacctgaactgacggcatgtcgctcctgaaccggagcctctgcaccatgggcttcatcttctcgatgagctttacgatgacaaagaagagcaccctgtacagcaccaccattccaatgaggatggcgaggtcggcccacttgctgtacccgagctgtacctgccagtagttcgtaaggatctcttcaccggtgatcacggtgccggcgccggcttgatcgttgtatttggggaaggtgaggcctaagaactcgttcttgtagaatccctggttggcgtacttgtggaacgcgatgtagtacatgggatacttccacaccggctttggaaggtcgttggggaggcggaagaagccgccgttgagcatcatgacgccctggacgccggcgccggtgatgatgcccatgaggaagtccggcacggcgctggccacgatcatcatgagcccctccaccaccatcatggtcgtgaagagcaccgccgcgaagtagccgaagtgttcgccgctgctctggaggccggtcaggtagtaggcgatcgcgcctggcaccacggagatgagagctaggtacggtgtagacgacagcgtgttcgcgatcacgaacgacgccacaccgtaatggccgttgagcctctccctcccaaatatctgcatatcatatcaaaatttatggagtgaacatttggttggtgtatatcttggctgttcaaaatatatcttggttggtgtaaaagtgtccttaatttgacattcaagaaaatcagtgaacaaaccttcatgtcctcaacgaaagaggggaagccaccgatggccatgaaggtgaggaaggcagcgacgaacatgagcatggagccacgggcctgcagagattttcagacggtcatgcacacacaattttgccaatgagtaatagatattaaaccgcgaacaaattaatatggaagactgtgccagagccatgcatggccagcaaacctggatggatccataggaatggccgacatcgtagtagatggtgccgacgcagaggcagagcgcgacgtaaatggcgaaacgcagccagtagtagcccaagtccctgtacatgttgacgaaggacctcttcgtcagcacccatgactgcgtcaggaaagttggctgcctttccttcttcaccaattgcccttcctgcagagataaagaaaattacaggatgtgtaaagcatgcatatattatatatatatgtagcagaaaatgctttgcgagatacattattggcgcgtatttcttcgatctgatgcatcactttcgccaagtgaacggaggatttgtatgagttgacaagtgtgtcgattgcttgggtagtggtcatcgtcttcccgtccagacctacctcaatgtcctgatgaatgcatcgtatagaagggagtaatttatttaggacatttagtcactttctttttgagaaaaaggatatttattcactgattcagtgcattggctagcttgctctcccatgatttgcttctcaccttgtcgaagtccttgttgatggtcctcagaaaatggtcagaagggttcatcagagacggacaagggaatccgctcagagcggagaactaataaacagtgaaatatagtcaataaaaaaaattaggaagtgcttagctagcaaccggaataaattctcatgatattagtcaatacaaaatagcatgtacagtcaatactcaattcaagtttgttaagtgcttcacattcagatcaaaatctcacaatatatatctctgtttcatttttaagaaaaacaatatatatcttggaccctcccgagatttttttttcgaattggatgaaaatttctgatccattcaaatttctttaaatctagttgaattttttgtttaaagtggttcagattcagaaaaaaaaacattgcatatgtattccttttcttttgtttaaagtggcggggatgctgttttgttcaacaaaaataagcggcatagaaaattttgctatacttgttcaacactgttttgattttgttccacaaatgctgttttgttcaaccctattttgattttgacagatcacagatttgctagggaggagaaatatgctttccatcacgaaactagtgtgacatctcacggtctaggttactccaaattagggatgaaaacggttcagaaagtttctgatttccggatgtattttcgaaaacagaaagtgtcggaattttttcggtaagtttcagaaatggaaacgaattcggattttttttcttgaaaatgaaaatggatacgataaggctactatccgtcagaaaccaggatcgatcgagaacttttcataaacaaattcggatttttttcctcagaatcagaaatgaagtacttctcacatacaactaatttgctctaaccttttctactctaaatgtttagatttatactgagtacactgagatggttaattagttgaatggagatattgttttctagttcagtactttagatctgtttttcttttttcctaattactatttttgttttactaggccatgccaaacaaaggttgtcaatttcagtttaaaatttcagtaatttcgccacccccactggcaagtaaatatgtcagccagaatttttgttttttcccatttttttgtgattttggaatattcaatcaatttttgttaatttttcaaataattttggcgaaaaagtatgaaaattcctgaaattttcagaaattttgagccatactacttacagttacagtatagatgaatatagttcttgttttcatgaaaagtgaagtgtgccactagctgtattattattaattgataaaaaatagataatgtcgatttgttgttctaggaaaaaaaaagagctacatcactttgtcgatttgagaagttcaatttgaggaggttttataatccgataaatatctgttaccatattagcttcgatttgtgttcgctctgttttcatattcaataataataaattcggttttcgtatctagagtttctgattcctattccgatgcccaaaaaaaatataaaatgaagtggtagagatgatttctgtttgtttccgagtcgttttcatccctactccatatcatagatataatgatccttgcttaattagcaaccagtaagttcagtttgcagatctgagcctagagtgatgctacacgtatgatttgccgtttacgatatttgtacgatgaaacagcttatgtgtttattgacgctgatgctggtatgcagcagtcgactcagtgccatgcatccatgtcatcccgttagatcgtaccatgattgtaagtccaaatcatgcgcacaacatttttctattgtcttaagcgccgatcaagccattcgccacaaatcccattgtaaatcagaaaagacgtttgttttctacttaacttcatggttttcttttgctacatatagtaacttctgcctatgtatattaccaacttcgtcccaaaatactaaaatttatgtgtatgtatcagttagaagtttctatattttggaatgactgtactacttccctactctaggccaggtcaagtatttaggtttaatttgaaaaaccaataaccggtgccgataactggacaaaagttaatttaaatccaaatttctgaattcacaaaccggttcccggcggttgcagctttagaaatctcgtggtgacctagtgcttcctaatttcgacttcaaaccacacttgaatacctgatacctttgttgtatcaggaattcaggatttgtgcagtgtgtcttacctactaactgtattgtaggatctttgcatagtagtatagaacctgatttgcagctttcagaactgaaattttgccaaaactgatgcatctgcaccactgtatactagatatgatgctggcacgcggcagcttgcagccggaagactactactgcagctgcgtcttcctgttgggatcaatgaatccgtcagaagggtaagctacagaaagcacaagaaggtgcaaattcgcacgtcaccgactgattggagtcactgtgcgagtgtgtttcagtgcattgaatgtgttctgttgcttctgttcatgagtaagctaagtcagcgtcatctacagttgcaaacggtatagggctagggctttcggatttcttaaccggtctcatctcatttaagctatatatcggatgtggattttcatcccttgagagacatctcctcgttatttgcatgtcatctaaataattattaaaaaaataaaaaaatgacagtatagattaatatgtaatatatcactccacgaatatgcaagactaaatttaacttttacaagttgcaacaaaaataacaaattaaactgaaaatagttattgcacattcgcaactatatttgttatttttgttacaacttgtagaagttgaatttaaactttactatttgtagagtgatatattttatattaatctatgttaccgatttttttttttttataattatttaggtgacacgcacaaaacgagaggatatatcccctcataaaataacttttccctatatatccgaattctgaattctgatacagtatgtttggtaacaattctcattttgccgtacaactttgcaaatacggatgcataatttgtatttgggacaaaatagtttgtacctgggcggtgtcggcggcggggccgaagaagacggtcttgccgtaggcgaggaggcagaggccatggaagaggccgaacacctcggtgctgggctggtgcacggcggcgacgacggtcatgccctcgcggcgcgccatgcgggcgatgcggctgacgacgtggtacgacgcggcgctgtcgaggccgctggtgggctcgtcgaggaacagcagcgccggccgcgtgaggatctccatgcagatgctcacccgccgccgctgcccgccgctgatccccttgtgcgcccacccgccgatccgcgtgtccgccgcgccctccagccccatctcccgcagcgtctcctccgcccgctcccgcttcgccgccgcgctcatcccgctcggcagctgcagctgcgccgagtaccgcaccgcctcccgcaccgtcagcgtgttcatcagcacgtcgtcctgcgtcacgtacgcctgtggcgcgatccattcatgcgttccacgacacgagatctcaccatgcttgcatcattgctcgaatctttatcaaagaaaaaacgagatcattcgtcgccgatcgactcaccgacgtgccgaacgccagcttctgtctccggccattgatcaggatgtctcccttctggctcacgctggagcctaaccttcctgtacccagaattcatgcaattcgatcggtgatattcggtgtctcggaacacacgcaagccgaggtgatcagaagagtggcatgcatcatatgtaagggaaactattttaatccctcgagggatattctcttgttatttacatgtcacttaaatagtcatgaaaaaaattgataagatgtattaacatgtgatatatcacgccacaaacatagaagttcaaattcaaattctacatctcgcaaagaaaaaataaattaaactacaactaacgtatattcacagttaaatttgctttttcgttgcgagatgtagaagttaaatttgacttgcatgtttgtggagtaagatatcacatgttaatatatctttttaattttttttcataactatttaagtgacatgcaaataaaggatcaaaatccactttctcaaatgttacctgctaaggagtcaagaagagtggacttgccgcagccggaggggcccataatggcgaggacctcgccggggcgcgcgtagccattgaggccacagaggatgggaacgcggcggcggctgccgccggcggtggacacccagaggtcctcccacgcgaggacggcgccttgttccggccggcgcaaggacgacgtctctcgagcgacgacgaaggcgacacggtcgttctcgtcgttcctctccacgctaatctccggcgagggctgctccgcctccgccgccggcaggaacggcggcggctggaacgatcgcccgctgccgaagggaaagccttcggtgccgcgcatggaggcgccgagatcggagaccatgccggctgcccccttgcgatcagcctcgtcgtcgtcctgacgccgccgcgggctcggcgtccacctcggcacggcggcgggctgctgctcggacgccatgcacgcgggaatacttgctggtagtggaagttggcgggagctgatcttgtgctgacgatcgatcaaaatggaatgcttgagcttgagctgatccgagctagtgagcgtgtatgaagaagaacaatgagcatgggttgcttaaatagaagcttgagggactacagatgaggttactttgtacacttgactattcctaactcaaaaatcatgaattagtaaataattttcacctacattgtaacattatcatttcttcggggtatatatatatatatatatatatatatatatatatatatatatatatatatatatatatatatatatatatactccatccattttaaaatacaaacatttctatgctttttagtaaaattaaggtagagagaaaatttctcttttagtcacttcagtggtcaaattttaaatgattatagctatatatatggcgctatatttttcaaaaaaaatatttaaatcattgttacactataaataacttatgcttattacattagaagtttcaatttttcacattgtaatttttctatatataatacacaatttattagagagttctgattaagaatagttcattatctacttgaaagaagagataggagagatagaagaatactagtatatgtatgggagagagagcaacctgaaattaagtaaaaaaaatgtggcgccattgcctagatttcctatttcccttcacaagcttcttattagctaaaaaatgtatagatttccgtgcattggaatcagtgccccaacaatgtttatacagagaggtacacattataaatcctcaaaatacttacattttagaataaaggaattatatgtcatgtaaatgattatttactcgcttgtcaagcactagatgaatatccaattacataaacttttttttgccaaagaaattatgaatgttctaacgaaagaaaattataactggatcttgattcctgcacaaaaaaaaaagatctaatatgtaatcatagaaatgtatataaattaatcttggaaatgaaacaacaaaataaactaaacgttgtaatttgtttgtatcaaagttatagctatttatactattcaagttcaaatgactggtagacaagaaaaaaagataatgccaaaatgacaaagtcgtctttaaaaaagtgttaagtaagcgtacttgatattatttgcactggtaacaattattataatatttttgcgtggtaccgaggactacaataaaacacgagatatgcctctcgatactgtgtagggaagactatgacctcaacatcttcacatgtgcatcgacatcggtcgtacccatgcaatcatatccattcgttccccctttcctcggcaataacggcgataacaacacaagttgtcaccgttagttgtctcatgttgagtttctcgacagtacttgatagttgatactagcaatgggatagggttctcactttggacttctcattatgtctagccaatcccatctttcgcattaatgttaccttttgctagcttagactattttgtccataatcactatcgtgcacacccattataatggtccattcgatttttgcagtaaaattaccgtacttcttcatttcttcaccactagaagtttgtagaatctccgcattgaaagtttctacattttttaaacgattggctcatcctagagtggaaattgagtcatttttaataattttgtggtctgatttgtctaaaatggtgacaacgtattccctctataattgcaatgagcatgcagaaataatgggtgtgacaaatcaataaatattctgaagcatgccatttcccactgcattgaattttactttttacagtaaatatatttagttatactaatataatctggttgatcagtctattgcccccaagattatgtgtgccacatgtacactagaaaaaattcgagtgtgaaacacattttgtgaaggatatatatcactaagtatgcatatctcatgatagttttacatcaagaaaaaggtttaaaacaaaagttgactatctcatgtgatatttttgtttcacaatagtgcgtcaaatctgttacaccaataatatggaaattacgtaataacccattgatgtgaaagtgagattgcacagtcatttatcacgacaacaactcaaatgccatcaataggttgcacgtacaagacatatgatgaatataacatgttcatctgccaacttcccaccatgctgcaatatattatgtgcatgcatgtaacatccacaataatagcaacttgcagcctttcctagccgtacgcaaaaaccaaaaacaactgcaatatttttgttctctttctttaaaaaggaaggtaattccactgcaccaccaatcaatattaattagtatttgtgatttttttaaaagtaagtgctccataatgtttttacatgaaacatattactccatccatttcaaaatatagcaacctaccaaattaaacatatcctagtaccataaatcataaatctgaacaaactaatgttgtactaggatgtgtcatttgtacatattcgttgtatcaggatatgtataatccgatactaaattgatatattttagaaagaaaggggtatgtactaagaatattgtatggtaaaagccgacacatggacattcctttactcactacctatctcaaaatatagcaacctagtactagatgagacacatcctaatacaacaaatctagatagacctctgtccagtttatattattgtactaggttgttatattttaggatggatatagtacatgtcagtctaaaaaaaagcctctaaggtttatacttattgttttttttaaaacacagtagaaatgtagatgcttatatacacgtgcatgcactcgcccctatagatacacacgcgcacaccctcttcgatg

SEQ ID NO: 67145 - DNA, 2968 bp, Oryza sativa
tgtagcttcaaatggcctcacacggtctatcatgacaaagctgtcactcgtccttcaccaccggatttggttcttcggcgccaagcaccttgattgcccttcaccgccgcatggtccatcgtgaccgagcttcgcttgcccttcaccgtcttgccatagtagccacttcgtatcccacatcttcaatatcttcactttgtcattcttggtatcgttaggtgtaattatatcacttgagcatcaacacctttgcaatccttgggacctatttctttcattcaacccaataaaattattagtcccaatgatccagttgtcaacctccacaagttgaccaaccgatcgcatgtataaaagaatatgaataaatgatgagtattaatcaataccacaagtgccatatactcaaacatacactcaaatgtaaagatcccaattaaatgaaagtgaataacttggatcaattacatgcataactaaagtataggatttgctccccctaactgtatgaaaaaaaatgtttgtgtgaagcaagagtatgcataaaagaatgaaacattaggagcttaccctatacaaggatagatggcatttatcaaatataaacattaaaataaatgtataccttcatcatctttaggttctcaatgtaaagagataaacaagagaaaagactcaaacaaaacattagtctcacatgtatattgttattcacatggaaatattatatatgaacatatcaatatgtacatggagagaaacagtgatacatatagcttgatctccatgcatttcatccttgtgatttaggtctatcatcaatgaatgtttctatctcaactcataagaagtccggtaatcacctctcacacactccactttcatgtccacatgagactaggcaaagaaatgcttataaaaatattagtttcacataattggatttatcattaatcaccaaaaccaaattaatggcacttgaactttcaaaaatgatgggtaatgtggtttttataagcgaggacaaagactactaattctatattgagtatgctaagggtaagggttttattgtgagcccaaaagcaggtgtgcacgcagaaatgctaggtaagatacattgttctctcaacccttaatatccatcgttatagaccagaagtagatcggattaagtagagcaagacctttaaaaactaggtgaagtggaaggattgtatggtcatatggagtcagtttgtatgctcaacttaaggctatatggatttgaaacactttgaaaagacaaaccagaaaagagatccgcaggccctcactcgttgtggttgcaaagctaagcttgacatagagctcaatgaggagagaggagtgtgttgtgttaaggagtttaaaaaccaacatacacgtgaacttgcaaatctctattaagtgacaggtttaataccagagatatgctggatagaagacattgtgcgaaggatgatgatgatctaacatgtcttgtgtaatggtgggcacagggaaactagacttcatcttttctttacttgcccttttagtgtcagatgttggcaacacctgagaattgtttggaacctggaaatttgggagatagtaatatgcaaaagcaattgctctattcgtctcatttttcatcgaagattcttgcatcaatgttgattccattaatttgcaaagctttcctacttgatgattctacaatttgtccccgatagaaataaacatatctaaaatctatggctaaacgaatttgcagtgatttgatctgaagtagactagatttgagacaaaggtaggacgacagacatggcacaagtggaatagcaccttgttggcaaagagcagcgacgctcaaaggcgtgctagctgaagatggatgtgatcgacagacacacgatgacttgcacgtagcccagccaatgcatgtgtggaacagttgagctaactagagttttcagtaaatgaaataaacctggtaaaataatacctagtttaaaactagtaaaatacaacagttaacttactcagtggagattatgggtaccccatacccacacggcatggttatccgaccggtgtagggggtaacttatatctatgaaatatgtaacggatcatgacatgggtattacgtttccttgtatattatggaacggtctaaagtcctggtttggtaatattgtaaaatagattaggaaaccgataccgtattggttaaggtttctatcttgtaatcctgcccaccatcctatataaggtgggcaggaggccctctagggggcatgacataattagatcgtcagagttataatacgcctggcggattcaaatccccaaaaaggagtagggtattacctctcatcgagagggcctgaagctgtctaaattcttgtctcctcatccatccacttttaggtctcgtgcgctacacccttttattattgctgaaatcatgtttcgacatactctcttgtttatttttcaatattttgtaagatcatattattaacttctcacttaaatgtgttatcggctcttgtcctttatgagtaatgcaaattcatcttctttgtttcaacgatttgtctagtaattactatatatggccaaatgggttgttcggtccgacacagctgttggtatttcttaacaacattactagaaatataattcccagcaatggcgcagaaatacttccggtatattatggttatagagttcatccgcaagcgcaagcgcacggatataccattgtagcatttcacccgagagtattccaagggtatcatatttattttgtcccgtgggaagatcatgtagagagaactcaactaataatttatatattacttgtgataatcatattctaagcagggattaagataatccaagggtagagtgacacacaaacatttctactcatcctcataataaataatctaagcta

SEQ ID NO: 67146 - DNA, 60695 bp, Oryza sativa
aagtctttaatacctttggtttgagggccccaaaaaaaaaaccaaagattgccagtttgaaagatggggacctttaaaaaaaatttcagcccttcctatagggcattaaatagcacccgtgcattgcagaaaaaagatttgcaaaaatggaattattctgagcaaaaagagcaacaaccaatgtttttttaaaaaaatatcacactgagtttaccgataggaataatttattatgattttgctagaagataggtgatcaaaaggcccaaataaattattagcttttttagagccaaaaccagaacataagtgctaagttttggcctgaatcaataacgaccacacttcaataggttcaacgagtacggttcagcgacaaacgactgacgtggtctcggacatgctccttccgtacggacgggtactgcagaagccttaagaaaaaggtgaagttcatgacactgctcgtgcgggtctgcttggcgatagtctccggcagcggcatgtgcggccacatgacatgagaggggatagagagaagaggagagtagtgagatgacatgtggggccacatagatcccaccgtttttattattctgtgtgcgaaactgacatgtgggcccataggttttattatttttccaaatcgaattgttatatacgcgccacgtcaatgccacgggacaaagacttagtcaaaggagccacgtagacgtcacgtcagccaaaaccaagggcaatattgccgaaggacctcgtttgtattggttttgtaagttgggggatgtgttgtatctggttttgcggtctagggacgaatttcgaactcggtgacaaattgagagacctaaagtgaacttattttgttttcctatgtttactctttaattagctgggcacactttggtcacagcacaagccgtagaaaaaaaggttcacagttaaggtttctcatcttatattcaagtttcaaaatcatccctaaatcaaaataccaaatataacgcgcttctaattttacaaaatcagataacctccgttcttggtgacgtgagggttgagtcagatgggtcgcacgacctccggttcctcgcgcgcgtggtgggacaacctcaagggctcgtacgtggagacgaactactcgttctatgtgcaggacatcaaggtgagcactgagcaccccgtacgtagctagattctgcatgagccaggcaggaacctcgcaattgtaggcgacggagggagggaggatcgccagagaactaactggttggcctctcggcgttccaggcgcgtgctcggatctagtcttgccgcggcgccggcgtgcctgccaattctcacagggtagtgctgctgtgtgttacggatcggagtatatgattgcatcggagcttcagattagttgctactactatacttaggctctcttttgtttaggcttaaaattattgtcttagaattttaagtcagcttattggcttatatgatttacaagccggtggatttaatgtcctaagtttaatgatggagtaatgcatctatctcatataagccaaaaaaaacttatccaacctaacttttgacttaatagtgttagagtggcttatggcttcaaaaaagccaaacaaaacagccacttgtttgtttaggcttagatttttcggccataagttaacttataagcctaaacaaagagggtcttactagtccatgtttgagtgttgcaggataaataatacggggaatgaaaacggtcggaaatggtacattattttattatttttttcgaaaacgaacggaaacggtccggaaattttcatatttatgaattcatctatttagtgtcaactttaatgccacgctgacagaaattaaaaaaactaaattttgaaaacggtaacatcggtaaaattattattattatattagttttacggaaatggtatcggtacggtcggaaaattttcataccgttttcaccccttaatacctcaatctgccgctgctagaagaagtagtagctgtccaccagtggcggagctggacagaaaatcaaaggggggccagccggcttttgacagttcaaaaaattagcaatttctcttttctttcatgcattggcaacacgtaaaagcgaatagtttgcaaaagtcgacaacaaagatcagctacagatgtcagattttaaaatttaggatttgtggatacatcaagttcatagtgacgtaattgacatctcaaattggctctctcttctaaaaaatcagcaggatagaactttaaagctagagagcacactttatcaatgttgaactgaatgaatcacttggatccaaagatgtacacaaagtgagaaactctgttgcttattcactgaatctgctatgatatatgggggtaataaaaaattttgtttttattggaaggggccatggcccctgccagcccccctcagttccgccactgctgtccacgtagcgtaaaaccccagcaccacgaacagaaaccacgcgtctacctaccatcttttttttttagaccgcacggagtcatatatatctacagtaaaatctgccatggaaaatccgtccatcacgctagcctaagcggtttaattagtcgaaattgaaagcaacaggaagcatgtgtgtaatcagtaacattgcaacaatataggtaaaccgagcaaatcatgcgtgcgtcatttaatttgtatgttcaagtaaattccagttaaaaaataaagtaaatctcacaaaactatatatatactttgatgaaactatcacaaaactacatacatatttaaggaatcgatttagcagtatatttatcataaactatatatttaagatagcctatcacaaaactacaaagtaacaaatttatcccaaaactatagatttaataccaatatatatctaataaaaaatacataaggcttctaatagtgtaatagtgatagtgatcccatgttttaatttattgcttgggcacaaaaccaaggaaggattttaatttactttttcaattatagtgcaatagtgatcccaatgttttagtttatttctcatctcctaatagctgttataccagtgaaagaacgtctttacctgttgcaacgcacaagcatttttttctagtttaatcataaaactgcatctataactttacctgttgcaatgcacaagtattttttctagtataatcataaaactgcatcatttatagctctaacataactgtagtgctagagatttgaactctaaaatttataattttgtgataatttcaatattaaatctgtagttctatgctaattttaatattaaatatgtagttttgtaatgcttagccttaactttgtagttttacggtaaaatttggtattgaatctgtaattttacgatacaacactttaaatatatagttttgtgatagtttaatcaaaatatctataattttgtgaaaattactttaaaaattacttcctaagatgtgtagcatattttgattttagaaaatcaatctttagtataccaataattagttaacataacatgtatagaacttacaacattagattcataattcgaaacattatcatataaaaactttctattgcacataataaatgctctctggtccaaagtgaacaatcagagtacctattattcttcttccactaatatttcaactataacttcataactccttcaaaataatttgccacaacattaacaataataaaattttgaagtacattagtcggggaggactatggatcggacgtcaaacgttttgcaaaacatcggatggtgttgcacaacattgttacaaagtgtcgcatatatttcatcgtttgatggaaaatgtttcaacaaaatatagagaataatgtttcattgcatggcacaaaaatgtctcagcccttgaacaaacatggttcaacatatagaaaaaatgtttcaacaatttaaacagtgaaacacaatcgaatcattcttgaagcattttgctataacacatgaaacatcgattttgagctactgaaatatccaaatactttgaaaaaaaatgaaacacaaagaaaaacaccgcaaatttttggtcttcctcctttctagtggcaggccaccgtattggcaccggattacttatactccatccatgaagacactctattgcattctctagatgatccacaccgcgtacactgtccttcctactaccgttgttgacgaagatgaggctgagctagtcccctcattgctggttcccctcccttgatctagcgccctgagcttagcatggtcagaacgccggcctactacatcctggcaatgtggtgcagagcaagatgagtcgcctcatgctcgccatcgagcattagcgatggtctcagcaactcggctccatagctgctccagttgctatggggagagaaggggaaaaataaatgaccgggagtgggggagtgggaataagattgactattggaaagaaaaggagatgtagataatgattagataaaagtgagacagatgcatttaatatttcctcgtacgccagatggagatgaagcgttttcgacattagtctccagcaaaagagcgggaaatatacctattttgtcctacttctacgagcatagaaaaattctccatcctccctctccagtctcccaacctttctctctatatccacgtaggcatccatgtcatccattacggtgacggggccagtgttccacgtggcattcgtggcccgtgtgaacgcgtccctgcaccccgcaccggtgggggcccagattcctcaccctcactgacccacgggccccacccgtcaaacgagcggcccacccgcttcccgaaagacgcgtcacgcctcggccccacggacgttttgttaccccacccggcacctactcgccgtccccaccactccacagtgccagtgacgcgtgggtcacacccgctcccttggtcggccccaaaccctcccaccgcccacctgagcgagtggggcacgagtccctatatatataggcgcctctctcctccgcccccgccgaccgccgcgtgctctctcctccgccgccgccgtcgtccgccgccgcccgccgcgtcacacacacagaggaagcaatcggctgcccccgcctcctccccccatcggctgcctctcttcgcgacggagagaagaggataggaccccgactgcacgcaaacgcgaaaccctaggctcgtcgccggcggcggcggcggcggcgaccggtggggagatggcggggcggcggccgctcttcgacctcaacgtcgcccacgaggattgggattgggagaagggggaagaggcggaggcggaggaggaggagcccgaggaggttgttgaggaggggaagaaggaggtggtagtgctcgaggaggaggaggaggaggaggagccccatgaggtgatcatggaggaggaggtggtggaggaagtggtggaggaggaggcggcggtggcggaggaggtggacggggaggtgaggaggaagaggaaggactgcgaggttttggtgggagggcttccccgggacgcggcggaggaggacgtggcgcgggcgctcgcggacgccggcgatgtggaggaggtgcggctcgtgcgggatccggcggacccgcgctccaacaagggcttcgccttcgtgcgattcgccgccgcctggcaggcgcggtgggctgccgacgacgtccgcacggccatggtattgtgtccacccccccccccccccctgcactagattcgtatctccgactcgttcgatttggatagagttgtatctaatgcgaatttgatatgttgagaataagtagtttgggaaaaagtgttagctttagtcatgcttgaagtagagctgataaagttagtggtctgggatgcttcttgttcactaatttgaggtaatctatgcccttgcaatctcgttttgttgttggcttgtgaaatttgaattagtggatgtggaattagataatgagattaagtagtttgggaaaagatgttgctttagtcatgcttgaagtagagctgataaaattagtggtctggaatgttttttgtttactaaatttaggtattatttatccttgtgatttcattttgttgttggcttgcaagatttaaattagtggatgtggtatcagggcttttgattagtgttgaggaagtagatgtatggtatgtgcccttgtttttcaaggcctaagtgaccgatcagaccacaaaattggggaaaaacagattagccaggttgaaaatggtaccttttagttgatttcatagcatgtgcctggttcacctattgaactaaagtcgtagagatatttaaaagtcttagttttgaaaaatactgttctaaattgtgatgtgacctgctgtggtgctaggtgtcaccttcccactaaggtcctatgcaccaccctgctttcccgccaagtgccttatccaaacataattttaatggtcatattacgttaagcttgtaatggcatatttgtcagtacttgatgcttcggatagttttaatgacgactcctgctggaatgccttcttaaatgcgttttgtgtttcatatatctggtaataatgaccaagacgtggcaatctaaaagaagctgaaactaaattagcaaatattttggcgctcatttttctaaatgcaatgagcaaatatttttggttgttaagccaatatggtaatagccaatgatttcattcatggtgtcattggaaaaagaggcactcagttagatttacccaatgaaaatgggaaattcctgataatttgttgtgctatttataaatattttaaatgctgttaattactccctccgtcccaaaaaaactcaacctcgtactacgatgtgacacatcctagtactagattgcctttgtttgggatggagggagtaatttgtaccacactgcctcacgctcaggacaaacactaggacaatcgttattaaagatgctacttacatgaatacttttcgatgttcccggataagttcaaactgattgaatctcagttatcttgttgtagcatcagtttgaattgaatgtaaaatgtataaacttgcatacttgataaaaatctgcaattgatccatatgtgcacacacaaacatccatttactaaaatgtgttttgccaatgtgtgcacaagtccaagttagcatacttgcatttatgttatggttttatgtttaagcactggtcactatactagttattctattgaaatggtgatgcgaataagtatctaaactagaggacaactgcacttatgaactaattattctgttgaagttgttactttagttaagagtcacaattagagccacaatgcaaatgtgccaagcttattatactccgcgatatttgccaattcattgtgaagtttgctcccacaatgaactgttagatcattagatccaagtctgttgaactccacattagttttagtttcccttctattagacgataatgatatctttattgatcagtaataatgtttttccaggtcaagggagaagcttgtatgatatgcaagaatgatgcaaacgagacccttcatctgcggaatatatgctttgattggacaaaagatgatgtatgctttcatccttatttaattaattgattgtaatttttgtcacaagcatattgttattttctacaagggttctcttctgtgcagttagcggaggaactgaaaacttacaagttggaaaaccttgaggatattaatttagtcgaggatccggaaagaaaaggaaaaaacagaggctatgcgtttcttgatttccgcacaaatgttgatggtgtggatgctttttttaaactacagaacagagatatttatcttggtacggatgttcgagcccaagtgtccttttcaaaaactctttcactggatgataagattatggaaaaggtagtcacacaaacaaggcatctatattttgtactatatgaatctgttacacgtattggaatatcttggctttgacttagctgctataactttgattatgcattgcaggtaaaatctgttttcttggatggcttaccacctcactgggatgaagacaaagtgagagaagtgtttggaaagtttggtgaaatcgatagtatacaccttgctaggaacatgtttaaagcaaaacgaaaagattttggtttcattggctttacttcaagacaatcagctttagattgcattagtacagttagtaaaggtggtattgttgaaggtagcggaaaggtaatcacttgaggtgtttttagatgtgcttttcttctggtttatttgctccagctactgttacttagtaggtcaatattttcaggttcgaatcaaggcttctttacaaaggcccagacctactttgaaaaaacattcatggcaagggattactcccatgttgggcatcaggaggggatttattggaaaaagttatggtgatagagaacactatggtgatagggaacgctatgatgatagagaacgttaccataatagagaacgttatggtgataggggatttgggttttcaggtcatgcaagacgtgattactcaagcaatcatgttcatgacaaataccatcgccacatgcatcgtatggcaattgatgttgaagaaaggcccgtttcatcacgagaacacagatctcattatagaagagattctgcagtatctggttggtttcctttaatcttctctaaataaacttctttcttttttctttctctccaaggctaatgaatgtttatttccaatacttggttgtaggccacatccacaggtatgagagggcaaggcccagggaagcatatcttgatagtcgatatactaatgaatacccaagacataggcactcaaggcatgaagaatccatccagcgagatgcatacaggagtaaatatggacactcctacctggagaggtcacacagagattcttgcccagattgtaatccaagtgatcatagttccagtgccttctataagacagtaagcacactatataaacactatctggttttattatccattgcttgatgttcattggagctggtttactttcttaggaccatgagccaacaccttcatcttcccaagtagcatcccactgtgaggaatcgttcagtcaggttgtgtttttacacttcctcctataaattcagttgcttcagagtgatgctaactatttgatcttatgtttcccagggccgtaagttgatggcatcaagttcccctgggatgtgtaattgtggcgaatgctatgttgtaagcacaaaactacagcactagtgtttggaatgaagtttctttgtaatacttgattctgattgtagaatcttcttttttgtcaggaacaagatgcagcccccgcaagctcccaagtggtgcctcttcgtcaccagttggccaaaccttttcatgagcgaaggtatatatattctgacgcttcatgtgttcctatcctttcacctactcttcgaactggttaaaaaaaccgtactctgatcttttgctgtagttctgagcctgatgaccactctgcttctgcctatgaagctgcggagtacaaagaacgcaagagcaggtatcatccatcttccagagatggccccagtaatactcaccacaggaattaccgtagacaaggaagataggtccaagtaagcaaagctaagctttcgacaagatagagaagctgctcatggcagtgcagctgctgctagagctatacttatttagtagcgtcgagttaccattggtgcattggtggtgctcccccgatgcagaatcctcccaaaaggatttctggcttttgtgggcgttgcaattttttccggccctgtggttgcgcacattttaccttgggatgccatgtcatgtgatgtgacattgtagttcgtttaccccggatacataccgatagaaatccaaagaaagagatgttaacttgcatggtggtgcgttgcgttgcagcctggtgcggttcgtatgagtttcagttttactgctggtgtcttcagagttctgatgtcgctttggccgttggttgattgagatgttgcaattgcgagtcaaaaatttcgttgacaagcactatagagcattgcgtgcgtaatctgaaagaatatagtttcttttagtgccgtactaccaaacacaaaaggtgctgaatatatatatttttgatttgtgcgacacgtgccatgtagcaccacataacttggttcgatgaacgcgcagcaaagaagggcgagttttgtgctccaaaccgtacacgatagtgcacattactttacatgatgcttttctttatctccctatgtacatcaaatttttagctgttttttactccctccgtctaaaaaaaaactagtattagatgagatgttttctagtataatgaatgtggataggagtatgtccagattcgttgtattagaaaatatcacatccagtactaggttgagtttttttggacggagggaatatgtggtactacacatcactgtgttgcacgtcttaaaacggtcactttttataatcaaagttttctttggactaccttttctcaatctttacgctttcaaacaagtaattgtgttttcttttttatggtttaccaccctaactatatagtgtggctggggtaagatagttgacgtgggtgtgccgatgtgtgcttgagaatatagggttgggtggttcaaaatgtaaaaagcaaaattacttaattcaaagtaacaagattaataaaaatctggtaataaaaaatgactcaaattacgattcgctttaaaattattttcgtcattgatgtgtgcacatctgagtgcactttggtgattaggtacgcaactctcttgtcaactgagaccgcaggagcctggagggcaatctgtacacattttatacggtagtttgtggaccatacgcacttggcagtggagtttatacaacttaggactcttttgattaaaagaaaattcatagaatttttttcctatatagctctttgaatcaatggaatggatcctataaaatcctatgaaattcctatggattgtcttttcccatgcaagttttggaaaaaatttaacatgaggtagaacctcatggaaagaatcctttgaggccccttttgattcaaaggaaattcataggaattttagaggatttcattcctataggattttttcctatatagccctttgaaaatcctatagccctttgaatcaaaggaatggatatcctatgaaattcctatggattggctaataccatgcaagttttggaggaattctaacataaggtaaaacctcttggaaactttcctttaagtctttatctctcctctaattcatgcgtttttcctgcggtccaatcaaactaccatttctctgtttttcctgtgttttgcaatcctctgttttacacttagggcccctttgaatcgtaggaatgaaaaaacagaggaataggaaaaacacaggattctgacaggaatacaattgtaaaacagaggattgcaaaacacaggaaaaacacaggaatggctgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggattttttttccataggattgaaatcctccaaaattcctacatttttcctacaaatcaaaggggccctatgtttttcctacattcctatcaaaatcctgtgtttttcctgttcctatgttttctcattcctgcgattcaaaggggccctcagtctttatctctcctcaaattcctgtgtttttcctgcggctcaatcaaacagtcattcctatattttttctgtgttttgcaatcctgttttacacttgtattcctgtcagaatcctatgtttttcctattcctttgttttttcattcctatgattcaaagaggtatacaataccttatggttttacgcactcaaaggggtatacaatatcttatggttttacacacttatgtgatgggatgcgaataatttcttgcttggtgtgtactagataagaggatggaatggatgtacggtgattgattgagacgacaaaattggatgaaatcaccatattttacaacttgaatcaatattggttcccagattaaatagagagaacattagggcccttttgattcaaaggaaattcataggaattttagaggattttattcctataggaattttttcctatatagccctttgaatcaaaggaatggatcctatggaatcctatgaaattcctatggaatgcctcttcccatgtaagttttggaagaaatttaacatgaggtagaacctcatggaaagaatcatttgagtctttatctctcctcaaattcctgtgttttttctgcggctcaatcaaacagtcgttcctatatttttcctgtattttgcaattatctgttttacacttgtattcctatcagaatcctgtgttttttctatttctccgttttttcattcctatgattcaaaagggccagtagagcaatgattaatgacattgttttaattgagagtatcctatgtggagaagtaaagttttgctagcaatcacataagtatccaatgctcacatttaattaatcgaaatgtggctgcaccaaatcacagctaatggggatagttatataggatttgtagatacataacatagctctactgctaaaacacctaagcaagttttacatggctgctaatttaccttggccaagattgatacggagttctcattatggttctatggtacctcatttattgtttaacaagggttcgttccggtggagggatctaaataacacccctaaccgtacgaattttctcgtttttttggaatttttttcggctcctcggggaggataagcgtggttggctatttttgcaaaaaactcctcgtgtttgtagaaaatatcgcacagttccttaaaccgactgacaacccgacatgttttatccgaaaaaccccttgtatttcagcgaaatacaatgtgaagaagagaaaattccgcttctaggggtttttatgaaaaacatccatcccctacccccaatccccaaaccctcctcgttccctcacctcagcgccgccgccgccgcaagccccgccgccgccgtccgtcctcccctcgacgtcgcctttcgctctccccccgtggtcgccgtgcgccatcccccgccgccgccgtgcgtcatctggcgccggtcccccttcccccttcttcgccctcccctcgcggcggtggcgtaaccggcgccggtttccccctcccctcgtggcggcgtctgagtcggctccggtgctcccctccctcttccatcccctttcgacggcgtcggggatgacggcaacgcggtggtggtggcggtgtcaggtgcgggtagaaaggagctggtgacgggcggggacaaggcgtcccgatctgcactgactcgatctgcgcgagccaaccccgcgccggattgaatagggtatgaggggagaggacggcggcatgggaggatgaagaggacaacgccgatggagaaaggggtgaggttgcccggcgggggatgctggccttcaccgacgcgtggctccccccgccgcggccgtcgtcgaccgtcctccacccgtcgtcgccaccccccccccttctcccctatctcgggcctcttcccgacctcatgcctgcacgagcgccggccgcgtcccgtgctcctctcctggcggcggcgtcggagccggcgcccggtgccgtcctcccttctggatcgatggatttggaggtagtaccggcggtggcggtgttgggaggaatctatatgagtatttcactttcattcctcctcctctcactctcactaccgatcgggagcgcggagtggtgatggtggcgatgtcggagcgggggtgctggtcgcgtccatggctcacctcatcagggcacgcgccatccgcgccggcaccatcatccgcgtcctcgactatctcttcatcgactccgacatcaacacaaggtgaccatacaaatccttcctgctttcgatcgatctcatctcgctgctataatcatgtatcagaccagatgcctgcctggctgatcgatcttttcaaggagccgctctttgatcattttaatgtatgtgtgtgcacgttttgactgctatcggggaaattttggttaatttccttttttcattctaactgctaggtaaaattttattctgaaatgctctgccgaaattcgttttttcggagttctaaacggcgctagggaaggactgatgaataacagggcctgctctttactgatccagggcagaaattaaatctaaaaaattaaccaaagtctggtctatttttgtatagtagcagctcttgtccagtttatttacatcaggcaacattctaaagtgatgaaatgcggatgaaatcaaatggatgatctacttgttcatattgataaatttaatattacacattatcaacctaacaaatgatgtagtttaagaaagtttttagcaaatcattataagcatggagtaattaatccatgtcaatcatccgattaacaacctgtttagaatggaacattgttagctatttctttttgttacttgaaactttgaaagtttcaagtattacaacatgtgtcaacacttactgaaaattgaatccataactaacttttcctatcatatcttggtttctcagttcagggtcattatcgtccagcaacttgaattgctgcaaactgagtgtgcactgatcggtactagcaatactcatgcgagcccagtaaactttatctcacatggaaccatgcatttcctttccattgtgagctgtccccggcatgttgctactgggtacctgttctgaccgacgtggtggagtggtgatgttgcagaacgcgtacaacatgctccacagcgacatggtggcggccgtgcgtattgcgcacgcatgctgtatgttcctcgacgagctcagcaccacatacctctttcctgcccaccacaacgtcaacgtgagcacattcagatctcccaactttataaaagaaattgcatcttaattcaaagatagtttcttgcacctcttcgatgcttcatatctggagatttgggtagcggaaattgactacaacgacctatctctgattttggagtcgatactaaataatcaagagaatgggcttgttttgtttttttttttttttctagagtgggatatggaaacacctagcccaccgtctaagatgagatgttgtctaggataatagttgtaattggtagatgggatattgcagggctacgagagggtaaatgatccctctgtgtaataggggaggggagtttatttctagggtgaactaaaccatccaaacaagcaagtgcaattctgaacagaaagtaaggtaattgactgcaacatctatcaccgaatagatggtgaaatgaagatcttaggcttttttgccacttgaattgtagtttctaaatacatgtccactgatatatctgaaccatagctacttttcacggacaaactagcttcatatgtatgaaacatggcaatgaaaatgttgtttgattcctggattctgacctactggatttggatgcatcatctttcctttgaagtgttagccatcatctgcaaaagtattgcattcccaagctctttggatggcccggtgccaaaattgaagaacatcatgtactgtgttggagagtgcaaaccattcaaggcaccacaaaacatatctcctctgttctttgtagatgttgtattaggatacatgcaatcaaagattcaaacatcagattctttaccagctaaaatatcaaaaaatattaagacttggcagtgtagttatctttttactaattcttatagatatatgattagaaaaatagaatggtaaaaacatgggtattcgacactctcgcagtgtactagacaagtaaaaaaggacactagggagtataaatcagtcagcacatatttcattttggcacttgatatttggtgccacctcacctgtcatatcatggttttgttgttttccaccttactttcaggacagtgcaaatgtaccaaacaacacagatgtttgcattgatgtgtaccatacccttcagttcaaaatttcgcttacatgatacaagcagatagcagcagactccggtccttctcgtttttgtatttgagagtattctgccatagttccttttagggttgctaacttacttgccattttaccccacgttatatatgatgtattgtttggcaggagaacgtcaatcgaggtcattccagttcagaaagaaaaatacaatttctttgctatccattcatgaagaattgtacattacagagttttaaagtaaattgaaaaacgattgcaccacaaaccactttttatttaaatttgttgtacctactacatctcatattgttaaatgtcaggtcaacatactggggatatatacatgacaaaagaacagagcaaactccttttttatccaaatcattgttcactgaagtggagttgtttctcagagacctcactaatagggtgagcttacaagactgatcattgttagtcttcagctggaaaccaagcaaaagatgtcatactgttgtaaccatgtttgaagacaatttcgttgcctcttgtttgaagatggcaattgtcataatgcgtggtttgtcaaaaatatgtccactgtgacatgcgtatatgtattaataatttgtcagttatttgtacctatctgttttgcctagatgattattgtaaatgctcttatcgcaatgtaccatcctgtattattcatgttattactgatataatcttgcgcgcggcgtggcgccgcgccatggcccatctagtgctttgcaactactgatcctgatgtcttgggctttggcagtgattggtgggcactgggcatagtttaagggtgactaggcaacggtaagactgccggtgagcagaacaatggtgatagcgttggttgcatttggtgttaattgcaggcatgtgcctggccgtaggtttctgttttgctcatagttcatggtaagagtggacgaggaaccatgccaacaaaagcatataaatgtatttttgaaaaacttaatgtaccatcggatattagtctaccactttatcctgtccagccattatttttctatcagagaattaacagataaaggagaaatatggacccatcagtgctctcatatacttagtggcagttgagtttcatcaatgctctctcgtaaggtgatgagattattaggaaaatttcaaatagtcccacctgagcacatctctacattgtagagtttcacaagtaagaaatgcatctccattctgatttttatacaatattttttttaccctgcctatgaaaaactaattttttatttatagtaattaataagtcttgaattaaataagtggtaaatcttaaattgaatttgtaaaaataggatggacgttgtttcaaagggcatccagatttggacgttgttctaagaagtgtccagaggtggacgttgtaccgaagcacgtccaggctcggtttggggcgcccatgccgccatgcggagaggcgccatcgtcgactctcctctcctcgggcccaatgttggtgcagggctcaggcaaggtgctgccatccccgccgttcacctcgactctgggagactgcaacggctgccttccggcttccgcctccacaacgtcaggaatctgccgttgcagttcacctcaactcacctcgaaggctctcgaatctggagaggacgccgccgctttctgccttcacgccgggagatcgcagccgctatccacgttctggttgagtcatgctggaacaataacccactcatgccggcttgtattgcgtcgtctgtccgcccctcttggttcctaacagcaagaccaggtatcgcctcactccaggtggctggccgagcaagtatgctcagttcatagatcttggtattcaggtgtatatgttctgcaatagaaagtttacaaagaatgcaaaattatgaagggtaggacgcaaacatcctccttctatcagatcatctgtcgcccgatgacttccaatctctggcctgttgcaaaaggaaaaaaaaaagcatcgatagaagacctcgcatgcagtacatctggcggccgcttctcaagattcagtcagcaaagagctcgatgcgtagtaaacaatggaccagcacaaaaaccaaactaatcaaatatctcaaaataaaagtggtggctgttcacatatgaccccgagtagagtgtccgtcatgcggaacagcggaagcattgaaggagggccgggggatggcgaccctgtctggcagatcaggtagagagcggtgcctgctcagcaagcaagcaatcaacgagagacaatagtctgcataggagtaacgaggcagagttcgaccattgtgtgattggatccaaagtccaatcttagtccggtgaattggacggctctttggggttttcaatggacgcccttgtaagcagcgtccccatctggacgttttctacaacagcgtccacacctggacgccctatgcaatagcgtccttcctattttcgtaaaaattgactttgctttattatatatttaatttctgcattattaattattatgaataaaaaattcggtatgaaaaaaaaaggttggttgtaaaaatagttttttttaagtagtagtggccacggctcccgtcgtcgcgcaccatgcagatggcattgcctagctaaccacgatatcggcatctcgctgctctgcaggtgctcggtcaaatgaccggtaagattcaatggctggtaagcgacacttatacgccactggtttgaagaacatcactgctatttgttttgccttggaatttccttcttaatttaagtaatttatccatgttttgcaaccccaccccaccccccaaaaaaaaaaatccgtgttacatgcaattgtatctgaccgaaaaaaaaaatccgtgatacaattgcatatgctagtgtggctaaaaccagatacatacctcctatgtttgcaatgaagtaactttagttaaattttacagaaataaaatagtgtcatgtgaaactgccatagaccgacggaatgtgacctcgcatcacaatgaaaatggaacggaaatttagctaagccagtgcttgacttgacagaaatcaggacctgacctgaaacaccgcagaatgtcacggcagcagcatgtggcatacacagcctgcacccatgctcaaatgcacatgcacaagaaaaagaaattctaccatagcatagattcagatctctcattcttgatttcacaacagctagccacatgagcatgaattttcagtatatgaaaaccctcttaaaaacaaattcagtattgcaacaatccacaaacattgcaacagatagatcatgcttgattctccaagtaagattttcgaagatgatctagtcagaatccgaagtaagatccatttcagggtgaaacgggcggagtaactttgctaggtgctcccccatgtcatccacctcctccctcccgaagccccagtcacggaggaccaaagacccgatggcacctcttgcgacaccgtgcttctggaggctccccgatcgcctctctatgaaaggcaggacagtgctgcttgatcgtaatcgtgccgccatcggtatcgattcaatatcgagtgagccctttggctgggattcttctgcatggtcgctaaggatctccccgtgccggccaatgttgcctctgaagattgacgggaacggaagggggacagggagggggcaaagagatgctgagagatgggaaaattttggctttgtctctctggcttcgtagactgaacataccgagtctttcacttgtgatatggaagtcctttgcccacctgtgcaaacaaatttcaattgttaattctttgtacttctacatgtataaccaaaatttagccaccatgcctataatgttgtgaaatgttcaatattgtacaatataacagtagaaaaataagttctgttggcatgacaaaacttccccatctagttttccgcgcgcatgcttttcaaactgctaaacggttcgttttttgcaaaaagtttctatacgaaagttgcttaaaaaatcatattgattcatttttgaaaaaaaaaagctaatacttaattaatcatgcgctaatggaccactccgttttccatgcggaggagataggttcccatcctccagtaccgaacacagccttaatcagaccctacggcaaaagataagacgtgcagacctctatcaagagctccatgaaccaccagcgattcaactgaataaggatcttcgtcctcgtcgctgatttcaggggtcaaagagtgcagcttcatctctatgttccccaatagcatctctatctgcaaattagatgtgtgcaattagcaagcaagattaaatttccatccaatgttggtataacagtagggcatatgttatgttgtgtacctgtcaaagaaggggcaggcatcgctacatccagagcagtaaccatattctgccgaccttgatcagataaaatgtgcagaagttcaccaatgtcaagattaccagatgaatgtgctaagtctgaactcgggcccgttcgttgcaatctaaatggaacagtaattgaatgtattgctgcagcacaaacagcactagcatggaatggtttctcgtcttgtatataaagatacggtgacatgtaacctgatgaaacagagtgaaaggaaatttgtgagaaaatctcattcggaataagctttctgtacattcacgaaaatattttttaagggaattcatgaaagtaattttgtatggaaatcaaatgtgaatatacagcatgaacaaaaggagttgattctctcttaatggaaacgcaatcaagtgcagtatcttaaggcacaagatcagtatacatgaaagcaatcaaaggcaaaactaggccaccggaaagaagtcctataaaatcacagaataacaatagcatcgcaatttagtatcctcctgtgtatttagccaacttacgagaactcctcagacctaaaagtgttcgaatggaaagttttcaaaaaagaataaaaaaataaactaaaatcgtggagttcaggcaaagggcatacttctacttaatgaaggcggtcctatggggaccatcaggttgcaaaaggacgaaagttttgaaaatgaaacagcatcatgaagagctctcataatggactccctttgattcatcctggatgatccaagggtcattggatccctcacacagtaaagcaatacaggtgtatttgtgtaatcatcagcaatgttctccaaaaactgtgcagctacactggaaaaacttcctgaatcacccacaataaactggatgccctgtggtaaattatgaatcaataatgctaaaaataatggtctcaaaatatgcatgatatcgaaaatgatgtgcataagtgaacattagcttgttgcaaaactatagtagagtttgctgataatttactggggaaaagttggacctgaatatggtcgcattcttcaacaaagaaccttagcctctcattcatttcctctatttgcgaccagtctgaaacaacctcttgtgcgctgccatagttatcaaacttgtcaaagtctgtccatgacccatgtaactcatataaactctgaggatgatactgaacttttgaataatccgtccaaaagttgacgccattctctagacagtcgatcaggtccttatcttcaacacttttctgggagttgctggcaccattgctagtgcttggattctgcccttcttcaactaagctttgcagaaacaagttccgcccatgaggttttgagactgatcttgttacatttccagacctatataaaccaggaaaaaatcatcatggtaatatatgagcccaacacattattcaacatataggtgcccctaacaggaatacaagagttagtcctattctcgtcgatgaaattagcatatagttactgatagcatgaatgacagcagcacataacaagcaacagcaggccaaaagatgaatgcaactctacgaaaataataggcaaatgcaatgcatcacttccacagaagctggatgggtatatgcatcattactaccagtccatcgctcccttattatcagcctaagagcagctcattgctttctcaggctgcagaaatttcctagaactgtatcaatcaaacattgctagagcaaagctgctatatttgctatctgctttctttgacaatgcagacatgcttcctccatttgtcagaattatcccccagctgtagatacctaaaagcttatttaactctgtaacccatttgcacaagcaatccgatactaaactgaaacaacagtattctgctgcgtagcttgtacatggcaaattacaacgatcatttatgcatggtgggcacaataagcaaaaccaaacatggaagcatattctggagaagttagagcaccacttgccatgtagcaacattgagctgatctgcagaagcactggtctgacagagattaccggatgaactcaaagaaccaagggacccctgcaaatgataccaccgtgaacacgcagcctacactatcagtaacaaaataacagttgttacacactacaataattggatcaaattcacagtcagattacctcgagaaccaaccgataccagacgagggcagtatgtgggtacaccctggtgaaatcaagcattgtatgctagtagctatcaattacaattacaacagattttgcgaatctggatcaccaaaggcacttattacacttatttcagactaatgtcgaggaagaatcgcatggagtgacagtattttctattttcaaaccaacctgcaatgaattgctggtcccaaaacacagagaacctcgctgctcaggtaaagcttcagtccataaggctatacatctctgtcgggagttccaaagataatctgttactccctccattccaaaatataaggcataaccatccctaatccaaagaccaagaaaataattattatcatcttgtagtttggatcattataataaatacaatgcatgcatccaatagaattatagaacatgataatggaggatttaaaaaagtaataatttaatggagaaatggtcatagttaatggcctacatgcatggatgccttatattatggaacatctaaaaaagtggttgtgccttatattatggaatggagggagtatattgcaagcacagtgcaagaagttaatacatataacccaaaatggacacggtgatcaaaataacagtagaggaaagaaacggatgaaacataccacagcatgcaacagtttattgtgtagatggacacatgcagattttcctgatatgcaaggagattcctcaagtgtgctcttgttccttagatcctctgacaccggataatgcctgcagcacctccatagcacaaccatttctcgctacctttattcatgttccatctcaaccgatgcaatgctacagctttaggaggaaagacctcaaaattttcaggggattcgctacccctgctggtgcttgtgccaaaattctcttgcattgaaggagcagctaaaactatggcaccagtttcttgtccttcatcaggttcatcttgttgaccatctctgatgctcggatttatagcacaattgtattctgtatggtggttaagcaggcatgtcaggtacaagcaaaatgatacaagttgcaggcgacagagattacctgagttggcaagaagttccccttcttctataacatgcaattgagctacatctttgcaagttttagtagcccgtttggtccccagaggaacatttgacaaaggagagtttggtaatgcaataccaattttaatggttgttccctcctctgataatgaaccacaaagaaaatatggtacacggttcctcccaggttccttttcccagaatctcggagtaagctacagtaagttgaatatttctttagcaatgttatagagaatcacaatagcatgcataaatcaatagtatatgtgctgtttagtttacctcaaagcaaacagcagttccatcagccacacaataagccgcatagcctggatatcagcaaaacaaaattacaaattcatgaattatcatgaatatttgacatttttactctgctcacatgtgtggaactaaatattgatataaggctataaccgatattccgatacttgacatagatatactatggttggacatgaggtgaaatgcacctgcaatttctgaggcatggacactccagatcaaatattcagacaattgataggtagaaacaccctgagttttcattccaacaaatggccttccagtaacaggaacatcatttgcgattctcgacaagctaacgaactttaacgtgccatcttccaatgatatgacaatacctctgaacacaaagataaaaaatataacagttaacattaccattcttgtaaacaaaagggtatgtctggcatatatacacacaatatcaccatgaatgaaacaatgtggtctatttaatcacgtctactttgatccagtaacacatcaagaccatgtccagtgaaggaagcttgcatatttagaaggtacgtgggcaaatacaaacatttatattaataattacgtaaacaagtgcaaatagagcgtttgcaaaaaaaaaagtgcaaatagaattacttaaaaaaatacgctgatgctttaatggaactaattatataaacaaagacaatatccaccttagcacacactaacagagaagtacaggccctatgaacataaattacatgactaaaacaattgtcaacattctagcaaatatggtttctagtatgtgttccaacattaatgaaaacatacatctccatttataattagtgcagtgtttcaaagacaaggaaaacaacgtaaacaccgtgttagtgatgaaaaatcttctgtagtgaaaaaaaaaacaagtacatttagtgctttacaaatattaccttgcatccttcaaccattgaagacttattacggcccttcgagcagtagttaactcccaaagatggcgatatggatctctgcagcaaagatatcttatgagatgcactaaaattcccaaatattacaaaacaaaaacggtagaaaacaacagcaaatccaagggggctgtgacaggtagtgatttaaccataacaatcaatatatccatagccaaacacactgcagcttctagaacaagtttcttagtgcccattgaaaagctaaagaaaaaaaaccgtatatcgcactggattcataaagaaactcctgctgacatcattggtccatgtgataataacatattctgcatatcgtgcctatcttttgtttgttaactcggaatttttaccattaggaaacaaacagaaacaaatatgaatggttcagaaattgggaggtgccacaaattgagagaggaagggggagagactaccctcaatgttcagacctctgaggacccatacataatattagaaattcatgcaggaaaagagagtagttcgaaagatgttttaaacattgcttcagttcacaacaaggccaacacctaccttaaatcccagaatttcagaccattctctccagcagtgacaaaggcattcatgttttccttactgatagaatgacaagagtcaaaactcaaaaattatcttttggaatagaccataagtaacggtacaactggctacctcacagatggtgtccacgacacggttctgatgggagcagattcagcagttacacacataaaaggttttgaacctgtttatcaacagaacgcatgatttagttttgtttgcaaacagaacagaataagaaatgtgaagatttgggaactccagtaacttgcttttaaaccagtaaagcagttctacagtcagacatgttgtcaggcaaagtgtaaatgataactgataagagtgacgtcgttggcaaaactatctaaataccttgaaatgacaagtttgctgagaacttccataaagcaacctggaatataagaaagtcaatcacagaactttcagaacagcaacttgaaagactcaaaggtcacaggatttaagttaagaaaataattttgctgggtaaggaaaaggtaccgttccatcgtgacatcccgccaatatcatatcatgagagggtgaccaatcaactgtcaagggaatgctatttaccattataaagaggcaatggcttcaaaattaaagttcatgctgaggaattaagaaatatatccaaatcttccacctagtttgagctactactagcaaaaaaaaaaagaagtctacaggtccaatacctttgtctgttcccacactttactttggcagagctaaacacaggcttcagctttaaaaatcgagggtcagtaccctcctttgaagaagaggaatatattttctgaatcatgcttggtgatggaacttcccatctgtgcacaaaaatgaattacaagatgataagagggggtgatagatatttaaatgagataaataaggatctacaagagcatacactcacacttcaagcgagccattccccaagagtactgcaagaaaacccaaacatgatttatgttctgactgatttgctgaaggaggtttccattttatgtcccaagcaacttttccattatgagctaaacataagacaacccttggtagagaaatgtcttttgggacacgagaaagggtcttttctgcagaacaaatcatatgataatctttagttgattctttaaatcgagccacttctgtatcttttagttcatcaataacctgagcactgttttcagaaggaacagatacagcctgatttctctctgcgttttcaaagttacaagcaggagtacaacatgaagtatatgcagttgatgcagaagatccgtccatgttctgtacttcaacactaagcactactgaacttctttcatttgaaacagatttctttttatcttgaacactgccctttccgggacatgattctttcttgcaattttcaactaaggccgcattgtcgcttgacttgggaattgtctgtgttttttgttcttcacccctgcatgctttagaacaaccgcgttccgttgaaattggctgctttctaggtctgcctctacccttcttggcacttgattcttccttgcattttgcaagacatatgccctgtgctggtgttgcaacacgagatgttccaacactcaaatggacactgttctctatagcacagcttgatcgaccaatgtcatttgctaaaatgtcacaattactcttggccaagaccatgagattatttgaattggtcaaagtagaacctttctttggggtctcagtaccaggagcaaatacacaactggttgtactcggaaatggtttcttcctaggtcgtcccctccgcctcggaccagttgagttactcttgttgcttgattcaggtaaaatatacgtaggcaacatggatcctacgtcagactgtccagattgcatggaattatcaatatgaattacttccttttctggctgttctctacccctctgacctgacaatggaactggggaggctgcatcaactgcagcatgagttatattagcaccagacccagtattttcagtgggacccaaaccacaatcaattgaaccaggcaacagacagacagaatcatttcctaattcagtatcagtgcctggaagatgcttgctgttgcttggagcaggatactttcggggcctccccctttttttcttgggctccatgcaggttaaagctattggagatagagctgtagacaagtcttctgttagtttaatgccagacaaaccttttatttcaacaggttttttcctaggtcgccctctaccttttcttggagttgattccacaggattaacagttggcatgggacaagctattgcaacgtcacatgaaacaactgctgaactgacaagaggatcaataagagcaaactcttgacttgtgtcgttttgggatgaatcttccaatttggcaattggcagcggatattttcttggtctgccccttggtcttttgacacttggttccaagtgatcagaatttgtgatggtctttcttggtctaccccttcgttttggttgattggatggattatatttattgcatgcaaccaatgactgatgaggatgaccctcttcagatggtgctaggagacaccaaacttgaattatacctctcccgattaatggcatgccaattttatggtaagaagaaccaggagggtgagcagcaacagcaagatactgcaatgtataggagacgtgcaaataaggttatcagctctcaataacttttactcctagtcctatactttttttcaagaccagcaaatacttgaagatataaaccataaaaagaacataatactactttcatagacactgaacattcaatgcaatcatgcaattaatctgcatgcaaagatgtccttgggaagaactcccttcggtcattttcttatacatgctttatctcagcgcaaggttttattaagtaaaaaagaagtaaactgccattttatcatcctgcaatgcacagcacatagaactggaaatgttgaaccagattcactgctttaacaagagttggaaaagatgagaaattttactttgattcctgtgagcatctaaaatgggaaatacaaatacagaaaacaaaatatgcctaatataagtaaacgtggggagtaccgcaagagatgtctttaaattcatgtcaccataaagtatgtggctcaatgaaacatgttaattttcccattgacatatgaactaaagaacactcatcatgttcatagtcacagcaagtagtggatattggaacaaaaattatgctgatataaaacaattttgaagccacaacaagagaaaactttcagtattatcatagttataacctcacagtttatgggagaatgaggcctgtcacacaacctagggcaccagtccaatgcccaaacattgcccccggcaaatataacaaaatctgagctgcaaaagctaaaaaattattaaacataatttaatcaagatggcttcaaggagaagtgaaagaatatataacatggcaggtaaaaagtattaacaatgttttatcacactgtgaggcaggtactaaataaagtgggaagcacaaaggcacaaaaatagtattagatcagatctattttcatcaatcacaaaaaaaaaaaaacaccccccccccaacccccaaccccaaaaaggaaaaggaagaagggtttggcaaacgtgccaaacccaatgtaggggcctgttcactttgatgccatttctaaccataccattttttggcaaagttgccaagattgtgcatatgtttggtttcttaccaaactttggtaaaaacaccagaaatttggcaactgtacagtaatgaccaaaatttggtagaatatacgttggcaacaaagtgaacacattcaaaatagctatcttgccaaaatttggcaacattgccaaaatttgctaaggtttatttcttttggcatcaaagtgaacaggccctaggattattcttctggaccaaaagaatgacccactactcccaagttgatgtggctagtagttttgaagtgtgtgcagtcaatttaaaaaaaccttaataactagcatgcacaaaaatatttcaattgccacaggtgtcgattggagactctactgaagactttaaacaagtttggaaggttttcaaaataagattcaagtctcgcatctcgtgtttcatagaagacctactcaaagagatcaaaggaggtatcccctgaaacctgaaaactactaaccaatagcaggaatacaatatatgttgccaattagtcagcctattggtcatgttacagcaaattagcaactagtgaattgccaaaggagctaaaataatacataagcagacatcttgggttattcctaatatcaactgagaaacttaacataacctatctccactaacagtatgacctttattgacaaatatgggggaaaaacagacaacaagataagtagattgacaagattctaaagtagtacagaaagaactccataaacaataactgtctgttttagccttcccatcgtctaggtgtgtgatctgcagtgtgatccgaacttaattatgagaatatggtccaaaaggaacaaaagatgatataagaaatctcattcagctgaacacaacaaaaaatagactcaagaacttagcacaaggcaccaacagcaactaagttacctggggaacagatgcagacgagaactgtggtaagtttatcttgtgtgtgtcaactctggatggagctgatctggcgtcacaagtgaaactaacattttttggctcataagagaggtgcctccattctctgcaaagatatgaaacaactagcagattaggtactaaataatattattttttttaaaaaaaaagaaggcagtcagattagacaaatgaaaaagcagcttgtgaattccatttaattgatgctcagaatgactgctagaactttccacaatctgttactcttgatgctgaaaggagtcgtcctcatgtgcataagcgagctgaacatggcaaaccttaaatctgacccaactatagactatatactatgtcaaggaaagtggcctaacactatccatggagaaattcaatcattgcagatagtctgtctggacaaaatgctaatggttataataaatgcagataatttatctaatgttaactgctaatagttgacacttgacacatttggataaaaaccaatcattgcacttagggagcaagtatatgtgacaatgtagaaattttagtcagtaaaatttaaaaggtgcatgtagaaggagaaccaacaatgcagcacgttgaaaatatgcagttccaattgatgcaaatcagtatacagtgagatggatgatagaaagctaacgttctgagcagcctttgtatggctgtaccagctgatcaatctcagttgagtttaacagccttatattggtgggtgctaaaacacagtgagtggtgcttttttaaaaaaaaaaaaatctttctggtgaacactgggccccttaagtttttcttctactttaattggtgattaaatcaaagagtactaactagttatagcatgctactataggttgctaataactaaagctgttactgaaactgccaatcctgaatacaaagtaacagctaacaagtagtcttcacaaataaaggtggggctcactgacttagtggcttctagataaaggggatcaagtttcgctactcctctgtaccttaaaccataacatcaaatggtaagctagaaagtcacaatgtgcataaatgatcatcgatcagagtcatcaaacaacagatgagtacagattaaggaaatacatctaccagaacaaaagtgacttaaacttaatgaattagtaataaaacaagtaacagtgcaactgcattttgttcatgacatgaaaaaaaaaaccttgtatcgttctaatcaatagaaaaacagaattgtgcattgagctaatattgttacctaaggacactggaagtaagaatatagccaattgcagtggcaaaagccaaatgaattctaatagccacaacaggaataatgaaacggcaccaaagcattcctgtgacaactgcttttttcctgtttgtgtggcagcgatgtcttgggatctaaattaacaaattccaataaaatttgccaccgcgtgtggcacataaggcaatgaataaattaaagagagcttatatgccacataagttttcccattaaaagctccgtgaaattgcatcaatgactaacaaattaatgctttgctgataaacgctactattaaacacaaattcgtccactccacccagctaaataggccaacaacagaaagttaccaattttgccgcggtgattaggtaccggattagacagagcaagggagtttctcacctgaggaaagttattgaagaggcgagccgctctacttcggcgtcagggaagttcggctcgggctccccggctgtgagctccgagatggcgtgcaccgctctggagaagacctccggtgactcgtcaaatacgcagacctcgacgccatccttaacctcctctccttcagtctggggcagcgcccccgtcgcctccggcagcgccgccatcaccggcgaatcgagcgaagagagcggttgagccgtggaaaacgagaatggggggaatcggccctcgcaggtggggttgttcaatcgagccggcggcccgccatccccgaatattctgccggtttccaattgagatctctacgggcctgtagttatgggctgaaagcgtaacaatgcattaggcccatatagcttctgactttctgcaaggcaatgaacaaccaatcggctggtaagcttcctttatcttctttactagttgacggcaatgaaaccaaaaaaaaaaaaaaactaccatacggatgagtcgatgagactaattaacatgtgaatatgcagatttagagacctaggaggaagaggatggggagtacaccaaccttgggaatagttgtcgcggactcggggaggaggcgggacgcgacgggcggcggtcgagggcggtgcgggtctagggtttcggcagtggtacgagtagaggaaggcgcgatgagggaggagtcggcggcgtcgggtgacggggtgagtgcgagcgagaggagggcggcggtgtccaacggtcgacggtgacgatgtgggggccggcgtggctatgtgggggagtccggaggatggattgggggggggcgacgagatgcgacgacgggcgggatgggacgacggcaggggggcggtgggttgggacgacgggagcggcagtcgagggcggcgctggtctagggttttgtcggcggcggcgggtgactctccggattggggggcgtcgaggcgtcaggtttttgttttcgttctggaggaggcggaggagcgtgcgccgtttttccgtcgctctcaacgtgtcgagagtcttttaccctattatctggggggcttttaggctgtgttcagatcctaagtttggatccaaacttcagttcttttctatcacatcaatctgtcatacacacataactttttagtcatatcatctctaatttcaaccaaaatccaaactttggattcaactaaacacagcctagcaaataactatttgccacttttagatttagcaaataactatttgccacccctatctcaaaaactatgtgtcacaaaaacttttttgagttagctgtatgccatgagcccaacttttgttgacccgtgtgccattttggatggatggagacataacagaggtgttaggggctgtgtaaagacagttttgccctagtgtacaataatgggtttaaacataataaagatatgcattgaaacattatgtaaattatgtttgatgataatttaatatgtttgtatttgaaaagctaagtatattggatatcataaaacataataaagatatacattgaaacgattatattggatgataatttagcatgtttgtatttgaaaagctcttaaattataaaaactataaagatatagcatgtttgcatgatgtttaaatgcgatagttgttagtggatgatgaatgtggcatattgttaattagtggatgatgatgtggcatcttgttagtggatgatgatgtggtatctttgcatgttaagcttaagcagttagtgggggataactttatagtaagataggattatgctttcagcccataacttcaggcccgtagagatctcaattggaaactggcagaatatccgaggatggagggccaccggctcaattgaacaaccccacctgcgaggtctgggaatacagatgccggttgcctcctcttctgcaactctggtgacagaatcgctcccccgaagcgaactatttctccgtttctttcctaaactctagctatgcatctcgccgtcgtctcccgctccgcacgcaagcagcgggcggctgctgctccgcgcctccgtcgtgtggggctcgcgagagcctggaccatggcggaggcctccgccgacgttgctcgccaccggatttggcgtggtctacttcttcggttattggttggctacttggcttcacgtctcttccaccccaaacaagagcttaattgggccgatctcaagccctagaaggaacttgcacttctcgaccaaaaaacccaaacaaggcctaattgggtcaattccccctatattctcgtttcgcacggctcaaccgctcatcaagccctagatagtgctctctctctctcttcgctcgattcgccggtgatggcggtgccgccggaggcgacgagggcgccgccccagactgaaggacggcgtcgaggtctgcgtatttgacgaatcaccagaggtcttctccagagcggtgcacgccatctcggagctcacagccggggagcccgagccgaacttccctaacgccgaagtcgagcggctcgcctcttcattaactttcctcgggtgagaaactccctccttgctctgtctaatccggtacctaatcaccgcggcaaaattggtaactttctgttgttggcctatttagctgggtggagtggacgaatttgtgtttaatagtatcgtttatcagcaaagcattaatttgttagtcattgatgcaatttcagggagcttttaatgggaaaacttatgtggcatataagctctctttaatttattcattgccttatgtgccacacgcggtggcaaattttattggaatttgttaatttagatcccaagacatcgctgctacacaaacaggaaaaaagcagttgtcacatgaatgctttggtgccgtttcattattcctgttgtggctattagaattcatttggcttttgccactgcaattgaccatattcttacttccagtatccttaggtaacaatattagctcaatgcacaattttgtttttctattaattagaacgatacatggtttttttttcatgtcgtaaacaaaatgcaactgcatttttagttgttttactactaattcactaagtttaagtcacttttgttctggtagttatatttccttaatctgtactcatctgttgtttgatgactctgatcgatgatcatttttgcacattgtgactttctagcttaccatttgatgttatggtttacggtacagaggagtagcgaaacttgatctcctttatatagaagccactaagtcagtgagccccacctttatttgtgaagactacttgttagctgttactactctgtattcaggattgacagattcagtaacaactttagttattagcaacctatagtagcatgctataactagtattattaaccttgctagcttttatagagcaattacacatactgttgtctctagaaatacagtgttattcttggatgatttatggaatggatgattcagaagtcagaagctaaaaaaataccctcatttatgcaatcatgcattcaacataaataaatcagtaaaggctatgtgcgcaaaacctctagaagattctttcaagtacgcctttataacagctgaagcatacagtgaatttcagttgttacaaatggaaatctagttagttctgcatatgccaatggggaattggggattctaggagctacatttggggagcataaagatacacagctcaaaagttctgtaaggctaattttgttagttctcctcaagaccatttaaattgttatggaaaacaaactaaccaagtgtgtcatgaaaatcaaagttttcatatggctactcttttatgatagattgaacaccaaagatatgcttgacaaaaagaattgtgcttcaaaagatgctaacatctcttatgttctgcgctcaactagtataagggagaccttgatacatcttttttcatgtgcccttttagttgaagggacaagaactggattcagatggaatattaatttaaatttgtttcaaatgattgttctaccaagaatcggcttgaaaagaaaaggtttcctaaagattatgtgcattgcatgttggcacatttggaagcagaggaatgaatttaccataatatcaacccatcggtggatcaatggtttcaaaacttcaaagcatatgtgtaggatgaatgagcctttaagatctatagtctttgattagttacataacttgttaaaattccgttttgtaattgtaactagactctatatctatttcttatactagcaaaagggcacgtgcattgcaacaggaaactataattacaataaaagttagataattcatgttaatctttgtgattcgatccctttaagagaaatattgttattatggatcttaacttgtaaaatagtaacgagaaattgtaacataacctttagatcatttaggaaaaaaactcccgcactattgaaatgaataacatggcataacttctattgtccctatgtttttactcgctccatgttgttattgtgcatttgattcgtctaatgtgaccttgccttgtcatgtgatcaagaagttaagaaagtgagagtggttggctgacggccaagtgtggtgatggcagcaaggatagagggggcgaggcagtggcacgcctaactctaaccaacgagagcaagagaagagcagagccaaaattagacactaacatggttagcaaactggatcatgtgtgtcgtgtgttgtaatttggttttggaaacaaaaaagattgtaattagaccataatatagacattgtgaaggaacacgatcttgatggaacactcgaacccaatcaacttaaatatataataaaaattattgtagcctacctatctcaaatgttgacaagtataaggctgtagccaatcaatgtatgcaccaaagttgaaaggaaagagccattgccaaactatataaattactatgaaatttacactcactatattacagtctccagctaatcagaatcaatcaattgggaatactgtcaggccaacgccaagcagttataatttatataggaatatagagtgcaatccattcttttgtacattgaatgtaatcaaattacattcaaattttaattttactgtgcataaattcacatgttaatgctgtatttctggttaatgctctaaattccttagagcacccgcaatggtaaagtaaggtgctctctataaaacatgtacatctcagcaatagattagattaatagtaaatcacctcaatagtatgtctacatggatatctatagctctctcatccattgcctcgtttttctctatagactatctctaagttagtagatagttttactctctctcttcatttaatctcttccaagtaggaaaatatgatgacatggatctcttgtagagagcatatagataaccattacgggtgctcttagtatgtagagcccccacgacctgttggcagcttgcgaatagactcactaaaaatgccaattttttttttaattctatgcagacactgatgagttagatccaacgtcccagacatctcccggccgcaccccccccccccccaccacgcatcgcctccaccacccccatcacgccgctgtcgccgtcgccatcccgctgctcgtctccgttgccgtccccgcccctccgcccccgatctacgcctgggcacccgcctccgcgcccctagatcaccgtcggcctgagtcgccgggctcgtcgtcgccaagccgatcccctccgcagggaggtgcagaaaccctcctcccctactggtcttttccttttccagtttgattcttgcaagttctagagactgatacaatcatgtaatttggaattcaaagttatgtgcacttagaaataataattttgctcatactcaccaaatccctttgattcactggacactcaagtgcaatattgaatccatcaacataacggaatcaaatactggagaggattggaacagattacccccatcaagttggtgaaataaaggagcaattaggacgaccactaaatccgctaatggaacacataatgaacagaaattccttagagcttggagtaatattagcactacagtcactatctttgaaaacgatcaggggagcattcattaccttggcccatgctaacatcagttactcctccactttgactggaacacctcaacacatgtgtcatcattagtttgaacctgtgaacgatgagtttgctattcacttcagggaagtaagctttagtggaaaccttggagcttatgatatcaatctaaaagaccattgagctaaatatatgcaaatctggagttgatttggcaaccacaaaaccaactgatataaatccttgagtccatgtatgaagaaaccacacttcatttttggtgaagccacaaataaaccctaaaaatgatcaaagacatacaatactgtggtattagtacaatgccaatttacaaaaattgaacgaatcatgcatcacaagcactgtttacagaattttggctctgttcatagagaacagatcttcaaagcaaaattcatcctctatttccaattattatttttttgggctttgattcactcatagtagagaaataagagacgcaatagcactgcctgggcattatttgagaagaatgagaaacctatatgtaaattgtccatcctttttctgtacttatagtagcaaatcaatagctcaactaataatgtcattgaccaatggcaaaaaaaaaagatcctataagactgatgtttgaataacccaattaatcaatttttcacctataattttgtaattccatcatagcacaaatgagagagctatgaggtctaacaagaaagaaacataaaccacatcgtttcctttctttttagagcagcacaaatgagaaagagctatgaggtctaacatgagccttctattcaagtattccttgttggaatatgttggtctgaattaaactccatgcactacatttattctacaggaattagtatgctgatagtttacatcaatctcgctgcatgtgcactacaagagaattatgctattgccacaaaaatattgcaacaaacttttattcgtggccagtgcattattctattgccatgtccggtcgccttgtggcaagtagtaaattatattacaacaatttagtattgttgttatactttagttttttttcatggcaattagtgtattttctctagccacaatatattactgttccagtaattttggactctttacaacataccaaaattgttgccacgacttggttaaattgttggaatagtactttttagtaaaacaaatattttttaagtgatgtaaaattttgacgtaactgatatggtctcaattattgtaccccttggagggactgaaatttttttatggcgcctaagcacaggacggtgggagttgtttcagataaatcaacgatcattaatctaactagaatgcctcgtttggtcaatttatttgtttcctttagtgtgtgcatggatttagaaataaaattcaaatgccagtgacaatagttagtctgagcgggagcaatgacctcgccaggccgcatgcacgcaccaccacttgctggaatccttgcctcggagccgtcgtctcgccgtggtgctaggtacatggctgacgctcgctctcgccgaccctgtgtgtgtgtgtgtgtgtgtgtgtgtggatgagtgtgtgtgtgtggagatcagtgggagaccacgcagatagcccagaatttgctctcaggttggggcaattggtattccatagttttcttcagattgtggatctcttcccctcttctgctcacccgatcccctcgtgccgcatgcgcacgaagcctttgcgtgattggcgacgcctctcctccctccttccatcctggatttttcccgtctgtctcctcaggcctttcaaccttcaaatgtgccaccgcatggattaggccataagcaattttcttagaaatgcacatgtcctgtaagaaaatggaatgcttttagttagaatggtgaccctttgtcaattttaagtcttcatgttccacttcaattagttggaatgaaaattccttgtcattcgaaggcttcaagtcccaatttcaatttatggttgtaaacttggagtattagtttatggtgtatcagcattcaacaaagttatgtgcagtttgaaaagagggcaatcggtccataatttgtcttgcatattatcttctcatttgctagttcaagatagcctactaaccactttgtaggaaggtcatcctttcactaattccattttcccttttacatgtgtcgaatttttattaggcttctctgcagctaatacaggaaaattactttagtttctactcagcattcttgtgtgataatggcgttagcagcaatctacagccttttcatcattaacaaatctggcggccttatatactacaaggtattgtttactgtactcctgtttctctttgttctttcaaagctggagtctgaacaccttgcacctctcatttatccaggactatggctcagcagggaggacggacaccaatgacagtctacgcttggcaagtctttggcattccatgcatgctatctcccagcagctgtcccctacacctggctgtgaaggcattgaccttctacaagcccacaactttgatctccattgcttccagtccctcacaggtcttttatcatcctcctctgttgtaaatttgcgtgaaaatctgacctggatgcttataactgcaaagtttttagtattattgggttggaagtcaattattacagtttgtcgttttttctataagtatgcatcctatctctaatctttcactaagttactctttagttgttctgttttctgaatgttgtggagatagtcgcatgaattataagcacataatcatgggcttctatcttgcggttgcaagcatagtctgagtgtgatttacaggctttgcatttgctgaaataatgtttttgtacttgtggcttggcagttgggtacttggggcctgttccttgaagtgggcagcattctcagttgtatgcgttgtgagcatgatcactctcactcgtagcttgcttgatggacaaaatatattaaactaacaaactaacaatagcacactcctataaatggaagtttggacgagttacattgatatatgtgttcaagccatgccaagacttcagttcacgggaagtataaataatgatgaaacaagtttggccaaactaattaaatttagtgcttgattctattgggtattgtgttttctagtttctagtcatttttcagcagcaagatcctagagttctgtccttccaaaattctcgaaaactttgatacaagggagttaatgtgtgagacaatagtattaatctgatacttcaataataagtgtggcttatggagccggattgcaatgtttattgaacttaagtgtgaatgtctgacagaagtgagatatttcttaatctatactaggtgcagatatatacagcaaaaaagacaatgaaagcattgggatatgctgtcctgctcagtatatctttttctatgcaaaacaatttaattggaatgttagagaacatactttcttgactatattgtgccttttgatctttaagtaggccctggtacatctctagagttagttatccagttatactttatttggtgactgaaaggaatgttgctaaattggttcaattgtaaacatagtgacccacttctgtttcatggggcaggtgtttttccgaattgttgattgttagaccaaaaaaaaattcactgtccttttgtggtttgcacttgcctgccgctgatctgtatgattttgcttctgtttcatcagggacaaagttttttgctgtatgcgaaactggtgctcaaaatatcgagactctactgaaagtcatatacgagctctacacggattttgttctgaaaaatccattctacgagatggagatgccaattcgttgtgagctttttgatctcaacctggctcaggtcattcagaaggaccgcgtcacacttctgggtcgatgaatcatttagaaaacatgacgcaccatgtctttgtatgtggcttatatgacatgtatggtgtcagtagggtacttggaattcaggcaagtcattacactgcatcacaaagtccatatacagtgtgcagtcgattccttctagttctgaaaattactttattcctgaagtatcatttgtgccattttggactttatatgtttccagtcgcaccaaccaattcaggaaggtgcatcacacccgtatttgcatttgcatctggcaatgaattcttattgaagagaacatatgaacaatgggcaatttgttttgcaccaatctctatactcaatataacatcctgaatactaccgaaactaattctttaactttaaaatcgcttgtgtgctgcaatattttttgtatgtgcgattaagggtcgtatggaaaataatgatcaatgacattacaaaagctaagaaaattaaaatgtaatattggagcactgtcttcctctaatattgggtatagaggtttaggcccctttgattcaaagaaaattcataagaattttagaggatttcattcctataggattttttcctatatagtcctttgaatcaaaggaatagatcttatagaatcctataaaattcctatggattggctaatgccatgcatgttttggaggaattctaacatgaggtaaaacctcttggaaactttcctttgagtctttatctctcctctaattcctgtgttttttctgcggtccaatcaaacgaccaatcctgttttttctgtattttgcaatcctctgttttacactttgaatcgtaggaatgagaaaacataggcattcctgcgattcggggccctaacaccattgaattagactccaaagagtgtaaacgacattcaaggggtggaactgttcttgggacatcacgtggaggccatgataccatgaagattgttgacagcatccaggatcgtggtataaatcaggtaaaggaaatgaatgcaattttattacttttcggacactgttttaagaatcaatttacggatagtatgaagattcttctacctaatcgaaacatcttacaatcagcgttgattacaagtttgtgcgttgtccaggtttatgtaattggtggtgatggcactcaaaaggggcgcaggagtgatttttgaagtaagcacgattatatatcatcttgatgtgttcaacctgatcaaattatagtttttactcccaagggttggtagtgtatttcattataaataaaatggactgaaagggtcaattaggtctagagttttttttagggggagggtcgaataggctaattaaaaaacttaagtaaacatggaagcagggattttcggaattttcgtaaatggttttcggaatttctgaaaataacagagcaggcgtgaatcaaagtagattctagatctaacagcctaccacaggaaaatgctagcacaaacaacaactagatttatagtggcacaatcaagcaaagctagaggagagggagaaagtgatatcaccaaagatgttacacacgaagttattcctggagttcgaattcttgagagaattctactctctgttgaggggctcacaaagagccggccttagctaaccctttcttcaagaggttgcacaaaacacttctctttcggaggtgagatctaacctgcacaagcttctcccagccaaccacatgtaaaatggtggctcaagagcgacacctagccgtttaggagtccttaacctctaagagtaaaaaatgatgcaacaaattcccggagatgatgtaagtgctcacaaatcttcacaaagacaacaagaaacacccacacaaactcgaatccacacctcacacacacacacaatctgaatcaaacccgagtggaaaggggaaacaagaaaacaaggctcaaatgaatctcaagtgaagcaaagccaagggcatgaaaatatccaatcagtccagcagccctctcaagaggagagagtgggctatttatagccatagctccagatctgcccgttagagtacaataattgcatttttcggaaaattaattttggaactttcaaaaatttccaaaacagcaaaacaggaagcgaacgatgattttcggaaattccgaaattttttttggacaaatccgaaaatatctagaaccaaaaacaccttcagtagacttttggaacttttgaaaattgctttcggataagtccgaaaatttccagaagcatgtttgacttgcagacattttcgaaaattccgaaaatgagtttcggatgaataggtgatttatttgatcatccatatataaaatcctcttcttcttcttttttttttccagaaatttacatttctcaagtaaatgaattagtgtgctcattgcaatctaggacttatcttctcctgccaacaaacactggttgcatgaagaaaacaaatggatgtacaggcgctgaagcatactgttaatgccaaattttggtaagcaccgaagtcgtcatcgatatagagttagtatcggcctctggaattggccgatggaaattatcggtcaccaacagtaggatttttagtggattcgattaaggaaattaatcaattagaagaagcttactcagaagaggtcgagttcaagaaggatgcgacataacaattcaagacagagtaagtttctttttttacttttaggaaaacttgtttagagtctgatcatgacttatatattttactttatctttaggaaagtatgtgtcatgtccaataaggactagtatctacccatgggtataaatatttatacgcaggttcattgtaatctatctctcgatcaatacaaatttcagcgcatcgccaccctctttcctaaggttttatcaccggcagaacttggcacctcgacgcggttctacattgctttgatctccggcaaaggggcaagccctaacttccgctggctctggcaattgtatctgctatattggcattgttcaaggctgcatcgtttcgatatcttggattgctcttgttcagttggtatatttgtctacctgatatttcaattctatctttaattgtattgtgtttagaaacacatcggtttagttgagattgtctcggttaggtccaatcttttatcttagtcgatatatctctacaatcacaatgctattttaaatggattagttatatccatcacgctgagcatagatctatcggcttacctacacccatgaaatcaatcaaagcctgccattttgcagtgggcatggctagcaaaggcctgaggctagcaaaaaacaaaatttattttttttgtgggttatactcatcggtgacgggctttaccttaaagtccgtttgagttatagtcatccgtgaagggcataagtttaggcccgattgagattagagtcatccgtgacgggcgatagtttaggcccgattgagattagagtcatccgtgacgggttatagtctacggccgattgaggttagagtcattcatgacattctttagtctaggcccgattgaaattagtagtcatcggtgatgggcgctagttggggcccaattgagataggtcatccgtgacgggctctagtttgactagtcgtctgggtcaaagctatcggtgacgggctttacttggggcccgattgagataacttcattcgtaatgctcgtatgcccgattgagataacttctcacatcagtgacttctatgctgtgacggatgccatacctgtcacagatggggttgctgcctgattgagatgtgggtgactgttgtagtgtatctaagtgtcaaaatctatatctaatatatagccgaattttcaaaacctattgacatcggctagcatcgctacattagcttgttggccgattagctctttgatcattagtttatctatcttgtttcatttgcaggatcaaactgactgccacgtctgaacctgataatttaggacctgcactggacctgcactcgtcgtaactggtagagaggaggcccaacaacgagtttttgacagggatgcagaggcggagataggggcaatggtggctgacgatgccggtgaaaatgtgggcaatggtgttggcggacgatggtggtgtggaggcctgaagccggtggcgcgtgtggccaacctctgcgatctcccgccacatttcatcgttcctcatcgtatgcatcagtaaggtcctgatatggagctcctgaaattttaagggtaaaggttagggttgagggttcacactatttccttcagtgaataaaatcaacactataccattgttagaatcttaatggctggctcccttctatgtgcattgtatgcctctccacaagaaaagtaagacgagaacaggaaagactgagctactgctaccgctgtcactatatcttgccgccatcgttgccgtcaagcaatcactcttccccctggtcctacaccctctgttggcaactttttgtgacaagtcgacaagcacgatcgcaacacctaaacgccttacggtgatatagagtcgccaaccacctcgatctagccaaagggccaaatcaagatgggttttgtagaaaaacagctaaaccggctagcagagccgatttagagatcaaaatcagcctctaggccgatttagatcgatatgaggataactacccatctcgtgggcaaaacggaaggttttcaggacaaacctacaaagaggtgtcgcactctcgcagcggcggcggacggtttatggcgcaaaccgacaaagatggactaaaactagggtaaaatagaaaacgtagtaaaataacgattcaaagtaaattgtattggggggttttacaatgaactggccttgtcccttaaataggggttggtcttgccctctacaggcccttctccacgccaaactcgggatagaaaccaaaggaaacacgaaacatgccttcccgagcaaggagacccgagacccgacgaaaacagactcggactcggaccctgccggtctgaccgcccacataccggcggtcagaccggccctactagctggtcagaccgcccacacacctgtggtctgaccggccatgtgaaggaaacccgtcactttccaaacattggcaattttctcctatttcgtccttaggtgccaaatttgggtgtaaacacatgcccccctgcctttttggtgaacatacgtgaacctaaaagcatagaacattttatctcagggcgataatccaattaccggccataggacttcctaagcatcttgccaaatgctcgaagtatttcttcaagtatttaccattaattgctctccgaaaacactgtcttgaagtgtcttcatctccttcaaagtcttcaaacgtttgtcgatgacgtcttcaaaattacttcccatcaaggtcttgtaatcttcaaccgacaagtcgtcttgtttgaaataccgaagagagccaagatttacctcaactggcaaaacggcaatttcaacaatgttttattactcgacttggcttatccattagcctgagcgtagtaaagagaggaactcaacaacttaatatcataagattcggcaaaacttatcacttctttggacataaaagaagctcctttaacgtttgaggaataccgaatctatgaacaatatgctttaaaataaagtcaattatctccgtacaagtaatattctcgagcggcacggcttcggcccacttagtgaagtaatccactgcaactagcatgaaccaatgcccttttgatgacgaagaataaatttgaccaatgaaatccaaagcccaacctcggaacggccatagtttaatgataggattcaacacagcggtaggcgctaattgaacattgccgatccgttaacaagcttcactccctctgtaacatttgaaacaatcatcaattattttcggccaatgaaaccccactctcctaagcaaccaatttatcttacgggctgattgatgaatttcacaaatcccttcatgtactactctcctagcaactttagattgatcattatctaagtaatactccatctatttttcggcgatataatatttgagcgcttgccgccgaatctttcgatcaaccttaagtgtaggatctttcaaatatctaatcaaaggaattctccaagctatttctaactcatgggcacaaatgtccgaattcacaattaattcagccttttaatcaattgtaacgtgccccctggctctctccccgagatcgatcagaccggcgacgcaatgcctacccggtcagaccgctggtaccaccggtcagaccggtcgtgcaatgccggttagaccgcccctggtctatgacttcgccaatttcgtccaaacttttgaaatcaagcatcggccttaagtatatatgttttcttcacataatagccagatgcttggtgtatcaaattatcggaccaaaattcctcctctctagacatattaaaaattataatatccaacaaatatgtctagatgaatactaattcaagtggcttttgaaacaataatcatcatgtcatcaaaacacttagccaattgaagtatgaacaataatgaatcaccaaaatcatatgtgtcacatgcatagattccaataaactacaaatataagtaatcggcttgagcatgtatgtaaaatattaacaatgccaatgttcctaaagaaaaccactctagagcaaatcatcacattgaccattgacattagccgaattactagtaagcaaaactttcatgttgcaataaatatgaaatctatatcttatatggtgatccataaaaacacatatgatttggctttaaataaatatcaaagagtcatgagccaaatcatacttcaaacaaattatatgccaacctaccaattcctctacttagaactggcatttgcaacatgtatgtataatatcaatttgataagcaaaaacacacatgtgctagatagcaagcaatgttctaacatggcataggcatataacggtaaacacaataaactcataccttgccttagcatccaacaaacgacagctcaaagatgtgatgtcgtatccatcgccgttcatctctcttgatttcctcataagcatattgatgtcttgccccccaagcaaaatcggctttcttggttgcgcgatttcgaaggcaagatgaataccgcactaacacccatagcatcatgtgaaggagacttatctctaatgaccgatgattcttctctcatcaaattgaatccatcactactccgtgaaatcaccgatcttttaacttctacttcttaaggtctccacactcgcttaggtgtcgttcgaggctctaaattctcacatgttttgttctccatatcttcggtctctttttctttttgacctatggcccgaagacgctgtagcctcctcttttgagagcgagataagccagaaggtatccacttcggctgtggttgttttccaagagctaagcaatgactcttgatatttttggtcgaagtagaagctcccgtattgctctcaattttcccattcttctccaatgcccctcggtcagaccggccacaagccgtcggtcagaccagccaatagggtcggtcagaccggccacaggttggcgatcagaccggctagatgcctcgatcaaacctccacttttgacaatcacggtgtcggcttcgatctcctttgcttgtatggtttccaccgcatctccagtaggtacttgagcatcttgagactcctctttgacatcaacgacctctggagctttggcttctttcctcacccacaccttcttcacctttttcactttttccacctttgatccaccggaccgattcttttgtgggaaacggtcttgtcttggattagatgaatgacttggtactgacttaggtgattccttccatccttgataatacggcataggtggttgaggcatccatggcatataatacataaaaggataaccatatagtgacattgaatatggataccatggcatcacaactggaggtttgtatggagttggtatagttgatggctccgattggtttgatgtttgaccaaatctcttcctacgagataatcttggtctttttgaatcactagtttgattatcaaatcgttgaccggctaatcctttcttgtacttagccataaacatctcaaaagtgagcttcggctttttggtcatttggaaactagatgactcatcctttgcaactttatgatcttcggccttcgcatttttgatcctattcttgggccgaggatccccaataataacacttttccctttctttttgtcaacatcaataggactaatagggagaggattactaaaaatttcggtctatggcatagatgtaaccgaaattgtttcacaagtgaccgatgaagtatcaaccggtctttgctccatcaagcttgcatctttgaaataaccatgaaactcatgttccatttgtgaccatgtagaaattgaattaggagcaagcgaactaaaccatgtagatgaaaagtttgacaaagaaagaggaagcaattttaacttaagcaaatcatcattaccggccttaccacattgatcgatgaattggccgatatgctcctttgttgttctagtatcctcacttgtgaattttgtgaaattgggcacttcaaatccttgcgggtatgggaccgaatctacgtgttcaggatacggcctttgatatgtatgcattgctactttggattctatttcactactatcccgcaagacattatcatcatcttttccaacatccacatgaccgatttgtgattcggttttaggtgacaacactatttcactttcgcttgtgatacaatccgaaccgtcacttagttcagctatattttcaatgatgctattctctaagctagcaacacaatccgaatcatcacttgtttcggctattccatatttgtctaaactagtaacacaatccgaaccatcgcttggtttggctataatggttgttgcattattatccaagctagcaagacaatttgaaccaacatttggttcggctataattgttatggcatcattgcacaaattattaacacaatccgaaccattgcttggttcggctatacatgatattgcactttcatctatactagcacgtaagctattgtcatccactcggctttcctgagccagagcttcatgcaacacatgatcaacatcaagaaatatctggccattcaatttctctttaatagaatcaagcaatccatcatatgcaatgtcggccaaatctttgtcagttattttcaaactaaaacatcggtttttaacatccctaaatctcttgatataatcagcaacagattcattgtatttatgcctaaccgatgttaaatcagacaacctaagctcagtttcattagtgtgaaaataatcatgaattttttgttctaattgagcccaagtagaaatagaatttaccggtaaagaagtaaaccatgtaaaagcagtaccggacaaagataaagaaaacaagcgcaatttacatgtatcccaattagcctcaccacattgcgctaaaaattgatctacatgctcccatgtggtcctactatcctcaccactaaacttggtaaattcaggaattttataaccacgaggatatgggataatgtcataataatcaggatacgccttttggtactccctagcaagattccttagctttgcgaaattctccctgatagtatttctaaaccaatcctccacagttttaggccttggtggatctggtggtggacttggtggcctagaaggtggttgttgcggcacaatattgttatattggccatacctagtatcgggaggatatcccctattaatatcattgtaggcattagggatatgtggaatagcatgactagcagtattaacaggtgatgaataataattaaaatcagtactgctagtcgtggtatgaaaacctagagaaattcccagggaaccggtctgaccggctatagatagcccggtctgaccggtagtcagtggtgcggtcagaccggccacaggaggcgcgatctggccaggatagagcacggtctgaccggctatggtaggcacggtctgaccggcgtagcacacggtctgaccggccatggtgggcacggtctgaccggcataggatgcggttagaccggtgccatgaccagtcataccgttagctagattttgcatatagccgattcctgtgtaattggccatataaacacccattgacccccatagcattataagcatattgtatagaagcaaaactagaagtagcatatgcatctacacaacgatcattaaccttttgaatagcaaagtatgggttgggcgaatcggaggttaccttttggtgaaactacaacttgaggtagcggggcgtttcctctcacgacgccgtggtcggtcctaatgtattgtgtaatagtattgttgaacccgttcccgcttatcatagttgatgaagaaaatccttgattaatttcggccatatagctcatagccaaaatatttgaccgaataaattaatatacggtcttaaaattttccttgtatgctactgtactcggcaaaagtatttgatttatttggtgtactcggcaaaagtatttgatttatttggtaatcaaccgagtagacttagcaaaatttggaaactaatctaaagcttcacagtgtaaccgatacaaattgaatcggtttttgtctttctttttttaatgtgaatagtaatagatcggcttgaatagcctgatcttttctaacccgtgtacagtaagctttggtcaatcaaatctttctgttgccgtgtggaacaaaaaggaaacaatgttgctaatccggctgctgctccctgtgtgaacacagtttaacgtctagccgtgatcgaacagaacaattaagcttaagcttgaagacaaaaccaatgtcggcgacaataataattacagtgtaggttaattccggctgtttagccgaaactaattcgatgattcgacgaaacagtaattattagattaaacgaaatttggccgtagtatggccgattagatcgttccccagcgaagtcaccaaaaatcgtgttggcaactttttgtgacaagtcgacaagcatgatcacaacacctaaacgtcttgcggtgatatagagtcgccaaccacctcgatctagccaaagggccaaatcaagatgggttttgtagaaaaatagctaaaccggctagcagagccaatttagagatcaaaatcagcctctagttcgatttagatcgatatgaggataactacccgtctcgtgggcaaaacggaaggttttcaggacaaacctataaagaggtgtcgcactctcgcagcggcggcggacggtttacggcgcaaaccgacaaatatggactaaaactagggtaaaatagaaaatgtagtaaaagaacgattcaagtaaattgtattcgggggttttacaatgaaccggccttgtcccttaaataggggttggtcttgccctctacaggcccttctccacgcccaacttgggatagaaaccaaaggaaacacgaaacatgccttctcgagcaaggaaacccgagacctgacgaaacaaactcggactcggaccctgccggtctgactgcccacatacctgcggtcagaccggccctactaaccggtcagaccgcccacacagctgtggtctgaccggccctataaaaaaaacccgtcactttccaaactttggcaattttcccctatttcgtccataggtgccaaatttgggtgtaaacaccctcctcttaacaaatccgacggcccctgagccagatccggtatcgaggtggagagggagaggaaaagagcggagaatgagagagggccgctggtggggtggagagggagagaagacgataatggcggagatacccgtgcgtcgccctctagggaccggatccaccaacgaggacacccatggtcgaaggtggttctgggtgaccggatgcaccggtgaggagaccgactccgaccgcccccgagctagatctagcataatggagtggagatggcgagaagggagaagggggcggcaacggcttgcaaccgtcccatttccctaggtggccggattcgttggcaaggagggcgacacacggtggtgtgacaaaacagggacgcggcggcggcgaggagggggggagggtagtcaacgacggcggtggctaggggaggacggtcgatgatggcaataggggagggcagatggcggtggcagcagccttaggacggcggcggcgcggggcacagtcaggtggggtagatgtggttttgttttggaaaagcccctttatttttttatatttacaatgctacccctagaattcttcgtgttgtatttctctgaaatacgaggtatattcatgatattgtgatattccgtgtaaacacgataggttttttgcaaaacagccaaccacgtgttaatctctccgaggaggaaaaaaaaaagggaaaacagagaaccggtatgggtgggactattatgaactaagtatgccttcctattccagtactccttcggtagcagtccagcaaaggcttaagggcaaagggagtaatgaaagcgggaatgttgtttcgcatataggacaaaccagatttcgagttacttgtccacaccaactgatcaggcattggaaaattgtccaatatttgtttgagcgaatcatcaagattgacagttccctcacaacacctattcctcgtcttgaagatactcgtaaggcccagtctgaaaaagattgatccaagaaaatgccatacaagttttttttttcaggaaacatattttttaaagtttgtagcaaataatgtgacaataataatccgatgaagtagctaaaaagaaaataaaaagagccaaaattctggtttctatgctacgtgccctcggttatctttctcaaactcaaagtaggcagaccaaggtgacagaaaaacaagacagggcttgggtatcagagtatgccacagtggacaccataaggcatgctgcaagggagacaccagtatgagtcatcagatggccataggttgtttgaatttgatgtcgcttagcttgacttcgaaaccagggtagtaaaataaatgttcccagcatatcagatggctgatgcaaaagaaaaagggtgttcagacttcagagtgcaactattcagataacaagtactggcagttaaaacatagctataacaaaattgcgcagaccttcttcctcatatgaccacatatgctgctaaaattacatattaagattacaacaggtactcttccaccatggtttcctggcacaggagtataacttttaagttgcatgtgttaagaaccgtctcccgtgatgatgcttgtcgtcatttcttcaatgggaactcaggaatattctgacgaggtgatcttgattcacgacgagatctacaaggaaacaggaactgaatcatggactgggctaaagaaggacgtcagcccacgataggagtgccatctcagttttgctggtgacctggaaaagagattagaagaacgagagagcaagagtgacctagctcctcgcgcgctacaagatgcaacattaattttcactggcatgcagccaatacagcaggaggatgagtgaatggtgcagttatggtctgattaaaaaattgaattcgtgaatatagacaagctaaagcccaactattgtataaaccatcttaaagccaaatattttcctgacatggtcatttttggagctaatagcttactacactattagacttgctctaagctgagcatttttcctggagcatatttatatcacacgacagatatgcagtgatggcaaatactgatggtaggcaacaccaccagactaagcgagtcataaaataagctcatggcagcaataacttgactaggtaagccggggactacctaattgtgatttctaatgaatacctttccatgtttctaacaaaatatgtcaatgggaagaaaaggtatttacagtaattaaacataattctgctcgctggactgctacccaatctacagagagaaataattacttccagaggttcacagaaattagacattcactattgtctctagagcagttactatcgaatttcagtaccacagtcaaaacttcattaaggaaatgaaaattaagatagctcaaacccaccttaataactctaggcagggccaataaggttttttatttctgcaaggcagtcatcgagagctttatactcaggggtatgtaagaagtctgaagcctagacaagaaaagttccaacaatgagcaatctggaggaattgaacattaaaaacaaacagacttaaatggtttagaaatggtatattttttctttttataatgttgtttccgagccatttgttgcaggtaatcttagcatcccacaataaccccttgttctagtcaatgatcctaaagtcatgtccaacctactaatttcataccagggaagaggaacagtgcaaaaaaaaaaagatacctgttttaaggagcttttaaggtgcatctcagctgaaaataactctctttggcttccagtcgaagaagaaatttccatatagatcttgcaaagctgcagggaagcttgagcatacttagtgaacttcgtctggtcatgccatagtccagaaccctgcgagtacaataataaattaataatatgacaggacaaggtaccacaagattaaatatacatcaaatataaaacagccagcattaaatgatttcctgagatgaaaatgaagcagaaatctgcattctacatccgcagacttgctgctaggggtcaacatggtaaaattggatagtgatcctctgcattagagtataaaattgtgtgttacacatttttttttctacaaggaatgttcacctcaattcaatttatatgtggccatccatttagatttgtttgttttttaatattaagaagttcaagggataatttgcaatggaagtaggtggggtggcagattcagggccaccaccgctaccttataaaggagtatagaaaatggagaaatgctacagtaaattgcattaagagaaatctgcaccatccactcacaatcctatgccaatggtcaacatccacagctcgaatgtgatagtactagctgactgataaatactgatgctacagtacctaactgatctgagccgtttgtttttaatgctcaagtgctaatgcaaaacactgtagcaccttgcattagcagttcaaaatgcagaggatccggatccggtaaaattaccatcctgacttttgcaaaaagaaagtagcaaaagaaagccagtgtccattcaagcatgtcatgcatgaactcaacagaccgcaagatcactgcgacaatacaacactagcatgctatgctcaagcagattttctagtagagcaacagttaagccacctgccataactatcatccaagcaaggtatgtcagggactcggggccatgaggaggtgaaacacagaaataggagaaatcagtgaaacttttaatggtaggcagacaaacaatatgctatgctcaagcagtagcatgtgatggtcgtggctgttggctccttgctcaagtaccttttgataagccagcaagagatagccaatgccaaagtgcatgaagattttaaaaagatgataacacgtgggcatacaattttcttaatttgtttgttcattcatcatatcttttgctcaatgcttgcatataaaaaaatgtacgatagatagtgatcccggtcaatcagaaggagcatggtttggtcaaggggtccattagagtattgggtgtacgatggatagttccgatcagacaactacaaaaatttaaggggtccaaatggacctttctttttttctttttctggcaaatggtttctacccaaaactccaagcatcataaaacttatgctctctactagatacactggaatccaattttcccagtggacaggtccaaattctacttccaatcgagatctggaatgttgtctcaataactcaggacagatttgtgaaaatttgatacgcgatctccattacacacaaaaaaaaaaactctgtccaacaaagaatgcaatcctagcatttgaaggacaaattagtaggaaagtgaaatggcctaaatgtccctaattaaataaagggtgcttaggagtgggactgtgggagggagattaggggtaagatggggagaaatttgaatgagagatgattgatgggacatgtagtactctagaattgtactttttgtgggacaaaatttgaaagatatgattgcattttttgttggacggaggtagtagcagatagggcaccccgtcttacaatgagccaacacactgttttgttggtacttggtactagaaggctccccaatataggcaagaggaaaaggcattatcactgtcagcataagcatagcatacgcacctggagagaccgaacttgcttcaacatagcttcagagcatgcgataaggttacccttcgtcttatgccacctcgcatataaaccccatatctccgaattgctacccccacttcgtacaatctacaaacaataccaatcagacttataatatcaaagagatgttggaattaagatgaaatgcaactcatagagcttacaaacctgctgaaggatatcaccaattatatctaacaactggttgtacttcctggtctcttgatttgcatcatctgaggtgcttctggaagattcagcttcttgagtatcagagagatgtgtaggttgttcttcaagcatggccatcaccttttccaacaaatcaatgttgaaacgtttgttcgaggataggtttagtaccattttgacagcctctagtgtctgcacagggtacctcatattatctcaataatcatgataaacaaattaaaaaaatcatactagctcgcatataggtctgagatattcaaatgagataaaaatcctcatcgagctaaatgctcaggaaaaacacatgtaactaaacttgtttgaagggtttatagtacgatccaaattacacgtggctgcatctcacaacatcttaggcatcatattacttgccaacatggcatcacaatgttttggcctcttttctctatccttatggctttcccgtgcctcggatctggacaagacaaggcgagaaagtggtgttctgcagtagagacctaaattaggttggttgactgttgtggattccttgtccttttggtttatgatttatgttggccatttcggcatccaaagtaaattgctctccactgggtggtgaccaccttggaggaccaagggcaggtgtcagatcgcttgtaggatagaaccatatgtagtttggacttagaaagtgcaattgtagagctttggcgcctacatgatttcttgcaacaaattgaacaaccaatgggttttttttcttcatggtatggtaaagtatggaaaactatctttaaaaagatgattatcaacatttcgtaatgaatgagaccaaaaaaaagacaaatgaagaaatagaccattgttaacaaggagattgcgtgaaagcaataaaagtgggtataaaattaggagatgagctctcgaatatataagaaacttatgcatgtgatgagtctcaaataaacatcacctaaaaatttaaatgcaagcttcaagaaagaaatataaactgagtctttgacatcaatacacagctcacctgttgaatacttcctgtgtccaaaagaaccttactgtaattatcccaaacctcccaactattcctcctaaaaacaattgacttatttttaatcagaaactttacagaattaaagtaataaattttgtacaatatgatgttatacgcacttgaactttacagcttctttgaatgcttggactgctgcttggctccttcctctaatcatgtgcctggatagtaaactacattagagatatattccaagagtgaacctataacac

SEQ ID NO: 67147 - DNA, 25294 bp, Oryza sativa
ccattccccataccagcattcctgagtggcaaataaaattgataaggaaatagggaagacgatgacagtagcaccacggttaaaaaatttcactacttaccactttctccacatatcaggagctttacgcacagttccatcaccactacaaggcacatcacacaatacacgatcaaattccaacctctgcagtttggactcatccgtgcatgtttctgaactaaactttgcaagattacagccaggaaagttctgtgcttcatgattcgtcacaatcaagttggctgtgcacattctctttgtctgatgaataagaagattgcatctttgcacatcaacatcattagctaccacctgagtacaaagtatgaaacacaaaatcagaaaaaaggttttgattcaaagtttttttttctatcgttaccagaaactatagatatgtgtaatagaatgtgaaacatacaagggcatttggaagcattccaggctttgtagactgatggatcatctcaagtaactggaaggtctttgatcctggagcagcgcacactgcataggataataccacaaaaattcacaagaccaatattggagaagtcctcctctaaaaataaaattttcaaatagtccatgtgtaacctacttttaagctcaaatgcctcaaaagctaagtctgatataaagctaaagccaaacagaaaaggctaggtctaaatgataactacggggtattctggtgttctcatttttttcctttttactggtactaataaattaacatgttcctgagacttataaacttttattaggaactattgcgccagatgctttattgagcaattagttttaaacattacaagctggactacagaagagcaaagttaggtcaaacatgcaggtcaagagacagacagccagctgcataaatagcacaatatgaggaatgatggaaaagaacgtggatatacatactgtcaagaatatgatgatcaggttgcacattcagaaacaaaggaggaacctgtaaaaatattacatatcattttaacaagaagaatatccgcaatatacatagaccatcatcaataaacaatatactcatatagctcatcttaatatatataaggaacttaccatgctgacagcctcttgcctagttatattgccaacttcattctctcgcttcaagaattcatgaaaactggagagggaaacaaatattacaaaaaagtattatgtctcaatagaatattaaatgagcgcctccaatgtttcaatggcagcaattgttaagtgcaatttttttcagtttctttttcaaaagaaactagccctaaaaaatcttatgaaaaactgctaacagtgatataacactaaatctgcaacaaaaagccaaacacaaatatttgagaagttttggtgaacttttggtgatggtttagtagagaattcaaggcaatcactgatctataaagccataaattggttagtaattcatcatttaaggggcaaccatgttctcaataaattcatcaatttacacaaactagtaatgtgcccgtgctaacgctatggtgatatttagtaatgatggtatatacatgagatgacaaaaaccaggtgaagggagttttattgtaacaaaaacatcagtttaccacactcctaaaaaacaatcatcctatatactgcgcattgttgacacaattctcccaagataaacattatgcatacccctcaagtgcctggtttctcctcagctgcattcgagaaaaattcaaatgccatgcaagattgccagggtaccaaggcaaaggccgaatagcatcttcttcatgctcatcactaacctgtccatgcaaaaaaaaaaaaaaggattacaaaatagaattgtgaaggacataactaaaatttatgcacaaaatatagaagctacctcagtttccaatgacttcctgaagtcattttctaactgtgagcaaatatcttgataaaattgacagctggaaaggtaaggacaacattagcatactagaacagaataatcatcataaaacaagaattagttatgtgcaatgataccagacatgataaggtatcagtaaaatcaccagtgcatttcatgcaaatgcttttgttctaactatatgatcaattgcacatagaactggagatggttatatctgaagaatgaaccatggcagggaaaaaacaggagaatcaggatagagataatgtccttttcttttacaaaaggacagtgaaagttatatggagtcaagtaaaagattattcaaacagagcatggtttttatcaattcaaacaataggcagatatctagaacctatatatgattagagtttaaataacagcaatagagagttagcaagataagattaaaagttttgattgtatagaaaacagtataaaatctatatctatatctttttataagctaggataatcccccagattcatttttgttggaacaaagttttgagagcttatagatatttcacccagaacatatacaacaccaccaaggaatttttgccttcttggtgatttcgagcaatatcgcaagctgtttggtcatgaaaagctacattacacaatcatcagaactcaaggaatgattttctttaaaatgtgatgctgctatattgcaataatcaaggtagtgtcataaacaagctaactgcactgccattcaatacaatgtgaccaacaaacaataaatcattaggccaaacatgtggatggagtcatgttgcttcagatgaaaacaacattacctcgcattaatcctgaaagtggctggcagcggtttccggagcatgttcatgaagtcgtcccactctccctccggaataatttgctgtgcctataagccataaacatgtataaacattctaattcagaagttatgcatccaactgaaaaactaagctaataagcaacaacagtataagctaatgcagtgcgtccagttaggcttctcttatcgtaaggtaagtctagagatcagtactcgctactcagcatcacaatcaaaatagagcagttgcttcttgcttgaaagctataatatccgcaatcaacaagacaacaaatcatcacattctaaacgaagtacacatacctagagcgagaccatacgatcaaaaccgagatgccgctagctcagctcaatttttttactaacacaaccaaatcacacccaaaaaaagtaaaatattaagcaaccgcaccttgtagtagtcctcgaaggctgggttctcggtggcgaagggctgccacgaggggttcccttcgcgcccctcggcagcgcctccttcggctccttcgccgccagccgccggggggcgctgcgggttgtgcttccagacgttctcccgcccctgcttgaagtggcggcgctgcgtgcgcccgcgcttcctgccgcctcccatggcttcctccctctctcgcgcgagctgctcctgcttccgccgctgctgctctccctcccggtgacggcgcggatgcgggcggcggtggcgcgaggggaggagggggttctcttcgaggggtttaggagcggcggcgagtgatgcggggtggggaggaggaggaaaggcggctgggcgaggaggaggaggtcgtcgaggtgaattagttgggccgggctccgtgtgggctggagacgcgcggtagagtagttatgggcccactatttcacgccataaacctgatgtgctagttgtcttctacgcccaataagatgttgggccttgtttcccttcagttccataaataagttcatttatagatccttaacttgaaaacaagtttgatttcgttcctgcaccgaaataccggatacaatgggtccctgtccctcaactgttgaaaccggtgcaatatgtgtctcatggtagtatagcaggtggttttgtccaatgtgacaatttaacccgaatcaacagtgctaactcagcttgggacttggtgaagaagggcttttggtggggtgttggcaatgggagttcaattaatatcctcactgacaattggatcccggcgttgttgcgggacatctgaaaactctaatcccaattcctgaagataccaaggtgcagtcctgatgaatgatgaagcaaatgcctaggatagtgatactgtcaaggcactgtttgaggaaggggttaattgccaatgagatacttcaaatccctatcaatcgttttggtgacgaggacttcacgtcctggccacacgacaaacatggcacctacacagtgcgctcggcttataacttggcacggtctaacactttccttgcttcacagtgtaacaatgggagaggacttccttcttctctactggagagtcagaaaagctggaaagctctgtggaagatcaatgcacctgggaagatgaagataaacctctggcgtgcagtccaagattgtttgcccactggcttccagctgagaaggcgtcacattgattctaatgacggctacgttttctgtaatagggatgatacgttggaacatgtctttctttcatgcccctttgctagctctgtttggcaggaaattaaacagatatatgatatcaaattgaagagaagggggatcatgcacttgagaaattggatttttgacttcctggaacagaattcaagctttcaacacactgtccttatagtaactttttggcatatcagggaagcaaggaacaatgcaagaaatgggattagcgccctgcatcctcggcgcgtggctcagaaggtgtttggttatgtcgatatgataatgcaacattgctccaaatctcccctcctccattccaaggtggattccaccgccggaaggaacagtaatgatcaataccgatgctgcagttttccaatctactcgtcaagtgggaatcagatccgtgatcacacaggtatctgcttacttgtactgaatcatgcagcgaacgagtgaacaacatcgtcctccctgaaatggctgaggcactggctattcgtcgggcactagtactggcaacagaagagggtttccagcaggtgttggtagcctctgattgcatgtcagcaatacagcgaatttaggcaccatctcgagatcgatcaagggtggggtgtctgatccaagatatcaagaagattgcaattggtttccaagcctgttcttttatgcatgttaaccgtctctgtaatgcagtggcgtagataggatttagagtaaaagtggtccatctatatatataataggtcaattaaaagggtagtccactataaaatttttattatattaactagtactacatatactatagttttaatctcgatcaaatttttaagtggtccaggacccacagtgccacctagctagctacgcctctgctgtaatgtagcggctcacactttggctcattgttatgagcaattctcttgttctgtctatcgttctgtgattccggactgtatccgggaaacactctgttatgatgcaagttaatcaatagaattccaacattacctaaaaaacagagtaaatattgctagtgcaatacttctcaaacctctaagggtgtgtttttttagataatggattacattaaacccagcctctacaccttgtgaggacagcctaaaagtcacaaacatgagtacataagactctcccattacatgggtaaagcataaaaagtttttaaagacagacaacaagcaaaaggaactaaaagctaagcttcaatccttcttctagagttccacccaaagatagagaaaagctccatcatacgcttctctaaaagattgcatttcgcgattacttcaatgccttcgtcttccttaagaagcaaagaccaaagccttcccaactgagttgctttgaaaattacctgcaagaaagatacgtggttgtagccattaaagactaagtcattcctactgagccacaaagcccaacaaatcgttgctatgcccacccaagtttgtcttttaagtttagattcaaaacctcttaaccaatttccaaacaagtgtgagctattacggggttgcttgattccaaaagtaagatagatcgcactctaaatgtatctagctatgagcatatttcccatccttaaggaggtaccacgaggtaccatcaggtaccaatctaatctaactgttggtttaacaggggtaggattgtctaatgaaaatgaggtgcccgtgctaatgaccgcccactcggccaatagggagttcgtctgtgccgcccacttctcttccattctgccgcatcgtggttgcatcgaagcttccccggcgccgccgtatcgagcctgttctcccaccacggcgccatcgcatcgaccccggtgcggctgccgccgcaacgaggctgccgcatccagcccgccgtcccgcggccgccgtctcatcgagacagccgcggtcccgtctcatcgaggccgctgtgcaatttaaagaagagatgttgaattgattcattagttacaaaagctacaaagcaaactacgcttctatctatctttcttttagtaagattatctttgtgtatttagatggagtaacaggctcagatagaattggccgccgagggaccgggcgactcgcgcgcatgagggagagtgcgtgcactcgcatcctccccatccttttctctccctcttttcctctcaacctctaaattctcccggttgaatgggtatcatgtactactatttgacatgtctcaatcatacaagacttgacactcattgaccagtctccacaatgacagtactgcactgataagcttattgctactagacatcctggaagctagctctcatctcaacaaccggcaatccggcatggacttggagactagcgagtccctctgggacctcagaatcaattcctagcctgaatcggggaatttcttcttcttttttaaaatagaaaggcctgacagccttccccttttctcatatcagaaaagcagacagatttaaacttgcaaaatggaaaaggaagaaataaaaacatccagggaaacttcgcacacagctcatgatcaagtccatgccggtttagatccaaagtttggatccaaacttcagtacttttccatcacatcaacctgtcatacacacaacttttcagtcacatcatctctaatttcaactaaaatccaaactttgcgctgaactaaacacctaagcattatagggcacgctagctgaaatggtgaaaaatcctgcgtgtcaatggcgcacaccgacaaattaccccttcgtcgatgacgacgacgcgagtcacgcgatccgcctgttcctgttccgccgtgtgcgtgcgcgcgccgcgtttcgtcactcgtcgtcgtcgttgactcgttgtcgtatgcagcggactcgatcggctaagcgctctcgtctggttggctgcagggtggttctaataaatgtggtgtgtctcccgtcctgcgtgtaagtaatccatcatcatccatggtaatagactttggttttgctgggtcaatgcgcattatatattgatcggctgccagtatcttgggttcggcatgcaactacttatgctacagagcactcgcctctgatacagagagtaattgtgtgtgaccataggattgaggtgttcagcactacttcagcggttggcatggttttacagtttgtgtttgtgaatggtagacggtgaatcgggacagattcctggctgccggtgaactgtgactacaaacaaaattatgctcattcacacaattgatcacgtcgtcagttcgtcactgaaaattccctgtactgcagacgttgagttcacaagaagtgaccgatgtagtggacagactcaatgatagcattgatcttgaagatactactagtagtacatttttagtttctcgttctgttgttggcagttaagtaaactagaagtaacaattatgaagtggcttccccaaaaagagacaaatattatatttcttgtagtagtttgcgtttctcaaattatacaagtcatgatggatatgtcgttacttcaatctgtaaatttcgcctacaatttgtagtttgtacttcaatgatgtgatcaacaaggcaggggttgaggaaattattatcttggccctggctagcttgtcaatgcgaattattgatcggctgccgatattttgggttgagcaacaactcgtatacatggtacagatcgctcgccttgatacagagagaaattaagtgcaagtgtgtgacacgtctctcgtcatgcaagatttggacttattcatcagtctccacaatcgtggacagtagggcactgctagatgactgctacgggatctcttggaagctagtagtagctctcacctcaacaaccggcattgacttggcaagtctccctgggaccctaatcaagattagagagatgttgagcagcggtagaggaggagctgaccggttgaccggccggctgaggaagtgagaagagcttaattagctgacagttctgcatcattggcgcaccaacaaaatagtgttttgcccttttgctttctaagtcgcttccagcgtcgtcatcgtcgtccaattagacaataataaagtgattttcggttgtgatgatgcggtctatatataccgggattgatcaacgttgataactaattagttaactaatcgtcaatgtcactagcttctcaaatttgctgggccagggatacagtcagttagtgcattcctctcatctatttaacactcggcccagccccaggcccccagcagcatcacacgtactcagaattcagaaacacacaaccaccaagagagaattaaccaaatgaccaagcttctccactccgcctgccttctcatctgcatttcaggcgccatcgggttggccgcggctgctgccggacacccaggctgccagacgaggtgcggggacgtcgacatcccgttccccttcggcatcggcgatcactgcgcgattcacgagggttttcggctcgagtgcgacaacgccacgaaaggcaccagcaatcagaagcctttctggggggacttcgaggtgatcaagatctccatggaagacggcaaggtctgggtgaaggcgtacatgtccaggcagtgctacgaccaatccacgggcggtatgtcatacagcgacgcatcggcgaatttgagtggttcatctttctggttatcggacacggataacaaaattaccgtgatcggatgcaagactctcgcctacatgacgaccgattctgtaagtactatttcagtataatttagtaaatctgattttcacaaagttgtaaaaatgagtcacccttatttttattttacttttttagaaactagaaaaaaaatacccgtgtgttgcaacgggtgaaaactattttaatcatattattgttagatttttttaaacaatatatgggatttttattttgatagtattgatatctaatttggaacttttattagaatgatggctatatcctacgttgctattttttatgctttagcaagaattctaaagcaattagaagtccaactctcgtcccaagttaatatgcgagttttttaaaaagatttttatacgactctttatgtacttttaaaagtgaatgaacttagagcatcaccaacagtctatctatctgattttcaaaactgatttggagggattttaataaaaaaaatagctccaacagatcccctactcacctacccaagttttggagttctcttctcccgattcctcgctccgtttatatgcggatgcgtgttctcgcaaaagtcgctcccaatctcgcactcccgcatctctcctcccgttcccgcgtgtgggagatagcgatctttttgcgatggaagaaaaaatagaattttttgttagtagtttaacaaaagggtccattttaagttttagggatttaatttaggctatctgttagagggaggagttttttcacttcctattttcagtttaggaaacccaaaaacaatttttggagggaagattatagataatctgttggtgatgctcttaaaaactgactcaaatacgaacaatgcaccaaaatgtcaacaaaaatattttcaatttttataatagtagagatagagatttatagatgtccataaggggtggaccaaggtttctcataagacctggaccagcttatgggcatgtttgggggagtttctagctgttgcagcttctcctagaatcagaagctccccccaaacagtccagcttttggtccagattttgagaagctgtagttgtagaatctataaaatgaactagaagccagcttgctaccaaccagctgcttctcagaatcttaagctcccaaagcaggcccatgtcatcttggtctaagattagagttgaaatattacggtgttttgttggtccgtccctgcgtccatagattgattgggaatagatattattatcccatttgcttatgttcttttctccaataaaagttggataaacttttggatactcgtggcatgtttttcaaattgctaaacggtgcgttttgtgtgaaaattttctatatgaaagttgttctaaaaatataagattaatctatttttcaagtttgtaataattaaaactcaattaatcacacgttattaccacctgattttgcgttaaacacttaatcttaatctttatcttcatcttcaggagattcaaacacgctagttgtgtccctagttgcagtcgaatactacacctaagtgcgtgaagcatgatattaaataaatttataacatatgtaagtttatgatactccatatttaatattattagaacttttcaaggaaaatctacatatattatttctttttctcttctctactattataaaaattgaagatgtttttgtcggtacttttgtacgtcatccgtgtatgagtcggtttttaagtttattcgcttttggaaatatatatttgtatttgagtcagtttttaagttcgtttacttttggaaatacataaggagtcgtataagaaatctctttaaaaaaactcgtatgttattttgagatgattggactcttaattgcagttcatggtttcataaaaagctatatattcacgcgaattcccatagtgaattttatcttaactaaaccgtataacaataataagattaaaataaccttcacccgttgcaacacacgtgtattttttctagtaaaattaaacatttgagaaattattgataatcaaagtttcgaaggtctgatcagatctcatcttagctaaatgtcaaatatttataataagaggaaaagtaaaaattaagaacgatccggtttttcacatgcatttcaataatgtgcggttattgcatcaattgccattgttgttgtcttctacagtcaactattagctattaggttgggtgggataaaatttacaaactttgatataagtttatagaaaaatatatttataatatataccaaataaatacactattaagacatattttttatggatttaataaaaactaaattgatgttgtagatgtggtgcacttttcttatgtttaaagttagaaaattttgactttgaatataaaactaaaacaacttagaatatgtaacaggaacagagagagtaatttgttaatcatgaaaaaaaatatttgttgcttttttttaacgaactggtaaagatgtgccaattttattgaatatagaagtaaaagttacaattacaagaataaaaaagaactgtaaaaaagggcaaggtctaaggaattaaaagcgcaaggtgtaaagaattgtacaaatttcattgaatattcgttgcttttgatcttcaactaaatagctttctgcatccatatgtaacaaatgcagtatgtaatcgggtgttcgtcagcatgcgacaacaaagtgaacaaactaactcccaagaatggttcatgctctggcgctggctgctgccaggcaaatgttcctaagagcatacagtactaccagggttatttcaacgaaggctacaacaccactaaaatatggatgagcagcccttgcagctacatggcagtgatggaaaccgcagcattcaactttagcacaagttacctcacatccagcgtattttatgacacgtacaaggggggagttccggttgtctacgactgggccataacatcaaaaacatgtacagaatctagaagaaacaagacttcctacgcatgtattagtaacaacagtcagtgcattgacaacctgacgaatgcacaaggttaccgctgcaagtgctccaatggatatgaaggcaacccgtacataaaggatggttgcaaaggtactgtgttgcacctttaattttgtgtctgctgcttatgtacacttgtatgtaatgtgacaattctgacccaatgtggtggttcgatttcagatattgatgagtgcctcaacaatgctacttacccttgcaaggggatatgcaccaacacgttggggaatttcacctgctcatgctccccaggaagttatatgatgaatggagattgtatgccaaagaagaaactacgttttgactcagtgcctgtggtagtaggtgagctcctatattctgtaagaactactaccatgtctatggatcaccagtttaaatactgcgtagtgtgtagtcataccatacaatatgacaatccaacacttctccctctaaacaacaccagagcttttctgaaataagtaataattaaaaaaaaaacttgtttggccaaattttgtgtagtcgcgttggccaacaagacacaactctagcacctttcttcattgcgacattgcagggatagccttaaatctgctcagtattggtccatagaaaaaaaaatgtaattgctggctaggtgatggaatttcatccatatcattttccaacaacgtgcaggcgcaagtatcatatctgttgtcctggtgattaccataatgtgtgcttacttgatcaaagagagaagaaagcaacagctcatcaaacaacattacttccgacagcatggtggtctgctgttatttgaagagatgaaatcgcaataaggtgttgcattcaaaatcttctcacatgaagaattacaggaagcaacaaataggttcaatgaacaacagattcttgggcaaggaggccatggaactgtttacaaggggcttctgaagggcaacatggaagtagctgtcaaaagatgcatgacaatcaatgagcatcagaagaaagaatttggtaaagaaatgctaattttatctcaaatcaaccacaaaaatattgtcaaactattaggttgttgtcttgaagtagaggtccctatgctagtatacgagttcatcccgaacggcacgcttttcgatctcatccatggtaaccatggtcagcagatctccctggccactcgtcttcagattgcccatgagtcagctgaggcacttacttatctccattcatgtgcttcaccaccaatccttcatggtgacatcaaatcatccaacatcctccttgatagaaacctgatagcaaaggtttcagattttggtgcttccattctagcaccaacagatgagtcacagtttgtcacactggttcaaggaacttgtggatatcttgacccagagtacatgcagttgtgtcaattaacagataagagtgacgtatatagcttcggagttgttctcgtagagcttctcacatgccagaaagcgttcaacctcaatgcacctgaacatgagaaaagcctatcgatgaggtttctcaatgcaatgaagaataacaagcttgcagatatattagatgaccagatcaagaatagtgagaatatgccatttctcgaagagattgcagagttggcagcacaatgcttggagatgtctggtgtgaataggccatcaatgaagcacattgcagataatcttgacaggctgagaaaggttatgcaacatccatgggcagaacagaattcagaagagttggagagtttgcttggagaatcgtccatggtcagctcaaggtataccagtacaggaaatttcagcatagagagaaaaggtgtcatggagctagattcagggaggtagtagctatactttttttttcaaaatcttggtgggcaatgtcagtattatctacttaaaataatcatatcacagatcttattacagtaaatatgcaatatcatattgttggcaaaattacttgcattgtatgtaggacaacaaagtaatgttggcggctgctcaaggaataccctcaacaatcttggtgttagtgtcgagaagaattgtcattgattattggttatcactatatttcaaatcacatcttagtggtcatagaaacatgcatactgcatgtacagctagtccatgagtgcttttttcagcattccttacatacaagcatgcctggcttgctcacaattggtgacattgcactacactttgtgtgtttatcggtccagcacaacaaggacgcacgcatatcatacagctagtgcacatcgcgcacagtggcacactggcccatcggtatcaacctcccactctcccagcttctgaaatctgaattctacgaacaggaccgagaagtaggtataaatttcagactttcagtagctaccttccaattccagcttttccagggattttccccaggttctgcttctgccagcccgttcccgtagtcatctaaaccacttcaccacaccaaactctgccttgtccaagctgtctaagctaccctgctgtgccgctgccctgtttactctgtcaaccgccgaatgcccccacccgtaaatcgattcagtgcgtcccagctttaggcttctattaccataaggtaaatctagagatcaatgctcactactcagtataagaatcgaaatagagttgtgacttcaataataataaccgcagtcaacaaattatcacattctaaaacagaatataaaactaacacattgagaggacgtgagctagcacacctccattctacactataaaagctactggtataagccaataaggctataatcaaaccaaaacacgccaaaaatgttaaaatgcgtaagcaacgcatgatctgaagcaagcggccgcaccttgtaagtagtcctccaagccgggttctcggtggtgaagggctaccacgaggggttcccctgcacccatcaccgcttccttcggctccttcgccacaggagggcgctggggtttgtgcttcaagatgttctcgcgcccctgcttgaagtggcggcgctgcgttcaggacctttcatctggccggctcctgacagtgcgccctcgcttcctgccgcttcccataccttcctccctctcgctctctcgcgcggtctgctcctgctgcagctgtcgcctttctcactcccggtgatggcgcggataggggtggcggcggcgcgaagggagggggggaaaggttcatggggtttcggagcgacggcgaccggaaagcgatgagggcggctgggcgagaggcggaggtcgtcgatggtggcaccggttgggctcaatgtgggccagcccactcgttgtagaattataagctgcgatgggcatttaactatgcaaaagtacactttacgtcccttatcttgtcgtcgagttttcaaaaacaccctgaaccacaaaaaccggatgcaatgcatcccttaacttataaaactaaagcgcacgaggtcttaggacggtttggatgatggttttggctaacgtggtgcctacgtaacttgtttgactgggtctttatcccacgtggcgttgacgtgacaatttagtctagaaaaataataaaaactatagggcccacgtgtcagttacaccacaaaacaattttaaaaatggtggggcccatgtgagccccacgtgtcatcctcacacctcccctcttctttctttcctctctcttgcatactcttggtcttcttcctcctctttccccctctctaatctcttcctcaccgttccctctactgctcctccacactcctgacatgcccgaatggtggcggttagcttctccagttctcctcaccccaggcgacgacgtcgacttcaagctccacacctgctgccaccatcgctcgctcgttcacacaggaatgacactggtggtgtgtgaaaaatcgtggcatgggcgaggacgcgtgagaggatggggaaggaagcaatccttgccattccacctcttcctcactggacagaggtcgacagggccgtcaggtccaccgggctgggacggtggtgtgtgcgctcgacctcaacatcgttgtcagcgagatgacccaacagcagccactgagggcccaacacgtgtggtagctttcggtagagcgcatggaggatgtcccagaggggagacaggcggcctctgccacattcctcgctgacaaacaactacagtagcgggcctcctcgaaggaggcggtcgatatctgcctccttccttactgacaaatgatagcgtccgaccagctgcaagatttgggcgtcggccagccgacagcagggacgtggggaagaggaaagggccggccgccacccttcaccggaaccgctgctcaagctctgtgccccactaccacctcgtcaagctccggagctcgtccatcgctggcctgtcgacctccggagctccgagaggctgagacagaggtccgtcgaccagtctacgacctcccgtcctttagagggagataagatgggggatagagaagaggaatatagagaagagagttggtgacatgtgggtccacatattttttttaaccgacaacccgctgacatgtggggctatctttttttcccttatgactaatatatggatccccttgtttatttattaaaaaattctgcctataatgccatgcaagcgccacgtgggatgaagatctactctaactagccacgtaggtgtcatataagccaaaaccaccatccaaaccgccttaggacctcgtgcgcactagtttcgtaagttaggggatgcgttgtatccaaccgtactccgtactcatccccgcagcccatcgtgtgacccatcttaaattgcctcaaacttattttggatgagccggtaagaatgcaacatttttcaggtatgcatgtaaaaaattctaatacacaaacgtattataaaactgtttaattatttaattggttgatagtcatggaaaatcaaagatatatcaccatgtggcattcatatcaggtattttgtaaaaaaaaattgtaagaatctttttacatgtatcactttacttttcagcagtatctccgaaatgcaaaagtctactccttgtagtggaaaaactaattctgcacgacgcagccgagccaggacgccgagaatttcatgtaccggccgcgtttttcattttgaccatgtcgatcgagcagtactccgaagttgatacagattacgcagaggtgacaacatatggcgcatttaattaccgcaactagggtgaaaacggtcagaatcagtaaatgacactcgatcgactaataattgatcatatttatcatttaaactggtaagtatcaacattaatacgatacagaaagaaattagtaaaatcaaaattcataaatagccaaaaatggtacgatcgaaaacggtaccccttatacaaatacgaaaacgatatttagtcgaccagaaatttctgtgaccgttttcacccctaaccgcaaccactggatcagcttcatgcaatcttcattaaccgtacacctgccactagccctatgaatattggagaaggccgagaccgctgcgaacttgcgagcccctatcatttgttaaggtcttgtttgattcagtttaagattatgataatctgaattattaggagtaagctgaaataaacagatagctaattatgataaatcattataatctataagccagattactataataatccactctaaaggtgctttttctaggggcctgttcatttttataccattttcaaccttaccaaattttggtaaagttgccaaaaaagtggctacatttagtttgctgccgaattttggtaactatataagaaatcctgccaaaattttggcaagttaccaaaattttggtaaggttttttttttgcatcaaagtgaacaggccctagattattgggtgtctaacagctaataatacagagaattaaacagctaacagcttagcttattttatgttggcttattataatccaggttatagtaatctgatttaataatctagattataataattttaagctgaaataggaccttagaaactatataatcccaggagcgtgcaaccatgacccagtcacgccatcgcatttagggcctactggagtacacttttgactaacacaaaggctctttgtcaaacgaagttaattaaaaacgtgaggaggtacatgtgaaaataaagtactgcaaatcacataacatatgtaatatcaatatgtaaattaactatcatcggataaaaaatgaacttgtttatgaattatccacgttatcttgagtaaaactttactaatggtgatgtaaacaaatatcagacacatccatttttaaatttttaggtttacgatacatatttttcccatagggccatatacaagtacttagcattttattggtcaaagtcagcctatcccaacggtaacatctatttccttatattaattagcaaaggatctcgtacaaccctcacactaatcaagctagaagtagcaaaatcagtaagagacaagctaaaaatattattcttgtgttaattaaaaaagataaaattatacccgtcatccatcaaatctagagcggagatattccattacagaatacgtggatttatagaattagaaattaataaatatcactctcaaatataatattttcacgacttaataatttaaaattataaaataataaagttgaattttactggggcgtcagttatgtaagctttatatatgatttaataagggtacatagcgaaaacgatccttgatttctagcattccgtattagataatatatgctgtgtcatacagttcaacgtatgctcaacatatgctgtgtcatccttgcaagaaaagtcaacatttaaatgcctattatacccttacagataccatattaaaaaatagaaaaagaaagtaaaaaacaaacagaaggtgccgtcaaccttattactgtttgttttctctctctcttttttttttcctttcacttttttaagtatatcgtttaaacgttgaccttacacatgcaagtataacatggtatatatgcccatacgggtttaagtcaaaactctctaggtttgactaaatttgtataaaaaaataataatatctacgatatcaaattagtttcgttagatttaacattgaatatattttgataatatgtttgttatgtattaaaatgttaatatattttttataaacttgattaaacttaaaaaagtttaaataagaaaaaaaaattaacgacttataatatgaagcatagggagtacgtaataaaatttaaagtctcatttagacaggaacataccctatgcacacaaaaagtcttctccctatttcgggctcttcacctagatctggctgcacaactcatcaagggtgcagatgatgacaacgaagggatcaggctaatctaattgctcacatgaaacattcgtcggtgacggcgttcacctcctcctctagtgctagctcctcctatttctaagggtgtgtccgtgtgtgcctgtgttcgttagccaaggtaagggacggttatggagtactgcaatgctcttgcaacttgctttaaattaaaaagaagtcctgcatacaagtatgtgtgaatatgtactgtatttgattactactactatttctgctagttgcatttactgtataaaataataataatgcttcttcatcgtacacacatccccctccctaaaaaaaatagagaaaactttacggtattcagccgcccacgtcaacaaaattacgtactatacgcgatacctgcgctgtagaatatctctctcttttttttttttgagaactccactgtaggctatctctctatatattctctatatatataggctagctggagcgctgacctcgcaaacaacgggcacaaccaacaaagatgaagttgcagtatacacgggcagttcttgccagccttttttgtgtctgtctgtcggctgtctgggtggcggcagcaacggccgatataccggcagggcaacgccccggttgcccggagaggtgtggcgacgtcgagatcccgttcccgttcggcatcggcaagcactgcgcgatgcagacgaagtatccgtttgatctcgactgcttggacgtgaatggcaccaagaagcctttctacaacaataacgaggttaccaagatttcggtgcaggagggcaaggcatggatgaagttgggcatatccagtcagtgttatgaccacgtgacaggccatatcctgtacgacagcaacgcaacggcagaattcggtgattcacctttctggctatcgaccgaaaacaagatcatcgtcatcggatgtcaaactatggcttatatggagagcaacgctgtaagtatatatatctcttaagcttatcatttagaggcattttaataagcacaccatgttaagtatacaaacagggaatcggccggggactaggggggaaaagaattcccgaaaactgtcgcaaggccaataccgtcgtttatctagaatttcacttggcaagtgtattctttttttttctcccagccacatgcaaaatgtacatactctatccgttttatattataagccgtttaattttttttcttagtcaaactactttaaatttaaccaaatttatagaaaaatattttaacatttttaatacaaaacaaaaatattatcaaaatatattcaatgttaaatttaatgaaactaatttggtgttatatgttataaatgttgctaatttttttaaaaaacttgatcaaatctaaataactttaactttagaaaaagtcaaacgacttataatataaaatggagggagtacttatgagatagaagaagtatatataggagggaagtttttggatgggcagcagtgatccgatatgattttgccaaaaaccggtttctcccaagattcttgtcactatctacacgttttgatcatctctttactttttaagactcgtctattccgtatttccgctcacactatgctatccacgccacccacgccacccaaagtaatagggaatctcatcccctttgatttgtgtttgtcatgttgtgttgcgtttttgttccaccaacctagcaatcaagtggactgtaatatgctgccacccaattttaactagtccttaattcgcgtaatggcctcccatatggatttgaacatctgacaatcctcgaaaatgtgttgtctcaaggcttctaaaacacaattggtagaaatagttattcagctagccaccctctgatttgtagtctatcagaggtctaaattctgttcagaaggagtaaccaagagaataacttgcatttggagggttcccagatttgccttgccccagctgattgtatttggctagcaaattgcgcttgatatgctaactgctaattctcaaaaaaaaaaaaaagctaactgcgcactgtgctattgatccagtgcccgtcagcttccaaattaatgatggtatattggattccttccgttaatgctgtgttgtttctccataagcaaaatcccatactttgtagaagtcactgaccaaggccctccaaatatttccatgaagaaaagaaaaactggcaaatcaacaagaacatcttttgcgctcaagagggagatggattcaaaaggagcataaagcttcatctattcatccttcttctcaccacaaaaactcagcatataaatcaaaagaaaaaccatatcacaaagacaatagaacacataatttacaaataaagaagcaaattaactcaacacgtacaactcacacctttccatgcacaacatttcaaagaaaagttaacaagatctcatacttagtacaagcttgaacacttctcaagaaatgtagtctgaaagtaaaccagcctatacaaatgctccttttttctcatccaaggtgcgacccagccagggtagggggtaagggcgtgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtatagtcatgttgggctgcggacagatcccgagctcacaactgcattacaaaagggaagcggaagccaagacttggaccaaacatcacaggcgcgacttggaaactaggccgaaaccctaaaactcatcgtagccggcttgctcctggaagaactcctcgtcagcgggatccgcttcatcttcttcagcaactaggggggattatttatatagagcaagggtgagtacgggagtactcagcaagccatgggaaataagtgtttaatgtaggcttcaaagaaaggctgttgtttttgcaattgattttatttgaactcttttctgaaacaactaagtgagtgcttctcaaacgacacggatgagacagtgcgtctcgtccggtcggagtatgtgcaatgtatcagtcttttgaattgatcaagattggcacccggccaacagctttcaaacggccacccgggcctggctgatcccatcagccgcagattttccaaacatcaaacccatcccacaacagcaaatttcataaggcagtagtcaaacaaaactacgctaggaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaagggtcccagaccaacaccagattaggtcccagaccatattgtgccaggaagcccaggggtcctccccgacaccaccccggcgaatccacatgtctcttagcatcatggctctcccgataagctagttactcagccaggggtgtcccattccacccatgtggtcgtacttgtcttatgttcggatgaaattccaaggaaacagtccttaggtgcaagagcgggaaaccgtacacccggtacgttccccggtccgcggttttggaaattcatttagttcgcaagcaccgacccaggtgtcggattttccaagtcttttgtaaaacgcaagttttacccaagatgtttctcagattttaagtttgaaggcgaccgtcgatacccgtgcagagtgcacgattaccgaggcgcaactaggtgggtacaagggaacatggtataacaattacaatggaatggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacagctcagcaaacggcaaaaataaagccctattattgacctctaagcgtgccattcgatagatctcgagatttgaggaattttggaagttgaacggagtcaaacggacttacggttgggaagatattgaatttctaagattattggatttttggtctaaaggaaaaggatttatttaaatcctttttgaaaaagaaaagaaggagggagggaaattagacttccctcgggcggctagggcgcggcccgagagaaaggggcggctcggccgagcttaatgggccggccggcccaagaaggcggcccaaggcgcgcgcgcgggcggggaggggagagagagagccggtgggccgggtccatcccgcgtggtcccgggtgggacccgcttgtcagcgactcggctcaccgtgagcgaggtgcacgcggggcgtgctagggtttggggagggaggcgcggcgcatgcgcgcgtttcgcggaggacgtggtgcgacgggcccacgcgcagcctcacggctcgcggtggaccgcgcgcgcgaggggcggagggaagcggcggaccggggtctgcttgacccggtcgcggccgaggtggcgccgacgtggcgcctacgtggctgccacgcgagccggcgggaggtagacgacgacgccggccggaacggacggcggacgacagcggcgagcggcggagcgaaccatggcgatacaggcgaaggcgagcacaccgggatgttgcacaggacgaggggagacgagccaatggctcggattcgccgggggatgctcgacggcggcggattgcggcggcggcaaccggcggcgggagaagggggaaacggcgatgaggtcacgaggggccgattcccggcggcgagagcatctacgcggctacgggaacccaccccttgcgccggattaggaggaatcgcatcgagggaggccggcgacgagtggcgcttctgagctcgggcggtgagcacacggcgagcgacggcagcagtcggggcggcgccggctagctacggggaggctacacatgctactaccgaaaactaaggggaagagatggattgaggagggagaacggggagattcactaccgtgcggacggggcgcagtgacgatgggccgacggcacgggagcgatctctccggcctcgggccgggggagaggaagaagacgagcgcccggagtccccttcctcgtcctaacgcgcaccggctcctccagcacacgcgacggcgcgggcggccggcgggagagacagcaatggcgcgggcgagaaacggggaagattgggaggggaaagaggaagggaggcgcttttgtttatagggcggcgatgtcggtttggaaaccgaccttgggcggtcaagggagggagctcgcgcttggcggtcgcggccaaagcggcgacgggggg

SEQ ID NO: 67148 - DNA, 24909 bp, Oryza sativa
ggaaggtaattccactgcaccaccaatcaatattaattagtatttgtgatttttttaaaagtaagtgctccataatgtttttacatgaaacatattactccatccatttcaaaatatagcaacctaccaaattaaacatatcctagtaccataaatcataaatctgaacaaactaatgttgtactaggatgtgtcatttgtacatattcgttgtatcaggatatgtataatccgatactaaattgatatattttagaaagaaaggggtatgtactaagaatattgtatggtaaaagccgacacatggacattcctttactcactacctatctcaaaatatagcaacctagtactagatgagacacatcctaatacaacaaatctagatagacctctgtccagtttatattattgtactaggttgttatattttaggatggatatagtacatgtcagtctaaaaaaaagcctctaaggtttatacttattgttttttttaaaacacagtagaaatgtagatgcttatatacacgtgcatgcactcgcccctatagatacacacgcgcacaccctcttcgatgattagaccggcatatctaaagattaacgaagtcaccacaggtgcttcgatgtctacatgtatgccgcctactactaaaaaaataattagtcataaatacgagtgctcatgctaagtgaatccggataggcaagttccaccatataatgaacctaactagctgagctatgcttacttcgtcaggtttctaatactataattgtttcatattataagacattttaacttttttttataatcaaacttcggtcgtgtttgtagaaaaacatagcaaaatcgacaacaccaattgtttcattaattgcaacatcgaatatattttgataccacgattgttttgatttgaaaatattgttatatttactataaacttggctaaagctaaagaagtttgactcagaaaaaaataaaatgtcttataatagaaaacatagtgagcatttttatatctattgcaaacgaagaagcaagcggtcagttcaactatattattcttctctagaggtgtttttcctcctcaaagggttatccctcgttttatatattatacttaaaaagtcataaaattttataagatagattaatatatgatatagtagtattactctacaacatttaagttaaaattcagcatatacaaaagtagaaaaaataacaaatataatgtacatgagcacaatatttactactactagtatatttgttttctttaatttatatagggcgattatgaccttgtaggatactcctatattacatatttattatcttgagttgatttttttttaaaaaaatatgaccttaatgtgatatatacacaagggacatcttaaaagacttttccattcttgtttactgtttcatttgttgtttcgttgcgtgctagggcgtgtttaggagaaggtttgaaacttctctctacctctataacgtgtataacggagtgactcattaactcgtaattaattatgtattagctaaaaaattaaaaaaaagattaatataactttttaaagtattaatatcgaaatgagcgcagtcagggtcatccacattgagagatactgactgctcaatcgctttctaacatggtgagctagctagctgccatgtactccctccgtactcgtaaaggaagtcgtttagaacaatatttaagtcaaaccttggaaatataaatcataaataactctcaagttgttaagtttgaaaatgtaaaaattatatgaatagatttgtcttgaaaaatacttttataaaagtatacatatatcacttttcaataaatatttttatagaaataagaagttaaagttgtgttttaaagaccgtgtcgctatactaaacgacaacaacttcaacgagtacggatggagtacgcatatacccatgtggccatgcctacctgacatggttacggcgcagcgactagcgagccaagtcgtctagactcgagaggagcaattattgggccaagttccttctcactgtgacccagtttactgattaggccgagttctctgcctcattggccatttggcctgtgtgccaatgaaaacattgagttggatatcaaccaagtagaactacacgggagtggcactgatgcacgcctcttatgtaggagtagctacttaactgcaaacgatctatataatgtctacatcagagatatatttttctctttcaaataaacaggccaccactgaattttctggtatactctattatcaccaaaattgtcctccatccattttcacaccaatcttatcattttccatatgcatgaatgtgatggatgagaaaaaatgtttgtccagaatgtctgatttgaccaatttgaggtaacaggtcatgcattttcttggcaaggcattttcattttcatagtactcctataaattttgacaagattttgggaagcttgatatggtggtggagtcatatgtgcatgactctatctgtcatggtagaaatggtgatatccactaatattacacacataagtacgttttaataggaatttagtgggatcatggatataccacctatttccatctctttgagagtggggacgaactcatgtggtgatgagcgtgcatgtgtgtcatctatgtaaatgaaaaaaaaagattttaattggattatgaagttaaaagttgggctcaaccccaagctggctcatcgttatcttggccccacgagtgaattttcacctatgtatttttggtcaagaaaagaaaaacgtgcaaaattgtgataaaatgggctgaagtggtatacacagagatatgataagtcgttttgattttttcctaaatcagaaatctataagttaaacctaatttatggagaaatgtagcactcttgtaacaccaaattagtctaattaatcctaatatgtttgttgatattaaaaatgtttgctctgtttttctataaacttaattacacttaaacagtttgactaaaaaaaatatcagaacgtcttaagatatgaaacaaagggagtagaatgttagtgctaccaaagttaccaagatattttcagtaatatatatatatatatacataatctatattgggtagactctcgagtagtacaaaaacatttttccttttcttttctcaaacaaaaaaactgacatcatctcacccttgcatatacaatgttcacatatatcacaccactaatatatcagatgcctatgggtaaaaaccactgccccaatcgatgttggatcaaaggcttcctgccgagccattctcggcgatgtgcaccgacggcgcgtcgctcctgaacctgagcctctgcaccatgggcttcatcttctcgatgagcttgacgatgacgaagaagagcaccctgtacagcaccaccatcccaccgaggatggcgaggtcgacccacttgctgtaccccagctgcacctgccagtagtctcgcaggatctcgtggccggtgatggtggcggcgccgccggcctggttgttggggaaggtgagccccaagaactcgttcttgtagaacccctggttggcgtacttgtggaacgcgatgtagtacatggggtacttccacaccggcttgggcaggtcgtcggggaggcggaagaagccgccgttgagcatcatgacgccctggatgccggcgccggtgatgatgcccatgaggaagtccggcacggcgctggccacgatcatcatcagcccctccaccaccatcatggtcgtgaagagcaccaccgcgaagtaggcgaagtggtcgatgctgctctggagcccggtgaggtagtagccgatcgcgcccggcgccaccgagatgagcgccaggtacggcgtcgccgacagcgtgttcgctatcacgaatgaccccacgccgtagtgcccgttcagcctctccctcccaaatatctgcataaagaaaacaatgaattaagtgaacattgatatccattttcagatataaaagtatgttactggggtagaagttaaattttgttataacttgtagaggttaaatttgatcttagtgtatctcatattaatttattttattgatttttttaaaaaaatagtaactatttaaatgacatacaaataataagaggtaacattgtatggtacattcaagaatataccttcatgtcctcgacgaaagatgggaagccaccgatggccatgaaggtgaggaaggcagcgacgaacatgagcatggagccacgagcctgcagagatgttttcggacgtacggtcacaaacacagtaacactaaagggtaatgaacagtagcagtgtaatgaacagtgatgggtgcggctaatagaaagcaacaaaaaaaagaaaagaagaaaagaaaatgggacactgtgagtgatggccatggctgacgaacctggatggatccgtagctgtggccgatgttgtagtaaatggtgccgacgcagaggcacagtgcgatgtaaatggcgaaacgcagccagtaatagcccaggtccctgtacatgttcacgaacgacctcttcgtgagcacccaggtctgcgtcagaaagctcggtctctcctccttcttcaccactgcccctccctgtaaaaaaaaaaagaaatcacagaaagaaattttggtgaattttacacgcagtaattaaaaagcagaagcaaggatggattggcaaagctagaagaattcagagatgatttgtgtgacgtacggtggcgcgtatgtcttggatgtgatgcgtcactttctccaagtggacggaggatttgtaggagttgacaagcgtgtcgattgcttgagcagtcgtcatcttcttcccgtccatgccttcctcgatatcctgattgatggatcgtttagaagatactaagttattcgggatcattttatttattcaataattcagcagctttcatatggtttaattgccatcgtcttgatctcgtcatttgctactcaccttgtcaaagtccttgtttatagtcctcaggaagtggtctgaagggttcatcaatgatggacaagggaacccgctcaaagcaaaaaactgcgaaaaatacaaagaaaaattaaatgaatttgtgcagttacctaataatcagtcaaaaaagttcagaaggattcttctgagttctgatttctgaactataaatgttttccgtagtgctagctagagagtcaaagaacagtggccaagtgcccaagtctgaaatttctgacgtttgtctatggacctacatacatggtacgcgaccgcagctgtagatcaccgaaaacgcgtgtttttcttgatgatttgttcgtacggtttcctaacttcgacccaagtgtggtcaaggtcaagtaatcagcatggtaggctattaaaatgtcaaatgggagacctttgccttcaaaaactagttaagtggtgtgtgacgatccaattgcttcttagtttcaccttcaatcacacctgatactttgttgtatcaggactcttttccaaagttgtttacctacttctagtactactaaaaaaaatgatccttgcagagtaatctgggactttcagctttcagaactgaaaattcgtcaaactgaacgaccgttgcagagtaatcgctgtatggatgcatgctgcagttggcatagctaaaatctgcaggctttaagtcaagctgaattattaagtgccaccgatgcagtgaaacttaatactcctactccataattaggtggatatgttctgctgctcgtgccacgctattggattcgatgagatatcagaaaaataagacacgcggctctcgccaaagaagaacaaggagacaagttcacacgtcaccgaactatcggagtcactgtgtcagactgtcagtgcattaaattcgttctgttcttctgtttgtgagtaagctagtgtcacaattagttggtatactaaaatgaatatgcatgtatatatgcagttcatatatagtagtggttagatctagtgtctcctttcagctatagttcagttcctggttcctcctacgtactacccaatgtttgagaacagttctcattttgtccttactaattttcaggcacaaggttccgatgtaataatctgtagatttgtttctttcaaaaatagtttttagatttgtagtaatggctgaaataatgtgtactttctgcatatgtgaattgttcatcagtatcttattagaactatattttctattcattgttcaatgacaactaaggatttcagttctacctttgatatagaaagatgcacagctcctgcttattgtcggaaaataaaaaatcttttgcaactatcagctttcatctgactttgcccaaatcttttatttccaactcatggttagctgatgtagcccgtcaagtgtgactaaacaaactcggcaaaaatgattctctttccgaaaacatctcgcaaaggattgactaatcgcagaagagtagtagtagtactggtctaagtgattcatcgacaatatgataatatcatagacagtatgaatacacagatcgaccaggctggctgccaattttttttcttaaaaaaaggtataattaagcaggtggccggtgaatgatagccgccagcaaaaatattattctttttttaaaaaaggcaaaaatgtacgtattaattaagcaagacatacgtatagatatacgagtacgtatttgtacagtatacggaagcgtagaagcgtgtagaatacctgggcggtgtcggcggcggggccgaagaagacggtcttgccgtaggcgaggaggcagaggccatggaagaggccgaacacctcggtgctgggctggtgcacggcggcgacgacggtcatgccctcgcggcgcgccatgcgggcgatgcggctgacgacgtggtacgacgcggcgctgtcgaggccgctggtgggctcgtcgaggaacagcagcgccggccgcgtgaggatctccatgcagatgctcacccgccgccgctgcccgccgctgatccccttgtgcgcccacccgccgatccgcgtgtccgccgcgccctccagccccatctcccgcagcgtctcctccgcccgctcccgcttcgccgccgcgctcatcccgctcggcagctgcagctgcgccgagtaccgcaccgcctcccgcaccgtcagcgtgttcatcagcacgtcgtcctgcgtcacgtacgcctgatccatgcgttccacgagatcatccattattcaattattcatcgtgcatgcagcaattaattctgtacattcgggaagaagacgagtccatctctcgctgacttaccgacgtgccgaacgccagcgcttgcctccggccattgatcaggatgtcccccttctggctcacactggaacctaaccttcctgtacgtacgtgcacccagaaaacatggagctcggtcagtcggtgtcagagttcgtctcagctagcatgcaactcgatcgatcactccttctctattcaatgaaattggcagcttgtcgattcgttcaaaaaaaaaaaaaactcgatcgatcgctatttgcagcgacagggatcgtgttcgtcgggatcgggagattaattgacgtgcgtgtacacgttacctgccaacgcatcaagaagtgtggacttgccgcagccggagggccccatgatggcgagcacctcgccggggcgcgcgtagccgttgaggccgcagaggatggggacacggccgctcttcccgccggcggcggacacccacaggtcctcccacgcgaggacgacgccctggtccggccggcgcaacgacggctcgcgggcgacgccgccgccgccgccgttctccgccgcgctgatctccagcgacggctgccgcgccggcaggaacggcggcggcgcgaacgaggagcggccgctgccgaaggggaacccgtcggtgctgcgcacggaggcgctcatgtcagagacggcgtcgaactgcggcggctggtccacgtcgtcggcctcgcggccctgcggccgcggcgggctcggcttccacctcggcacggtgggttggtgctgcccggacgccatgaacgcgagaacgcctagctcgagcttgaccggaagcgatcgagctagctagcgaggaggtaggtggtgtgcttgtgaagctagcgctgtgtgaagaagaatggcgagccatggctcttgcttaaatagagccaaagcttcgcattgcgccttacagataagatcgatcgcttcgtacaattgacttttgataaattttaactgacaattggattatacggtcaaaagtgcatttgaattgttattctatcgtagtttctcccatctaagctgataagatcgatgtccacgtaattttagacagtaagcaatcaattgaggcataagaatatgtacaagacgaaatgaatagcatcaagaaattttcaaaatcgttttttaagtactatagggtactgttattaaaatgttgagacattcaaaagtacgtacaagcctcttcggtcaaaaaaagaagaagaaggtacaagccttcaaatttgctagttttcatgataaaatagttcctaaatttggaataattcaaagataactcagtttggggagtcattaattgtatttcttatgatttaataactttaaaattctgaattaataaatataatgttgtattggtcttgggggctctcgctttagcattttattaatttaatactaaaattcgaaaattaataattagcaaattgaagttgatagacccttgcttaaatttaagccattatgattcgatcccacatcgatatatggctatatttattcatttcttagtgtggtcataatttcaattttccatgatgaaacaaagagtaaattttgctttgggcctcttattaaaaacaaggtgtacttgagtccaaagttgtagtttttatttttttatttagtaattcttacattgagaattgataataattataaagttgtaactgtctgggactcttgaaccgttatatagccagatttatttacttattctctaattttatacggttacaacatatactaattacaattactcctataaagaagcacatgcatgagaacgcttcttcaagaagttgagctaatagatttgaatttgataattgccgcatgctatttatagtcatttgctcaaactgtttatttgcttcatacaaatttccgcagcaatatgtggatgttaatatagctaagaacacctaattaatatagctcggaatgataattaatacagaaaactccatcttgaaacacattattaaatgatgacatcttgatcatgtgattgttttacatcaataaataaacatctatatcaaaaagtgactattttgtggtatttttcttccataacgatgatgaaagggagcgagtactggatttcgttactatcaatcacccatcaattagcatcccctcttaatttgtcttacgtgctgccatttgctgggtttcgctgtacacataaatatttatcaagttcttttgtcaaaagattataacagtgaaaattgcttaatataactgaatgatgtacatgtggaactgaaatagcacgattgatatcgtctctactaccaaaacaacccatcaattaatgtataagcctgtccaagacatgaagaaaaacaatagttcatctgccaacctctgaccatgctacaataactatatcatccacatcaatggcatgtaaatgtccaaaataataatcaaacatccagaacaatagcatctccaactgcacgtgaataaaatgcttgatgttgtagattttttgtttgtgctttatttggatgacatcatcaaatttttatagttgtcttctatctatgttgcttttttataatttaataaacaccgtaagattgttttatgcgctaaaaagattgcactatacttctataatgataacatatatctttgctttcaaattaatctatagaacaattatgacttatagtttcttttggattgctagattttttttccgtgatcaacaaaattctccgtagcaatgcacgggcaccctactagtatccaaaataataaaaacaatagtagcatatatagcatatccaacaatttccaacttttgaaagcatttccagcattacgaacgcggaggagaactcaactaggccggtcacccggcggcggcggcggcggcgggcggtcagctttccaacgataaaaatggatggcttctctgcaacttgcaatagcaaattggcagcgccagaggtggtcaattcggaggctctagatttttcacactttagccctttcagagaaaaaatttacaaatagatcctccagaaaagtttccttcaaatcctattgatttgtagtcaattaattttgaaatgaaaatgatagatcaatataccctaactcatttctgctactttatttttatttataaaatcttaatatgggatgagcatatataggtccctccctcctctacccaaaattacaaatcatataccataattcgattcccctacttccttttcaaaatttgataacaaatcaataaatctaggaatggggaggagctagtacgtacccacgtcctctatttagatggagttttttataaataaaaaaactagtaaaaataaattaggatacatttatttattagtttttcaaaatgtgacgctgagtcaataaaatttgaaggaaaacaaaagaaagagttattcgtagaattctaagtgggagagttcggcaaggactcctaacgcgcgtgtacgcgccaggaggagaagccggcgtgcgtttttctgacgctaagagcgcttagccctaactaatagcgcttagcgctaactaactttttttctttttttttttgataaaaattcatcacgtgtctttcttcctttttagttgactgaaacaaactttcaattccagatttgaacttagatttaaaaatttcaagttaagatttgaatactttcaacttagatttttaaatttgagttaaaagtttttaaacctgagttaagttttcaaatattgacttgaagttttttaaatttgaattgaaagttttaaatcttcatttgaaagttttcaagttcgaactgaaagttttcaaatccaagttgaacgttttcaagtttgaattgagagttttcaaatccgagttgaaagtttttaaatctaagttgaaagttttcaaatccgaattgaaagtttttaaatcttgaattgaaagttttcaaatttaagttgaaaatttcaaaaaatcttgagttgaaagtttcaactcatattcgaaaactttcaactctagattcgaaaactttcaagtccagatttgaaaactttcaacttgagatttaaaaattttcaactcaagattggaaaactttcaactcgagattcgaaacctttcaagtccagatttgaaaactttcaacttaagatttaaaaactttcaagtccaaaattgaaaatttttaagttaagatttaaaaattactagtaaactaatcactagtaaaaatagggaactaatcactagtaaactaattacgattttttctcctatccgtgcgatagcaaactgcgaaaaaaagaaaaaaaaagagaagaaaaagcggtagaaaaaaactgcgaaaaaaaaagaaaaagaatagaagaaacgtgtgcacgtaccgtggaccttgtgggccggaagtaagcgccggtaacgcgcacgcgaactagcaatctcggagttcggcgatgtctggtgccaaagcctaatgtcgacgccagcacatatatttggagcaagtgttcgatagggtgtctactcatgaaatacattttcaaaaaaggactaaaacgtcaaaaatccagatcagatcgtttgcttctctgctgtttcgttttctgctcggaaagagaggtagggaatggtcgcgatgatcaccatgcatgcacgtcgacagacgttgaccgcaccacattgatagtctccagcttccgtcgttgtgacttgtgtgagatgccacgagagcatacattacacatgcaatttgggattttggggacacatgcaatttggggttgtttccacgcagctagccaagtcatgggctctcccaattagtctgacccgaatttattcgctcgctgccctaagcaagaatgcatgaagacttgtcaaaggaatatattactgtacgtaattactgtaacgtaggattggtcgatatataggagtagccaattgtcaagtcctatgcaagctagtcaggtcacaaaattcttgaagagatactctgaataatatatgacgtgtcaagttgctatactagtattgttttatactgatctttctcacgttacgtagtagtagtatccaataataaagaaaagataagtacgtagctcgacattcaccggagcatgcatgcagcgacttactacctcccttttaaaataaaccaatttacgtattaatatgataaaatctagtacaataaatccggatagaagattgtccagactcactatactagattatattatatccttatcaaaattgatttactttacgacggagtgagtatctagctagatcagagcaagtaccataaagatttactcctaagagtagagatgtttgcccctagtgccacataaaattaggtggaggaaaaaagtgaggagatagagaataagccaactctcatgtaacgcgtaacctctatacaaaacttcaagaaaaatacaaagagagtgagatagtgctagagcgaaccaaccaaaaagttatcaaggtttatttattagagataaatatattatatatacatgatgcctcttattcctaattcatgagtagatgatataactaatattagaagcggtagccacgccactaatataaaactactctgagcagacatgggatatattctactctctctctctctccaaatatataacaacttctagacataaaggtctgtcccaaaatataacaactttttcaccaacattctcttcttaaccaatcgcaatcctccatcattcaattttctcacctatcttcacttctcaaccaattacaattttatcctatttaattttacctactttcttaatacccgcgtccaaccttaaaaatccttatattttaggacggggagagtagattaaaggttgggttctttattactttttttttctcaaacttctactctctcatttatcatgaacacacttcacgaacttttaaatggttttttcaaatattttctaagctagtacgtagttactttaaaaaaacatatatattaatctattttctaagttaacatttaattaattattggttaataagctacctcgattttcgtacaaggacctaaattaacgtggtaatataaagctagcttcagcaacgtagagtacttcctgtggcagggagatcgattgatcgaccgctgtgacgctgtgttttagctaaccaaccagggtttttacattccgaaatgtaaaagatcaatctcggggaacaaaaattcggaatagcaatggtatttcaaatttgaacagttttttctctgaatgtaaacaaattttcgctaaatataaagatactaaaagtttttggacatgtacgtaaattcaaattttctaaccgaaaattcaaaccctactatccgcaacttgtgagtagttaatgcagagtaatgatgatacatgacggctaagctagctagtgggagtagttagctcacagtaataatattaatggtggtatcaaataaatgattgctagctagctttccatgcccgtaattaacttatctcaagtttctaataaatacttcctcccatttttataattaaagttttagacaacgatactgccctccaaaacatattttcgatttgaatccaacaaaaaacaatgaatcaaatatccaaataaaaaactcccagaatcaacccatcacataatcaatcaacatatatataatacggccaatctttataacatcctcactttttaattggaagaacagaaatggaattacatggctctaggaccacccgccaccgctattcaccgcatggtgaagaagtccgcccacccgctgctctctacagacaaccattgatgtcgagatcagctgaagagagagggggtaggatgaggaggatgagagggaaaggcgcggatggaggaagatggtgaatggacgttaaccttggatgttggtgttggactcgagggtggcggatcagatcaatgacaaggacgaggcttcctgcctagtgctaatgcctccatcctccacttcattagtgttgctaattgtgatgaagagaatgaggcactctagattcagctcgtactaggccctaggcagaggcattgagggcaaggaagaagagatctgacatatcagtgccattgccctcgtcgccgcgcgttgctgccccatcccccttgctagccccaaataggctagatctaggttgccaatctgccagcgccataatccctatggagccaccgtcgcatcacctctgtaaagtcatgttgctgtcgatgtagggaggcagtgagagagtgagaaggagagcggggattagagggagtgggagggagagattattgacaggaaagctggatagtgtaagataattaatagtttgggagagaccaagggagcgagagagtagtagatattccctcggttagttcggctcatctatgtggtttattattaacaatatttttaaataaacaagcactaataacatcagtgctaggtttcttaatgaaccagcaccgatatggcttgagggtgcaggaaaccactattagtgttggtttttggctaactgttataaatgtggttttccaaatatggagttttgtagtaatgaccaccaccaccaccaccatccccgtcctaggcaccgctagatccaaaggcgaggatgcctagggtgcctgatccggcgacaagaaggctttctccatggctaccgccattctgtcttccatagtgtagtcaatggcaattgaggacgtaatgatgatgacctccgctagatctggccaatccatgctctgagtgtgggtgatggccagccctgtctcctctccacaacctatggcgaacagatcagtgcaagctaagtcctaaatcaacctaaacctctgctcttctttctcaatctgaccccatctctcctctcacgtgtctggcaatactcatttttactgtcgattctggagctagccgacagtgatatgagttagggcctgtttgggggagcttaaaattctaataagcggctagttggtagccagctttccaaaatctggaaaagctgggtttttcagcttctggctttagttcattttctgcattcctcaattacaacttctcaaaatctagacaaaaaattaaactgtttggtgagcttctgattctaggagaagctgcagcagttagaagcttccccaaacagaccgtaagtatcactatattgtaatgtgggtttttgaattggaattgattctgtattttgtatagtagtgttagtatattcctataaatagcgtacccgcaagcacaaattaatacatatatatatatgtgagcactaggatttttaatctcagagtgtgaagtcatgtactacgactccactaatagatcaataggcgtgctttatcctatacacacaagcactgttaattgatatcaaccttggacaaaaatagatggcttaattcaactgctacaataataacatattagtgtgcagtagaaccgcatactattgacacagtagtgtgtattagaaccgcaccggcctcgaactcattttcttttgctatatatagtattcatctgcagatccagatctccttttcagtcggtgattgatccatgatgctcatcagtgcaccgaaaacgattgtgaccaacacgtgagaaatgtgcagtgtaatccaaaggaatgaaaatgcaacacgatacgtatagtatatatatatgcacgtaggtactcgtacgagtactactgtatataattaatggctaaactcttgacgtgttaacggtcttgtacgtttttcttttcctatatatctcatcaaacatggattaattaggcttaacaaattcatctcacggtttttagacgaattataaaattagttttttcattcgtgtccgaaaactccttccgacatccggtcaaacattcgacgtgacacccaaaaattttcttttcacgaactaaagaaagccaaaatcacaaaacacctcaacacaattgattgtttttttttaagccgcacgtggaaacaaaatcctaggcgtagattgttttttttaagtagtgacttgtagactccatggactgactaggaagactataaatcgtacgtacgcgcagaatgtcacacgttaatgtagcgaattaacgcacacgatcgacatgcaatatattcaacgtgcataaattatgtcatctattcgtgcatcttttcctagctagctaacttgcaaaaacctgcagcgggttgtggaatacaaccccagttaaatttgtaacggtgcgattgatttcagacttcaggccgtccgccaaagaaatctacacgaaatttaggcacggtgaaagaaaaatacaggttcttggaagtatttggaataagtgtccctagaaagcaaatatatcatattcaaaataatatcgattaagtactgtgcgaggaaaagtaagagtagacgacgttcacggcgtcgtagttgagttggggcgaaatttcataatgacatacggcttgaactaacctttcaatcaacgtgaaagaataattataacggtctatgttgtccttgcgagcatatattaatgctgatagagacattgatctcaccataacttcagtataatagtaggaaagaatgtgaagcataagcatcatatcatcttcaattgatttcttcagccgccgttaacatggaaacatggagtacataggcgtcacgtcaaagttcggcaactagctaggagtacaattttatttgttttaggaattatttctcttgaaatttatgtgaaccggtgagtaccgttgagttgtgattcaaattcatttgcacataataaaggccagcttctgctggagcgaaacggaggcccgtaaatgctcgttatcttttagggtttcaccttcatacatacctttgtaagccaccgttcggcgttgtaacctcaccctgatatagtgaagatattttgctggctagtgctcgtggttttttctctcctgctttgggagggttttccacgttaaatctcgtgtcttctgtgattgatctattattctttgtcgtttatttgcctatcgttttctaacaagtactccctccatccaaaaggaatacaattgtagcattgaaaagataatatacttagtatgaaaggtaaataacttagatgtccctcactaaatgagaagtgagaggtggttagagtaaggttgggagaaatttaaatgagatgtaattgcagagaaaatagtactctataattgtattattttgaataaaatctgaatgttatgtacaattccattttttttatggaggggataatcaatagtaactaaagcgtactgtgtatcccctagtttcctaataaaccaatcataaacttttcaattaattatatatatgaaaatggaaaggataacataagggtttacatcatgtagacatatgtcagacttgattaatacccctttagacttttggtacattatattcatgtaatatttcttcgccgcatagtaagaggtcttgagacagagatcgagagagacagagatatgatagaggaaatgtcttgttgagaatacaaacacaccacacactgctagttgggaactctcatgatctgtacctgcagttgctcaaccggcacttctctttggacacgtatgatgtgatgccattattgtagcacttatgtgtctctaggagccaaagaaatgggaggtcagctcgaagagtcgatgcttcgagcggccatccgatccacatcccagtccataccctaatcaatccccattcaagaacaattcaagaactccacacatcccaatccataaccataatcaatgcccattgaaaaacaaatcaagaaccaatatatgattcaataaacatcacacacggtattacattgattcgattactatccaggaccaatcaaccccaacagtcaagaacaacagatgaaaaacactagaaagctcaccactgtcgtctcccagcaacaggcccatgtccaagattcgaagcaggagaacctctggtgtggccattccttctccacctcccccatgttccgtccagtaccgctcccccccccccccaaaaaaaaaaacggcactgccttaattctcctctcacgacagcctccctgtcaagccgtgctagagaggaatattgagagagaggaggtgcggtggcaatgaggttttgacactatttttttcactctccataaaaaaatattttatttcgttacgataagattttaataaacaattactctattaaaatatattttagacacaaaatgatgctgtcaaaatttagattcatattgaaagtagatatttatggttatgctattgtatcacgtaaagaatatattagtaagtagttgattgttagtcaaagtagttctaatgaaacaaaatatacatcatatttttcgacggatgtctggagtatttacacaatgtactcataagttatttatacaaaaccccccacttccattttcaaagtccagtttgtaggatcactagtcccatattcatcgacaatttcctaattggtcttgtcagaagacttcactatttcttcatgaaatggcattatcaattaggtgtaataatgtgctcatttgtcatcgatcaaaacctaactaatagatcattgtcaactccatatcatatatactcccttgccctgttcttccagtccaatcagatcactccagagtacaataccttccttagctggtgcctacactacacgcagtacgcatgcatctccatgcatgttatttttttcagaattcagaaatttgcatctccatgcatgcatgtgaacgagctggctaaagactttttgcaacattctatctaacctaatgtttcctaggcagagagggtagttagatgcgtgattaatttctaactacaaatgggagaatatatactttgttcaccgtcatacaactaattagcttcatcatttggcaaagtctatacgtttcccgtgaagactaacacaagcaagaaatcaacactaagaacaaaaaccagcaccgttcatggacgtcagtgcagcgatttttttgcagcacgcgcgggcgtctgatttttcgtggccttctctttccatgaacaaccggtctgcaggtcccagtgtttcaccgcttcacgcgacgatgacgacgatgtcgacgacgacgttgattagataacgtggatgcgacggtgaaaacgtggaagtgcgtactccctccgtcaaaaaagagaaacctggtttccgtgtccaacgtttcaccgtccgtcttatttaaaaaaattataaaaaaatttaaaaagataagtcaagcataaagtattaatcatgttttatcatctaacaacaatgaaaatactaattataaaaaaatttcatataagacggacagtcaaacgttggcacgggaacccacagtttgtcttttttggggacggagggagtagaatttcactgcactaaaggatactggtggtcatcgatcccaaaaattcagtgtgtaggtaaactcagtcactgtcaggatacaaattttctttgatggtcagattgcgttgctgttgttgttgggatcgactgtgtctgaggtcaggggaaaggaaggcagccttgacgagtatgcatgccgtaattactaacgttgtaaaaattgtgaccgcaattaccgagctgtgatcgtgatgacatgatcctgtcaacattgcttttgtttgaattaacctagcttctccagtcaaagtttcagccatcgtcgacgtaggggatatacgattttgtttttgtatgtgtcactggtttgtggaatgtatcatttttgtatccacaaatggcaaaagggagaagagatacaaggtagaccacagcgtggcacgtgtgaaaacagtaatactaatagcagcataagtaaaaaagaatcagatatgttcagtatttcaagtgaacacacgaaaataatgattttgtttggctatcatgcaccatataggcatatatatagtcgttttgtttttctatctgtcactagtgtgatgggtcattgttctcacaaacggtgaaagtgagaagtggtctaacgacagtgaaaacctagctggcacttgtggaaacagtagtactaatagcggcataaataaacaaaatgtcaaataagttcagtatttcaagtggacccatggaggttttggctgtcattgtgtgatgtgtcgtactgtcattgtttcacaaatggcaaaagtgagaacaggtctaacggcgaattagtggcaattgtggaaacagtcacaaattaaaagtgacatcagtaaacaataagtcatcaaatacacagtatttcaagtgggcacaccaaaatagtacgagaagattcgtatctcagaaggcacatctgcaataatttaattccatttatttcttatacaaatcaacccaaattacgtttcaaggtactccctccatactcataagtcacaaagaaagtcgtttagaacaatatttaagtcaaaccttaggaatataaatcatgaataactcttaagttgttgagtttgaaatgtaaaaattatatgtatagatttgtcttgaaaaaatactttcataaaagtatacatatatcacttttcaataaatatttttatagaaataagaagtcaaaattgtgttttggataccgtgtcgctgttctaaacaacttccttggatggagaactgtataaacattctctctttttttttactggactggaatataaacaatgtctttgactggagggggagcaataactgtgcgttcccacgagggtcaaaatattgagaaagttcccacgcttcagtgcgtcagttttttcttgcttgtggccttcaataaattagtcaactctcaaatggaacaaaacaactgacaggcaccggttttttgcgtcgccgagaggtgtaaacagcacgtacatgcatctttcttctgccttggccggcggcagtacgagacccgattcagtggtaaaaatgctgaatccaagcttcacagcctctgggttttctatccattctcattgcctcctcgttattcaagtttctgcatagaattttctaacatccattcatgtctccgtaacaggtttctaactttcaagcacgagttctgcatggacttgatggatacgtcacaatgataatgcattcatggtcagacagttcagtccgtggtagcgacaagacgtacagccacaagcatttagtcaagaggatgtgtctgaaatattgtcatatcaaaatttatcaggttcaagagttcaggttaagactccctgtaatacattctcttcgaagaaaaataagctgatactgataggttacaggtggatgagccagccggaagtatggagggggcaatacgtgcacgattaccagatgacatggacagatgggctttagagcaacgtggtgccctttcactaatgggcgagttcattcacccattcttcagaaacagaatatgataaatcaaacaggaaaacggcgtaaatgccagaatcaatgaaaaatggcggctcatcgctcaactaataccggtaggcaaatgatggggcgatgttgtatccagctataatatgtggccttggatagcatcagcattcagcaggattactccacctctttagcatctgcaatctccatgtcagatgctttgctttcgggcacagcttctggatcaactgcctcagtgctgagatcaggctgctcgtctgatccatcaatcttcatgctgggttttacatcatccgctttggggattttgagcccataacgtaaacaaatcctctcaagcagctccttcccatccaggggagaaaccatgacgcacaaattggtcttccctttccagcaaacaatggcgattgcagaaggatccatggcgatggaatctatgttctgatgccctgaaatatttcaaacatgtttagctgtcatcaagttgtggtgtttctctataaagcttataagtgggatgtgatgttaccttcccaaagtactacaacacagcaaccaggcaacaaagctgaagcttcttcaccgaattttgcatccacaaaatcaggaaatttaatagttctgtattgtaaaaggtgctggaagtcaattgcagaagcgtagagaatctgtttggtgatgtatggaagcagcagtggtaaaccctctgaagacaacctaaatgtgcatggtgagccatcctttgatgactgtctttcctgaaagatattgcaagaatcacagcttagtgtcgtgccatttgccccactgataaaagctaaaattgataaagaaaacataaattaaggagacacttacaaatatctttaggccaagtgaggtaatcttaagccgctcaccaacttttacattgagctccaaaacttcttgcactgattttgacacgtagtatattcttttaacatggccagcatcaggattcctagtcacaaggtgaccctcaagcggaaatgtatccttgataccatagaaagatactatacttcttattgtagcttcatctttgaaaaatatcactggatcaacccctctccaccttccttggttctgtggcttcctcctcctatctcttggtcctgcttgatcattttctgcctcattaacaattactttagcttcctctgagcttttaccatttgatgtttcattatccacatctccattttgctgttcatccataacattaccatcatcaactccttgctgctgcacggtattttctttatgtggcaccttatctgatccgagacctttctcaagtttctcagccctatcctttgaaatattgtgctcgccttttataagttctgcctcttggttccctgcaaagaaccaaagatattaaggtatgcacacttgaacattaataagcagtggctaataagtttatgcaatttgatacaagtcatgaaatacatggaataaattcctaaagattaccattaataggggagattttctgaaggactgcaataaaaaatgccccactgttttgatcatgcggaacaattctcatgcagcgatgcagagggaaatttgaatgttctgtgcggatagacgtagaatttgactttttatcagagtcgtttggaacttcattagactcaagtttgctcgtctcttcagtattgggatcaccaccattattgacatcatcagatgctgttttcgtttcttgttctccctctaccatgtttgttgaatctttcatatcagcatcaattacatctgtgttgatctcaacactgccaatagccacatggctatccatggtgcccttccctgaaggaaacatgcttggtgatatcacgttctttctgtagcgagggacatcttcgtgagtgccaaaccaagaccctctatcccgtacctgcaacagttaggaaggcaataactgcaaaagaatcaaatactccagagtgtgggatatcaaatttagaggggccccccaacggagaatacttctgtgacagaataacaaaaccaacagagcagaatgcaaacaactctgactaagaaataactccaaaaaaactaaaacaatggctgctacctccattgtccttgcacaagtttcataaactgaaaagcacagtagaatatttacaaaattggacacccatccactactcttcatatcacatctaagaaactactaaaacaaacaaagtagcaacattgatcaaaacagtaaataaaaagatgttcaagatatagttgtgtattgctacatgtaaatgcaaactcagtcaccactttatccagtgaaaaactcagacagatctaatctagaccatataaatggaagatgaaccatgtgtccatgatattgataattaaaacatgtagtaatcgcagttcagcacattacagcagattgggtgaacctagggtgacttttttttttcttttttggctctaaggccacagaagatcacagtcgcagctaattatgcaaaattgcaaagtgatacaaaatatacaaggaaatatgcatgattcagagaaatgtacactgaccttccaggtgctaagtccaggacgcctgactaattcaggtagctcattagaaacatcaagaagttcaacagaatccccacatctccgtagaatctatttagttatgaaaaatatggtcaatgtcacaacaaggtacacaggacatgaaaacaagtgctacacttgaaaaatgaacattcctagatggtctaatctcaacaaaagttactcccatggtagatttgacacactgaaaacattttagggtctcatcaagtataagtgtatgacaaagaaaaaggcaacaaaaataatttgatcaatcaaacattactacttaatattagagaggggcaaggaagtaaagttaa

SEQ ID NO: 67149 - DNA, 1321 bp, Oryza sativa
  unsure (1)..(1321): unsure at all n locations
tccttactcgtctcataggttttttctatgtggacgagatttatatttaccgctcgtgtcgcgtgttntnttgttgttatttttataattctttnnnantaaccnnnccnnnccnccccaggggttttgattgcagatccnatgctcgccgcctgcaggncgactctagaggatccccgccgtcaagccgaagggtgccgccgcttcttcctcatcgctgtcgccgtccgttgatcttccgccgccgctttggtcaccggtgagtttgccgtgccgtccgctacccgtaggtgctctccgttcgcgctgtcgtgccgtcgttcgccggcgagcatgcacgcccgagccgccgccggtggtgacgtcaccgctgacgtcatcgtcatcgtctcccgtgggccggccgtggaccggtcgatctcggccattcgttttggatggaaagatctcggtcgttcgttttcgtgagccgccgccgtgcacccggttcaccgcgaaccctaaccgctgacgcaataattaccttttccttttcaaaaataattcattattgcgtcataattcaattaaaatctaaataaatgatttaatcccatttaatctttgaaaattcataactaattcatcttagctcggatttagttggttcaagtctctaaatttttctaaaattgagatctacatgttaaaaatatccacatgtactgttcatgcttttttatgtgctgttttggtgattttgcacctttctgtttagattccgacgtttccggagagtccgtttttacaggagaagaatttgaagagttccaaggccagcaaggcaagtcacacagatcccaaacaaccctttgagcatgttgatcctgtttaaagctattgtttctattcaactattgcatttattttcgaatgtcattgggtggaattaacctattgtttgttatagcccttttgttcttgattactttattccttgataccttgggttattataacttgactagttggactatatatattggttcagctagatattagatatgattgcttagccatgcttagaaacattagcacattattgggataacttatgactcactattatttaatgttggcttaatgatagttcacgatggtcaatcgtgattggttaattaattacttgccaactaaaacttgataatggtgggttgtgagcacatggttttgagagtcgtgctcatgaaaattaaggaccggttcacgagtttcggttgtgaaacattaaccgtgccaaccacaatccagcgtgggcaacggctttaccttttgtatagca

SEQ ID NO: 67150 - DNA, 24132 bp, Oryza sativa
  unsure (1)..(24132): unsure at all n locations
tagcgtagcccgactttttttgttgttcttggcaagttggcaacaccagtcatgccgaacaactgttttggcttgatgacgtggtttacctagttagtttaatcctgtttaggacttaagatgctcaaagtgctttcaccaggttaaattatcacgggcaccacctaaccaccaggttttgttgggttaaatttgcttatcaggtttttgacgaatttatataaaaagatgtcctgttcttgcaggtctattacatgttagacctgaacaaaaatgctgaactactgaacttctcaggctgcggtaaaaccatggttcctgtactcgtatactaatttatttgggactttactctatatcaataactgtttttactgcaatctaatactaattctgcttttgcttaagaccttaaaggatgtaatatatctcagttttacctatggacatccaaataccaaattattaattatattttctgttaagcctttatttatacagctttacagctggttacttttaagaaaaatgctatgatttatttctgaaattactgcttgtgtatcttgctgatctaacatgtttaatgactagatacttacatatcacatgatttgttcaaaattttgaaagtgtaattgtttcacttttaagtcttaacggtatgttttggttcaacctagggaatacactgaactgcaaccatcctgttgtcaaggagctcattcttgacagcttgagacactggtatggacaacttgcagctaagatttttctcataaatccaattgtgtgtagattcatccatatttctttgtttcatcttgactatgtcggcattattcataatcaagtgtcaaaaaatatctatatcgatttgagctttcatgttggtatgatcagaccaagatgatgtatcgacagcctaaaattattcaaaatttcctctaggctatagcacatgcttgtagctatttggcttgtagcaagacagttgatatatgagagatagttcatggctatgtcttattgtgaaccttggaaaacaagatagccagaaactgcaacaaaaacagttatttttatacaaataactgaattatagcatgcatttttattttctctttgacaatggttttgtcatatttcaaatgtcatttctaatctccatgcttgttttaatgcatcaagggttgaggagtatcacatagatggatttcgatttgaccttgcaagtgttctttgtcgtggaccagatggttgtcctcttgatgcacctccactcatcaaggtataatgtagatgcagactttaggtttgaacactaaatatgtatggctgcttaccaagcctgtgcagaccgaattttgtttgtctaaataagtgaatttaatagatttcatgtaaaaacaacccgtacgttacattatatggatgattggatgcaaattatgatgtactgaagtactgaacttccagcaatcaattctaatcaactttgcactattgttgattgttttcttgtttgcatggttttgttcattgaatacatatctagtgcaagctcacaggaatgcaatcatgaaaatttgcaatgtgggcagctatataagatacagtatggactagatgtagggctcttgaggttcatttgaaagtttttttagtgacccccctcaaacgttagaaaattgtatttatgacaaattccaccttttcaagaccatctaaatcctaatccatcaatctctggtcatacaactcacgttgatgtatcgagactagtggcttttatgtttcttcatattaatttatttggttgtaggaaattgccaaagatgctgtattatctagatgtaagatcattgctgaaccttgggattgcggcggcctttatctcgtagggcgtttccctaactgggacaggtgatttgaacacttctatatttctataaaaagaatttggtggtatagatgttttatccttgcttcttttaggactaaagatttggtgatacagtaacacaaaacagtaactattttctgttatggataatatcatgctgagatgctcattcctaaagtacttaacaactgaattcttgaaatgagagaattattgctagtatcacttttctcattggacttggcaaacatgcttcattgtgcggttcagtgacctttccctaccatgcatacacagatcagttattctataatgagtttcatttatttttaaaggtatggtgatcatgtttaacattcctcttgcaggtgggctgaatggaacggcaaatacagagatgatcttcgaagatttattaaggtaatatgccgggagagaagattttttagaaaatacagataagaaaaattgtactcacctgcaatttatggtagagatttcatcatggcagtatatcaggaattactgctgaggaataggattgttatgcccttatgctaatctatcattcccttgcctcatccctttctgccagagtattttaattaaccatgccataggatagttattttactgagcatgttaatgaagtttagcttctcactgtacctatatttagttttaattgtccttgatggtgtatgaacattagcggcaaacttaggttattgtggaacagccaatggctaggaaacatggagattttgttaaatgtttaactagatataggatcagtacccttgcaaaatcagtattttatttaatttaatgggcaattctgaagcatacgatcacagttccgcatattatttgagaaaatggcaacatacttttatgcaatagctctgtaccagttgtgtaaagattaccaggttactgaaacataggggtagaattaggtggctgcagtttcccaaactctgatcttggctatccataactccattcttgagccaaatatttagatgatctccttcagaacttgagcataattttttttaaccatttcaaacatcagtgagttttttcaactgaagatctgaatttactgaacattctgcattttatcagtgcttgcctagcatagccatgagaattcttctgtttgtgttcttttattcttgtttctataataacgaccgaatgactgattggatgctgctaaacatttggagttgtttctcagggtgaccctggtatgaagggggtgtttgcgactcgtgtgtctggatctgctgatctctatcaggtccccctcttttagatgttattttccctttactgttattttttatccatttgcttaggatatcgcttgtttttgaactttgatccccccccacacacacaaaataaataaaataaaaatccatttccaaacaagagcggcttccaaagttattgctaataagtttaggtttaattacatgcttgttacttttgtatcactgttagagcataggtcattatcaacatttagcgtgccccaaattctatcatgtcaattgtgttagttcagtaggatttctccagtatccaattgtttaatggatataaatgtattcagggtctagtgacataccatttgatagtgcaaaacacagtatggtatgatgccacctattatttcattttgtgaggatgtgtaaggaacctctgtggacaaatttttaagaactactgttacactgaaggggttcagactcagttattttttgtcaagaaacaaaaatatgtaaaataaaattcacctgatgtggcaggtgaacgagcggaagccttaccatggtgtaaattttgtgattgcacatgatggatttactttatgtgaccttgtttcttacaacttaaaggtaactggagtaagctaagcagtttagttaagatcatttatttatactgtgaagtgtatgctaatctgccttctttttatcaaaatcatatagcacaatgatgctaatggagaaggtggctgtgatggatgcaatgacaactttagctggaactgtggtgttgaaggtacctgctttaccgaatatctattttcttttgtacattgaaatcatgattccatgaaactgcaaaaagatgcttattttcatatcccatcaaattgatacatctgactgatgtagggtactgtaaagatagaaaacttggtcgagtttattattaaaacaaccctttgtatgaattaaaggtatagtcataaagagaatgacatagtttgattttgttgaaatttagtgtcttgtattgattttgttgaaatttaatgtcttgtaattcaacagaactaaaagattgcccctagtagtgaagcttcaatgtcaagatggatccaaatagctctatgagctgtgcagaactttccaaatgcaaccatagatggctatccctctttgaatcagaaataattatttttagggttaattggatccatgccactgcaaatgtggcaaatcaaaaaaatgccacacatatttgcgttatcggctggatgccactgcaaatttttaaaataagaaccatgccactccatcacgatttccgtccaatccgtcacattttccgccgtctccgtcttcgtcctctcgtcgtcctcgtctcgacggcagcaccagcacggcagtacgaaggcgggcgcggatggcagcacggcgcacggcggcacggcagcacggtggtggatggcagcacggcaccggcgacggtcgtgcccgcgtccgctccccgcgcccctccgcgacctcctcgccgacttcctctctctccaccgttgcagccgtcgtcgttgaccatttccgcggtggacccgccgccgttgacctcatctgcgcgggagagctcgggagccgccgccgccgttgctgtcctcgtcgtggtcgtcgacgagccgcaccgcctccgcccagatctggcgaggagggccgctcgtcgttgctgccgatggaggaggcgtcgagcctcgaactccgccgctgttggccccaagctttgtcactagtgctgccgacgcccatctcctctctccacatgaccatcctcggcagcagctgcgccccctccgcgacctccccgcgaagcgtcctcgtcggcggcggcggcctcgctcgcgaccgtcctcgccggtagtggctatgcccgcgtcccctccacggccgtcctcggcagcagctatgccccctccccgacctccccgcgagcgtcctcgctggcggcggtacgcccgcgcccgcctccgtgaccttcctcggcggcggccatgcccctccgcgnnnnnnnnnnnnnnnnnnnnnnnagatcgatggttgtatgttgattggtttagttagctagctagctagcctcgcgcgctgcatctgtagcagctagctagctactccctgagcttgttgggtgtttctgcctgagctccattccgcgccgaaccccgtcaggcccggccgcgaccgcgccgggctgtcctccgcccgtgccagccgtcgcgccagctccccatcctcttctccgttttgccgcgtgaagccgatgcgttttgtcgcgtgcgcctcatcggcttcgactccggtggttgagctgctcacacgcgtccgggggcagcagaagtgagagagagagagaggaggacggaaatcgtgatggagtggcatggttcttattttaaaaatttgcagtggcatccagccgataacgcgaatatgtgtggcatttttttgatttgccacatttgcagtggcatggatccaattaacccttatttttaacctaatgctatgcgaaatgtttgatgttagaattgatgctcttgttctgtaacaggagaaacaaatgatctgaatgtgttaagtctgcgttcaagacaaatgaaaaacttccatgtagctttaatgatttctcaggtaaacattgtgaagtaacctacagtttattttatgtgtgcatcatgtataaacttatcacataatcaccattttcatatatcagggcaccccaatgatgttgatgggcgatgaatatggtcatacacgttatgggaacaacaatagctatggacatgatacttgcattaataatttccaatgggaacaggttgcattaccgtaactattttagttttcaaccaggaatatgtttatgaatttggcagatctatatataatttgttttctccgaatccatgtgaatatagttggaacaaagaagagatggccatttcaggtttttctcagagatgataaagtttcgtcacagcaacccaatattaagacgagacaggtttcttaataaagtaagtaatacctagaagtgctatcattgcaattaactggtttattgaagacaatcatttcatcatcttctcaaaaaatagctgctggtgtctgtcgaaattccaagtatattttctcagtcaagtctgattagaatagtataatacagcaaatatacactttgcagcttttgcagttgcatctcttagtttttttttcgtctcaaatgttcttcattgtattgtgatcttccttgttggtagaacgatgtcacctggcacgaggattgttgggagaaccaggaaagcaaatttttggcattcacgtaagtttgttgatcactttcgtttatgcaccttattatggtatttgtttatgatgctccaaaatccaaattcttggcttctgactttcattgccattttactgtagagtacatgatcacaactctggtggagatatctatttggcattcaatgcacatgactattttgtggacgctgtaattcccccaccaccacaccataaatgttggaaccgtgtggtatggatacttttcagcattgctaaatttcttacgtatagtaaagtaaattcctacataatcctagcatggtgtggttgtaatttctaaatatgtagaagtgctgccagtactcattctgaattttactacattagacgctcggacaaataccaactcttaaaagaagatatacaagtttccacaaaatttctcaggaatagacataggtagtactgatacagttctacaaccaaaagctgtatacggttgttacttgtgctagcaatcctgctaaaactggtttggagtttattgctcattagctacttttaatttttacaatgattggtctggctggatttgatcactcttttctcacacctttccgctcctattgtcattctaaatctgctctaataatctttttgtaggtggataccaacctggaatcaccaaatgatattgtaccagaaggggtgccatttacaggaccaaaatacagaattgctccatactcttccattctgctcaaggcaaagccttagaaaagttagtagttgagagcataaaaataatgccaccaatgctggcttggttggttaataacaggttgatcacattagcagtctgcacttcaaaaaggcaacaggtatagagaatgtctaataacaactgccgaatcatagttggctttggcagatgaggccacttttggcattcaggaatttcttccagttattactgtaggaatgaatgggctagggcttagggccctctgggggcagcaaagctcgaggtgtcgtctcggtttcatgtgagcgtgacctggctatggtcaccctatcatttatcaaggtcctgtttcgtaataatgtgtcatcaaacactcaactcccatgagaatgtatgccagcatctattttgctggaaattcatgaaaaaaaggaacaatgctattagtcccatgaagtatgaacatatgtcagtgtgtatttcttgcatgatgcagaggctgcgatattctgcgcctgcacctcccggtacgggctgcggcggcaggctcccgactgacggcgaccccggttggtacggagggaaagcttccacatgtgcaacggcggcaagctacagtgttcccaggcaggcaccaacctgttctccaatgcagccaagagaagagccagcttcgacttgacaagataacatggccatttgacagagctgggccagccggtgctgctcttaaccaaggcatgtgaaaggttaactcgcctctcctgccaatctcacctgaatatcaagcgcctacagtgcagcctgagccaggtaaaaatccctcctatctcaatcattgtcaaccaccttctatcagctaggttccaaacagaggggaaggaaatgaacggccggtgtacttagctcagctgtcctgttgctgaagggcccagaccctgggggtgggacatactactcctttgcaagctgtgggctgtccttatgatttgctagttatatatgtcgaagggcagccgctttattagtgctaaccaccttttagtttatggagtatggaatttggcaacctctttaggaaaatattcctaatcattcatcaatgaccaaggaaccaccctagtgcataattatgtcagtctggtttcccaactggctttcagggggaatatataagtccttcataatcataccaactgctaaaaactttacactgctagtaataaaattgataacaagctttacacagcttaatttgctggtagaggttgaaccctgtctggtggagcccggcctgaggttttaggctctagaaaatagcttaattaggtaccgagtcaaggtgaagatagtgtggttgatccaaatccagccttgctccctaagttcctcaaaattactaaccggcgccaagcagctgaactcaagctttttcaataagaatttagtgaggtatttgaggtctcaatataccttatgtcagatagctgccaagaaatacaagcaagaaaacataacatatgcccatgcatgtcacaccttcataactccaagtatctagattcggtactattccttttgaaatactcgaaccacccaacgaattggttattcctaaacaagtcatgaaaggaatgacgaacatacggataagatttactatcaacctctcttttcgcgttttgttaggggcacactcacagtcacaattcatcttccgtataatcgagaaagaaaaaacactatgcaaatcactaaatagagcgactcaacatgcttggggataaagatactctagtgacctgtatgctgacctctaccagactctaacatccgccgtccacgcgtcatcgccgaaatattccaactgtaccacaccatatacatacatactacagtcaggacttcatgggcgtacaggccatggacaacatgttggcacaacttatatgatcttgcagagactttgtggttgtcacgtagccggctcggcgccacgaagtcgtacgttcacctggtaggatagttggtacatcggtgtcacgtagcatgcactggacatccctgctggaatattacaccctgggcatagcccacgttgatagaactgatcgaacgaactcgtgcttttgaagatcgatctgctgttcttaatttggttgttaagttggacagattgcgatgtcgatcattccatggacgatattttcggatcattctgaagaatttgttttttagaaggatcataccgaaacatttgtagcaactcatcatgtgcgacaacaataaaattgtgattttgttgtcgaatccggaaggttggaagcgatgccaaattgcgcgtgatgttcgttgctctgaaatgcaaggtttcttgcaacgggcctgcttggaataaggacgaccttacgctgctcaggaatatgaatattgtgatggagtggaagtttaggtttagtatggttaggctggaaatcactgaaattatcttgtggatcaagttgaacattgtgaaagagtagagttttaggttctggaaggatttaggttggaagaaactgaataacactctataccttcccttttttgaaaagcttggatatactatatactttatgggttgagttgagttttgtgtgggagtggaactaaaggttttgggagggttcggttaggttggaaagtggaaacaactgaatttatctttgggatgaagtttttagtattgctaacacaagaaatgttatgaaaataaatacacagcagatacatgattcttttacatgggaaactcttacgaaaaaacaacacgtaccaattagcaatcatcattatttaggagttggttacaaatgcatgaaaataattgtataacaacactcctcccgtacaacatacaagaatatatataaagaaaaaatcaattataattggtaaagatttgaagttctattaaaaaactaatcttgtagtaccactgttgtaagaacacattcttcataaggggaaaaggaactttttaaaatcttggtgaacacaaatgagaatagaagaacttgtaaaccaatcaaggtgcatgtgtcaacttggttaggaaagtacattattgggaaataagtttggtactagcaagatactcaattccttcttttgaaatcttgtaggagtatatgtcggtgtgttttgtgcatcattttgttctctcgaagaaccaaattattttgagagaagggcaataacaatcaatcatctacagattcatcaaataaaaattagagaatgcatgcaacatggggcttcattgattagtttccaagccaatcatgtcctttcaaaggatttcgttaggcaactaatcttagctgggatggtgccatcataaactaagcaaaccttgactgttttatgttatctgcgagcagtagcagtcgtgccagcaatttgtcaagcctggttagtctcatgaatgtttttcccgatattatcagtataaagatttgttggtatgaaaataatcattcaggctttccactaaaacaagtgttggatcaagatcatgcatactactataaaacatgcgcactgtttgcccctcatgaaatttgaaaaggtccacctattcgtactagaatatttcataatcggccgtgaaatttgatgaagtccacatattagtactcgaatattacaacaccgctggtactataatctttcaacgtttatcatcatcaaaaaggaaaacggtcacatggctatacaattgacggtatgattttttttaaagtttcgacttgtaaattttctttaaatcattggatcgtgttgagattcatggagggaagggaagaaaaattcccatgtcacttgtgaggctaagagtgtcaaaccagcaacctcataggtaaaaatgtgcctcgctagccaaccggctacgcatggtttggtttttgtttaataatatgagagttttgtagaacttatattgtaattataatatatttacaatacaattacattatgattattatataaatagttacttttaaaagtttttcacttgaatattatataaatagtttctttatctaagcttcaaaaactaaaattaggtccgaccaaacgtttagtaattcacccatattcataataggcaaccccaataatcacgcaaaaatatataaaacaatttttgagatagaaaacatgtgagaaagattttctacaattttgaggagcttccagcctcatctttttcttatacttaaatttgactttttaatcttagatttggagttaattttagatgttttttcatcgtagtttattttttaaactttgttttttgtttttagatcgctaaaaacagtatataaaagttttatatacaaattattttttatttgtaaatatactgtttggcttatacccccaataatcccaacgatggggccgtaacacacttgggatgattcggatgaagcttcctgtctccaggaaaagaaaggtttaaaagcttgcaaaatccaaaccgacaatctgcaacaaaactgcatctcgaccgtcaaattccgatccaacggagagtgttggaaaattagcactaaaccccctgataatacctgtatttttcatgtagtaaaccacatctcctacagttctacttctttataagctcccctacctctactgtctcggacaccattacagtacaccacctcaagctagtagccaccttctccccaagcacacactctcctcccaaaccctagcaccagctagctctctcactctactccaatggcgcgcttccagatcgtggccttggccatggcgatgctcttcgccgccgcatcagctcaggccccggcggccaccccgacgcccgctcccaaggcgtcccctcctccggcgacgccgccgccgacgcctgcgccggtgtcagcgcccccggctcaggccccggccactcctcccccggctccggctcccgcccccaaggcctcagctccggctcccgcccccaaggcctcggctccggctcccgtgcccgcggccgcggctcccaccccggagatcagctcgccaccagccccgtcaccggcaggcttggccccgtctcccaccgccgaggtgacccctccccccagcgccgccgccggcgtctcccccgccgccgcgtgggtcgccgccgccgccgtggccgccgccgccgcgttctactgagatcgaggctgatgagatccgccgaccacctcattaatttattacccgtccatcagagggacccaccattcctcctcctcctctcctgatctcctccttttccttcttcatctgtggtggtggtgttgagctgtttattttatttctctctctatcttttttttcttccatttttttgggcattttttttccattcaggcattcgattcagtaggtgtgtgggcgtgtggcgtggacagattggttggttgggttggtgttgtgctgctcctccattgtactatacatctcccgttgttcaatattcctttcactttggactttttactctcttttattttccccaagcgcactcaccccatttttttaatctttctccattaccccttgcagcatcatcgtaccagcagatcagatctttgagcccccgttttcgttgggttatgtacacgtactgcagccgatcgatccgttgctgtaccgatggatctgagctgatgatgcactcactgtgctccagatctggtcgatctcctttaatactcccatctaaaaataagaggaattattggtacgtacgctggcccagtatttcacagcatttccggtgggattttcgctcagctgcgtcgatcccgtgaggtgaaaaggcctgtagctagccagctggggagcagcgaaaggcagcgatagattacgggcaccgggtcggtcggtgggggcgccgcacgatggcgagatgtcgagacgaggcgaggcccgcgcggcacgtgccggtggtggtgcccgatcctcgcggcagcgacagcccgcagacggcagaggcggaggcgcaacgcgagcggaggcggacgcgacgcgacgcgcgcgtgggtttcccggtgtttttgctgtgttttttctcccgtccttttcgtgcgggcggcggtttgcgcgcggtgccggcttgcggctttatttagctgtaggcaagcaaaggggggggcagcgtcacggacggctgcgtgcggcgcggcaagcagcagcacagcagatgcaacgcggggtcgtcagctgtttaggtagttcgttctctctccttttctaacttttactcactcacgtccaaaaaaaacaatcgatgtgaatgcgatttcagtttggttgtactagctaaagtcacatttttacctaaatagttttatttatttagggatggagggagtactcgttagtttttcacacgcacgattctccaaacaatctaaataatactccctccgttctaaaacttaggtggatgtgacatatcataaaaccatgaatatggagaaacaaaatcccttatattttaaaacgaggtgaatactttcttttaaaagttatttatagaaatgttggttgaaaaaaatcatattaattaagttttaagttttttaagttaacttctaactaaccatgctgtaattagccacccacgacaagtgtaatcgaacacagccgcggaacggcggaagcagagtggtagagcgcgcggtctgatgagatgtgtgatccgacgacgatggtacaaacgactcaacgagccaggttggtggtgaaagggatggtacgggacgataccttggtacgtgtgcacatgccatgccatgtgtgtgtcgtgatcgctgttttctactatcactactgatcacgcaaatgatttcggaggaagggaatgctgtgcagggcaaccaataccatacatcatttcactagctttggcttctgcccggttagaatccgggatccaactgtgccgtcaaattcatgcgttccaagctaagtaatgcccttgtttttgcaattcatgggctaatcgacgttgaggggaatgatgccaattgtctggctgcctgaatgcgatccacccacgccatcttttttttttgtgacctgacagctcctcgccttttagtgcgagcggtccttgtacgctcgctttacaagcgtaatgcatttgcttaagctagccacacagctcggacgcaacgcagggtgaccttagctagcatatcacgcgttgctgactttggagctgtaaagaaacataaagaagcagctgattggggaattggctttcctgccgccaacgacgatctctctcacattctcactcagtgatgagggggggggggggggggggagagagagatttcagcatgtgatgagcattatttcagcgaaaccaccgggctgtgcgtgtagatctccctttttctagcttcttcagcctgcacccacgaacacactgaaattctgaagctgagatgggatttatgggacgagaggtgcagctagtagcagatgttccgttctgccgtgagattgaggggcccacctgtcggccgccgttcagggtgggccctgtccggaacgtgtgacccatgtggcgatgcgatgaagggagaaagaggggccaggagcatccaaggtggtaaggctcacagtacatcgcctactaattaacaggccgtgtttacctttggtggttcgatgtggtaaacaaatggccggccgtccaggagagatctgaaagacactgggggaactgatgcgaaccatctttcagagtttcaggttctatcactaacgcttttccagaaaaggggtgacaagaaaaggcagagtaaatgttgccaaattggtgatcaggttggtctctgaatagacaaatcttggatgtcctttgtctaataaaaaaaaatctagtttgaagttagggtatgtacaatgctccagtctgatgtgtggttttagcttggtcacgtaagcggtgagctgccttagaggagagagagagtgtgtaaaactagtgctttaagccttgtttagattaaaaatttttggcataaaacgtcacatcaaatatttagacacatgtatggggcattaaatgtggggaaaaaaaccaattgcgcactttacatgtaaattgcgagatgaatcttttgcgcctaattacaccataatttgacaatgtaatgctacagtaaatatttgctaatgacggattaattaggcttcataaattcgtctcgcagtttacagacggaatctgtaatttgttttgttattagtctacgtttaatactttaaatatgtatccgtatacttaaaaactttacacccaaaagaactaaacacaccctttaaaaaacaaggttgtcctggcttgcaaagatacaacacgagcaaagacatggctcaagcaccatattcggtgaggctatactcttcacaaacccctcccttccgagtagcggtggctagaaaaacgtgacacatcaaacgggattgaacaagagaactagcacggtggaggggagaaaagaggggcctagttggtgtgtaccacgatcggctcgttggcgaggtaacacattcatcgactatgaatcctgaccgtcatggatcttgtcagcctaagtcgccatcagatccatgggagagagataagagagaatttatacataaacattataatttttctttcttgaaggtcataaactttgtaaatttataaactgcaagagctgtgagcacaacggctgtcccatgcgtaaaaatatcaattttgctatatctcactcgaaagatttttttcttatctctcactcgattttctcactcaaatttacaatgcattttcttgtaaattacagtgtaatttatgaaacttgcactgtaacttttgtaagttacattgtaatttttgaatcttcgcatgtaaattttaaattttgtattggatttggtttttttcttgaggatatggtaatttagtgtccattaaggtgtttcttaattgcttttttctttttattatatctatcggattttaatccaaagattaaaaatccgtgtgatacgatcataaaaatctttcgaaagatgtataggtacttcctaaaaatatttgtttcttttcatgtctcactggtgggcttacaaaggctagcgttcatacaactatacaaggcctttcttttgggctttaatactatattaggtccatttatttcttttattgcgctcgcagtaatcgtacaaggatctggcatatcagcgtatggatatggttgcatttgctacgagtttttcatacctgaacctacgactaatgatcaataacctgactagacactactttccttttccctttgcaaacctgaatgaagattcatgcttacagttcgtagttgatcagaattaatgcttctgaattgaagttctgttccgtcccctgtaacttgacgtcacgttctatcttagccctatcttttgagagagttggcgatgcaagcgtttgccagatgacgaaaagcacaagagttctctgaggcaatctagggcaaattgggaaaagcaggagccttttgcagacagcattagagacttctaatataaccacgcgtatgcatccaacagaccggttcccctttcatcgttcatgccctcgatttttctttttgtctgtgattctacttttgccccaaatgagccgcccaaattattctcacctgagaaaaaaaattatttcttctatctgcaaaacgcttatgtcactcgacatatataggcattctttttcttactcgacatagagaattttaagcttgtgtgtctatatagtaagtattcctttcattcacagaagttacacctattacttttgtcatcaagaccaagaagaaattaatcttagatgttataaaatcaagaagtaaatacaaacatacaaccaatgagtatttagatgactccttgggttctaatcaaacatttaatttatctcttcatttaagttttgaatatataaagactaccaataggaacaatttatttcaaaaactcaaatgtgaaacatgtctaacttttatggatggagggaataggttgtaaggcttgtaacctatcgattttcattttttcaaattaggatttgctatttgacaaattgatagtgttgtaggccagtacgacactaatctaccgttcaaatcctacatatatacccctgcttttggcacaagtgggtgtcttcgacatttgatttttttagttcaaaagtttatctttatattagccaccatgtgtgttgagcctatgagggactacatatgcatgcgcagaacatggaattttactgtgcatgtacatcttctatctaattgaatacagtttgctctttctgaatcactttgatgttatttagcataggaaagcatctacacactacactgcctgacaaaagttatatatttactgcaataaatcccagtaaaatggatactacgcccctcatgcagatccccccccccatatatatatatatatatatatatatatatatatatatatatatatagtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttggtagattttgattttaggtatatagcatctatacatataattagttaggtatgtaatcatggattgtgaaataaagttaaatttgagttgttttgttgataggtataggtatgaatcgagttattataactaggtatatactcacaatttgaaaattttgaaaaatttgtgtgattttgtatatttgataccatggtgcccgggcaccatggtgccccatatgagtgtcctatattatatatatatatatatatatatatatatatatatatatatatatatatagagagagagagagagagagagagagagagagagcttacaaaacacttcgcatggcattgttcggttctaggttgctaccattcacatagcagcattatttgagcaaactcttttattgcatgccaacttccaacagcgaaaatatgttcctcgagcataaatacttttttttgccaaagaatgaaggttgggctttccttctgaattttagggaaactattttgattcctcgaggggatgcctaaaaaccatttaaacggttataaaaaattctggaaacatttgacaacactcatagaacatatatatacaacttcacaaaatcttaattaagtccaaattcaactcacacgtcgagatataaaaaagacaaattcagcgtatgaatagtagcgtactgtttatatctgaatttgtctctttttttttctcgatgtgtagatcgaatttgaacttgattttcggtggactagtagatatcactgtactctatattgtcaatttttttcagaatttttcataattatttgcattgaattttaaagaaaaagatacacgagtggacatccactcgagagattagaatccacttgtgttcaacccagtggcggatccactgttggggctggttagtgcgccagccccacctccaatccctgcatccaatcagctattagcaattataattaatcattaattagtgaaaaattggccggcggcaaggcaagctacttccctacttcttgcagccaaggccaaactggcaaagacagatatattttatttatagatcattcttagtagaccatgaagtacctatttattaataaataaatttctttagatattttatatagccacagcaagttgaaatatagagagaagtgtgttcttattcattcatgcatttgcatatttgggttatatttacaaaatatttttgttgatatagttcttgtttgtctcaatcatactgagtttttcatagccccagctcattttgcatcctggattcgccactggttcaacctcagttaagcatagaataagggcctaggggcacactcatgcgcagggttttgcaatgccttcttttaaggtgtgaaaaccggtcgttgtcagtttgcttaaaactaagcaaaatccgatgatttttggttaactctgtaagagaatcagccaaaaccgatcccaaacagtttcataaaaatggtgtggttttcacgatttctgatcgatattgcgatggaaccatttcatttgagatcatgtctttcatataatagaaaaataaatataatatcttcaaagaacacaaatagtttgcaacttggcacttaggtgtgttggacaagcttgggcatatataattatggacacaggaacctattttaaattcgcgaggggacatctatcacctcgttgtttgcatgtcattctgatggttatgaaaaaattgaaaaaaaatcaacaagatacttggttaataagtgttaaataactccacaaacatataagaccaaatttaacttgtgcaagttgcaacgaaaaaaacaaattttattgcgaatatacgttaactagccatagtttaatttgttttttcgttgaaacttgtagaagttaaattttaacttgcgtgtttgttgagtgaattatcatatactaatatgttttgttgatttttttttaaaaaaattcataaccatttggatgtcatgcaaataacgggaggataacccttcgagagtttagaacaccaacggtaaaaagacgtgtagtgtgatttgctggaggatagtaaagggaaatatttattcttaaggccttatacgtttattctcataagaaagggattatatagaattgcaggggatttagtgtggaattaactaatccccttgaaacccccttaatctagttgggtgactgaggattacacaaacaaggcctaacaaggaatttttttttagaaaatgaattaaaaatctggcttctacattcacttggatgtatacacccaacagggattcaactgctggaacaagtatagagagcaaaggctaaagttgaggggtcaagctgtgattacaaaggtcaagtaattaaacttcggtatagttatacaaccacgactataccattaccaccagcatgtttttaacatgcttggttttatttatacccaccataagaaatttcaccaacacaaaccatggcatgcataaccagagcccccagacacgacgatacaccagtggcacaagcaaatttagaatcaccacaacaaactaaggtgattactacatacgagttgcacggtgaccaaatcacacgagaaacgagaagaaacacggtcagcttcattgcacgagtcaccaacgtgcaacggccgatcgacaagaacctgcatggcttccacgcactgtctctaccctggctcgcatgcaccgcggccatcagaacagcgcgagcttgatcagggcccccgctgccgcggcggcgacagcgctcgccgccgccggcgaagaggcggcagagtacgacgggtcaccgttgacgttcacggcgagcttcatgccgctgctgcagtggccggggatggtgcagatgaagtagtgcatgcccgggtaggagagcctgatggtggtcgatcccccgttgtcgttgctcagcgggctgttgccgttgcagctgtcgaagttggtctggctcacctccgtcaccgtgtgcgccctcgcctggtagttgaacactgcaccaacacatgtgttttcccagcacgtaggtgtgtgtgagactgtgagtatatgtgcaagcgactactccctctgtcccataaaaaattaagctagtactgaatgtgacacttactagtactatgaatctagacatacatatatctagattcgtaatactaaaatatgtcatatttgattctagattcgttttttatgggatagatggagtatgtattagtgatgagagaaagctgagctttgctcaccgagttcgtctccttgtctgaaaaacttgccgttggcccagttgttgtagttgacgccggtcgtccagccctcgccgtcgccgacggtgtacctcgtggctgcggccaccgcggcgcaactcacgacgagtagcccaacgagaacggctgaagagacggccatttgtccaatgatcagaaaaaggctcgggaagagttgggttaggcacttggagggagagggagataaggatgtcagatgaccaatctcagctatactgttgctgctgcacatttgcccggaggttgtaggcagggtctatttatacgcacggccagagaataagtcaagtgacaaagtacagataaagagttggccaatgtcgaattgtcaatccccttttccgatcggattctttctaaaaaccactataaatttgctcagatgtgaaaaaaaaaagtaattggaatgcctttggtgcaactcaaagcttccaggaggtgcagagttgtttcagtagctggtagcattccctccctctgtgcagtacacgcagagtcacacccccgtcgcattattttttccatgataggaacatataccacatttttctagctgcaaataagcttttggacaagcaatccatgtatccacggatcggcaaatgaaaactgaaaaggagatgttacgcagctgaacgacgctttgctggctgttcagggaactgataccaaagcgccagagatacgatcaaacaaagccatggatgggttaggtgatgtctacggttagctttgccgcagctctctgaatgttccacacacggtgatgtgtctctctgcaggacggacgggcggacgggggcagctcgatcgatcggatatcgagcatactagcagtagtccagcactgtttcactttcgcggtttcacctaatgcgctgaccggcgggtgagtggtgcagaggacaaacacgccggaacgccaccgggtgcaggtacatgacatcacggccggctcacagcagcgacgctagataaggactcccgagctctacggacaccggtgcagctgcaaccactgcaacccctagtacagatatacttgttaccaagattcttgtgatctgtgtgtagtatgtacatcagcaatggctgctcgctgacgctcttatcggagacggcgaaactttcgccaagatgtacgggttcgaaaggacaatgtgtaacacagggttctgaatttctgatccccgtcaacctcgccgacgtaaggggggcggtggccatggcgaacggtgtacttccgctgacgatggatgtacttcgatgtcttcgtcagaggacgactctgcgtatctccggcctccgaccggtgccgcacgccttgtcaaattgaccggcaggagctctggctgccggtctcacgggatgcgatcgatgacaagggaagacatggaggtggtcattcatcgaaccggcgggtgttcgccgttcgcggtgtcggttaggggacacatggcggcggccatggtgagttggtgggggagggaggaagacacaattgggttcacaagcgccgtccgatcgagcttccatggccacgatggactctcctgggcattctttcagttagacaccttagaaacatgttaaattggtacccgtagttttggatcgaccataatagttgggccggttgcatgcggcccttgaacgtggattaagacttggaaaaggtacaccgaaggtccctcaacttgtcatcgggattaaaaaatatcctcgaaccgcaataaccagatatacggtgtcccttaactatgcaaaaccggtcaccagaggtctttcggtggttttaacccagtgttggtctacgtggcggctgagtcaacacgggacccacgtgggccccacatttcaggtgtccacgtcagcgtcctctccctctttcccctcttctctcccttcctcatctctctctctcgcttctctgcaagttgacaacgaacagatgggcggctgccggcgaggaggatggcgcgaccggcggggagaagggtggcacgagatggccaactgggacaaggggaagggagaaggagcggcgccggcagccgatggggacaaggcgaccggcggggagaaggatggcacgcggtggccaactgggacaaggggaagggagaaggagcggcgccggcagccgatggggacaaggcgaccggcggggagaaggggcggcgcgcgggaggaggcgggctgcccatgacagcgccgcggccgcgtggggcgttgcctgcctccaccgccgtccgccgcgcttccgcttccgctccactctgcttcgctcgcacgccgcctccgctggccgcatcctcccgtccgcactctccgccgcggagagatcgagtgccgccacatcctcccgtccccccctctaccgactccctcctcgccgcaacctcttcgacggagagcctgacgaggccaacgggcgtgaggcgggagaggagatccggccgacgacgcggtgacgggcgaggccgacgctggcgccagcgccgcctccgcctgagctcctccagcgtcgcccaacaacatcgccttcccggtggtcagcggctcggtggcctcgtaaaaggcgaagtagagcaataccaccgctgatgcggcggccgccgaggccgagaacgagacggccgcgaggtgggcgtccagggagatgaggagggagcgggagcggcggagtccaaggagcgtgagaagaagaagagggcatcgcccacctcgaacagcgcgacagggatgcggatgg

SEQ ID NO: 67151 - DNA, 3061 bp, Oryza sativa
caggttttaattatcaaataattatcataacacgattaaccatcgtgagctaccattaaatctaaccataagtaataatgtaatatgattcatcccattaatgagctaatgtttctaagcatggctaagcaattatgtatatagcatttagctgaaccaaaccaatatataaggttcaagctaatcaatttattacccataggaaaataaagtcatcttcagccattaattaattaggaaaggctcaccacccaatgacattcaaaattaatgcataagttgaaataaaacattagctttaaaaaggttcaacatgctcaaaaggttgtttgggatctatgtgacttgccttgagcttcttcaaacgcttctgaaccttcctcaacgtaaacgctctcctccggaacgtcggaaactatagcaaatgaacaaaatcaacaaaatagtacaaaaacaagcataaacagtacatgtggatatttttaacatgtagatctcgatttaagatgaatttagcaacttgaaccacttgaatccaagttacgatgatttagttatgaatttccgaagtttaatcacattttcatccaatacagaaaattagtacgatttatataaaagatttatgatgtcatcacgacatcatcgccggccatggcactggaccacaaggttaccagcgctacagagctcggttgggctttccgaagacaccaacacgaagaggacgacgacgcgaactcaccgaagcaaagaactacgacaaacgacgactgacgacgaggtccgacggcggctcggctcgggtcaacgtcggcgacggcgctccggcgagatgcagcaacggcgaaggggcggacgggatgctcctccacctggcgaactcgacggtggtgacggaaggcggcggcgacgaccacagcagcggcgcggcgcggctgaagcagcgacggcgacggcgacgctagggctcacgtggtggcggcgctacaggcgacggctgcggcttggacttgaggcaaacggaagaggacatctaggggatgctatttataggctccgaataaagagatcaaactcggaacgaatggaatcgaaaccggaaaatgcgatggttagtttggagagataaactcgaaacgagttagattcggttgaaatacgaggaattaaactccgttttttgaaggaaacgaaagaggacaatgaggagataaattcccctcatccaatcggactcgcgagcaactgatggaggcggattcaaaggggaggcggcagaagaacagtgccgagggaggcattttagactttcagagaaaaggaaaagaaaggaatggagcagcaggctggcatggctggcagcccaagagaggctttgtgggccaaaatgaccaacggcctagagaaaggttttaaaacttttccttctttgaataattcgtgaaatgctatttcgttgattaaaaatacttcccttactcaaataattcctagaaaaatctagaaaatagataatcaaacaaagtatttaatgaaattttatctaactcagttttatgttgcgatttttcctagattattagagtttaacttgtaagcttttaaaataatttctaaaaatgcattaaagaatgaattattaaattaggcgattttccgggcgtgacaaacctacccccttaaaatgaatctcgtcctcgagattgagaggaactagcaaaaagttgagtatgagctgacttcaattcatcttctcgctcccaagtggcttcttcttctgaatgattgctccactgaaccttgcagaaccgtatgacgtgattcctggtgtttctctcattcacctccaaaattctgactggcttctcaacataagttaaatcttcttgaagctctatacgctcaggatctgtttcctccgtaggtacacgcaaatatttcttcaactgcgacacatggaacacgtcatgtattcctgccattgacggagacgactctagttgataagctacttcacctctccgactcacaatcttaaaaggtcccacaaatcacgatgctaatttccgtttggtctgaaaacgatgaactccccacagcggtgtaacccgtaggtatacataatccccttcttcgaaattcaaatccctacaacgattgtctacatagctcttctgacgcgactgggcagtacgcaacctttcttggataatcttcactttttcctctgcctctcgcaatatatctgtcccaaaaacttgacgctcactggtttgatcccaaaggagcggtgtacgacacttccgaccatacaatgcttcatatgaagccatttgaagactagcttgataaccattgttataagagaattcagcgtacggcagattcttatcctaacttccactgaaatatagaacacaggctctcaacatgtcttctaaaatttgattcactctttctgtctgaccatcagtttgagggtgataagcagtactgaaattcaaacgagtacccatctcttcttgtagtttctgccaaaactttgaagtaaactgactacctctgtctgacactattttccttggaacaccatgtaaacatacaactcttgccatatataactctgcaagcttatttcccgagtaggttgttttgacaggtatgaaatgagcaactttagtaagtctgtcaactactacccaaatagaatgatgtcctgccgacgttctgggtagaccagtgataaaatccattcctatttcctcccatttcaactgtggaatcttcaacggttgcagcagaccagctggcttctcatgctccgccttaactcgttgacacacatcacatagagccacatattccgctatttctcgtcgcatgctggcccaccagaattgttgctttaggtcttgatacatcttagtgctccctggatgaatggaatacaatgtttcatgagcttctttcatgatagtatcctcatctccttattgttgggcacgcaaattctatctcctagccacccagttccttgctcatcttctatataatcgat

SEQ ID NO: 67152 - DNA, 6504 bp, Oryza sativa
aggtctctaatcgtgacggttctgccgggcttgaatgatccgggttaagtaatgtcgtgtgggtaaaagtgaccctcctctgcagaggttattaaactgttcgaacagccgtgcccacggtcatgggcggatgtgaggtgattcctagcgtagttttgtttgactactgctttgtgaaatttgctgaggtggtttgggattgatgtttggaaaatctgcggctgatgggatcagcaaggcccgggtggccgtttaaaagccgttgcccgggtgccaaccttgatcaattcaaaagactgataccttgcacatactccgaccggacgagatgcactgtctcatccgtatcgtttgagaagcactcacttagttgtttcagaaaagagtttaaataaaatcaattgcaaaaacaacagcctttccttgaagcctgcattaaacacttatttcccatggtttgctgagtactcccgtactcacccttgctctatataaataatcctccccagttgctgaagaagatgaagcggatcccgctgacgaggagttcttccaggagcaagccggctacgatgagttttacggttttcggcctagttcccaagtcgcgcctgtgatgtttggtccaagtcttggcttccgcttcccttttgtaatgcagttgtgagctcgggatctgtccgcagcccaacatgactgtagtcctactctataataaagagacctctgttgctttgatattctgtcttcctgtgaaaccagcactgtttcctgagactggtatcgataaacaggttaatttggagcgtcacgggctagttccgctcgagactagttcggggcgtcacagaacgccccaatccgagcacgtatgcgacctgggcacccattttagtgcagactggtactggactccgaattgcacccgaggtcgaattggtttgggcctccaccttgacttcgacatcctcgatgatcctctatggctctaagtccctctccaagtgtctcctcgtcccctctattgttcctaatccacaatataatcattaggtaacaatccattctcgaattcatacaaaaaatgaacataggagcgagctcgcctctaattttaattgccgcgcacgagctcttgttatcggtccttgaatgaccgttgaagcattgttgtgtgtatccgaggtagtgatgtccgcatcagattggatgaggggaatttatctcctcgttgtcctctttcgtttccctcaaaaaacggtgtttaattcctcgtatttcaaccgaatcaaactcgtttcgagtttatctctccaaactaaccataggattttccggtttcgattcctttcgttccgagtttgatctctttaatccgagcctataaacagcatccccaagttgtcctcttccatttgcctcaagtccaagccgtagccgtcgcccatagcgctgccgccacgtgagccctagcgtcgccgttgccgtcgctgcttcagctgcgctgcgccgctgctgtggtcgtcgccgccgccttctgtcaccaccgtcgggttcgctaggtggatgagcatcccgtccaccccttcgccgttagtgtatctcgccggagcgccgtcaccgacgttgacccgagccgagacaccgtcggacctcgtcgtcggtcgtcgtttgtcgtagttctttgcttcggtgagttcgcgtcgtcgtcctcttcgtgttggtgtcttcggaaagaccaaccgagctctgtagcgctggtaatctcgtggtccagtgccatggccggcgatgatgtcgtgatgacatcataactcttttatttaaatcgtaataattttctgtattagatgaaaatctgattaaacttcggaaattcataactaaatcatagtaactcggattcaagtggttcatgttgctaaattcatcttaaatcgagatctacatgtgaaaaatatccacatgtactgtttttgcttgtttttgtactattttgttgattttgttcatttgctttagtttccgacgttccggaggagagcgtttacattgaggaaggtttagaagcgtttgaagaagctcaaagcaagtcacacagatcccaaacaaccttttgagcatgttgaacctatttaaagctactgttttatttcaacttatgcattaaatttgaatgtcatcgggtggtgagcctttcccaattaattaatggccgaagatgactttattttccaatgggtaataaattgattagcttgaaccttatatattggtttggttcagctaaatgctatatacataattgcttagccatgcttagaaacattagctcattaatgggatgaatcataatacattattacttatggttagatttaatggtagctcacgatggttaatcgtgttatgataattaattgataattaaaacctgattaaaggtgggttgtgagcacatggttttgatgatcgtgctcatgacaattaaggactggttcgctagttactgttgtgaaacattaaccgtgccaaccacaagccagcgtgggcaacggccttaccttttgtatagcatggttcattacggggtgccagactgagaagcggcgagaagtccatgggggtcattggggagtccatgcctctggttgtagaggggggggattctgatccaggtatggtgcactgtggtgagttgtgttttgcaaggggtactgttacagttcctttccaaggtaccgtggtggcattgaggcgcatggagacatgttttggagctgtgtcttgtgggtacagtggtacatctctggccagagtataactattcgaatagccatgcccgcggttatgggcgggtctaacaatgtttttcatgattagtctcacattactcattattggtgataacctgtgataattaaattgactcctggtttggaacggtatattcctggtatggaggtttggtttgtacaaccggggttggttgttcagatgaggttgggcctatgcaacacgggtgtgttgtatagtgtttatttaatatttcttaaatacttaattgttttactattctctcaaatgcttattaaatgttgtttatacaaatgagctttgttatgccatctttgctatcctgtgcacttgtatatttgctgtgtagcttgttgagtatgtcatatgctcattcttgcaatattcattcatcagaggaggagtacttcagtgaaggtgatgatcaggtggattaggctttgttcgggtcaagttgcttgtggagtggagtcgccattaatttttccgctgcgtagaattttattcttttgagaggaactatccacctctataataatttattattttgtgaatattaattagtagtttgatagtactcttttatcaatttattattgtgtgcctcggctgattcctggacgaggatttaacgcacatataaacgtttggaattttggatagaaattccgggcgtgacaagttggtatcagagccatgttgaccttaggacaagccaaatggtaaaccttaagtagccttcaaaatattttgaaaaattaattaagttggcagcacatgcaagggtatgtacaaaattttctaaatcctactttaccaaaacagaaagctgttcttttcttttttaaaaaaaactttactgttcagtgtattaaatagtttgattttatgaatttcattggttagtcagcactgtacatctattatggtattgatgcaatcaagatagcaccagtactactcatccctgttaatggtgacactgtaccgtgcttatgatagatcctaagtattttagttttattttattcatttgtctaaagcaatttgtctctgtccaaagttgatttcattttccaaacaaaaactttgtttagttctgttcccacgagtactgtacaggaagaaaatatatttgcttctttttgtttacttttgaagtctatgcccctgtataaattaaaattttcgaaaaaaaatttctgaaaaaaaaacgaattggtttctgaaaatttatgtttcggtcagaaaagaaaaaatcgaaatttaattaaacaagaaaaaaattagttatgtttgctccttttcttttatttttctttttgggtcaaattaattaagtctagtttgtgcagctaacttaaatatatgcattaattcctcctttctgtgctgctttagatgtcgccccatccgccggaaagattgatcgatgtggtaggattcgtcagggggctgagaatgatggcatttgaagtaggctacgacgttgcccctgagtatcgtcagattccccatgaccccaacgaggagcaatgtcgtgttcgcgtgacgttgactagtgatcgtgaagaccttccgtcaataaagtttgaagctgggggaaaaaagtatagtcatgcttgtcaggaggcagccttggtggccattggagagctacgtcatcgctttgatgaggagttagagtcatcagctttttagtatcatccacacaagccacatggtcaagactatggagttcacaactaccctgaagatgaagatagcaccactctgaagcatgcggtgtatatgcttagcgccatggatgcaataggcgtggagcgggagaaagcagctcatgataaggaaaactagaaccatggcaagatttacaagctggagagcaaggtgtaccgtctgcagaaggaactggccgagcttaagggagaagcacaaccgccagcacccaagcttcgcctcaccgcaaggaagagaacccgtcctccacgtcatatccagttggcttcgaagactcgtgtggtgggagatgctgtgcctgatcatgctgaacctgtcatccatgtcttaagtgatgatgaagaggaggaagacctagaagaaagagagctagctactccagaggaagaagatccatctcttcgttccgacgcaaggcgggattagttgcctagttagaccgttgccatagttcgatgtgttagtttgcttgcttaagttcgctcatgcgtgtgtgggtttagcgtgtttcttacatcattggtgggatgtaactacaggagtttagttcttttgcttatcagagagtaagttagctggtgagatagtgttaaatcaacttaaatgtaacatactcagttaagagcaatatataatttaaattaattaaaggtctttgttctaatggtatctctctgtcgttctttccttttgcccgtgcttttcttttgatggtgaacacccgcactgaaagtgaagtggtcacaatgaagaagatcccacccttgcccaagttttggctcagcaaactcagtttgattaatctactagtgcagcaagcgcagaaccagcaggcaaataacaacaatcaaccaccacctccacagaacaagttggcagattttctacgtgtcagagcacctaccttctcaagcaccactaacccagtagaggcaggtgattggctgcatgctgttgaaaagaagttaaatttgattcagtgcaccgagcagaagaaggtttcttttgcttcgcatcagttgcatggtcctactgctgaatggtggaatcactttcgtcaaaatagagctgcgggaaagcctatcacttggcgggagtttactgctgctttcaagaagacacatataccatcaggtgttgtggcacttaagaagagagagttcagcgcactcaatcagggatcccgttctgtcatagagtacctccatgactttaatcgcctagctcgttatgccccagaggatgttcgcactgatagagaacgtcaggagaagtttttagagggactgaatgatgagttgtcttatgcattactggctatggaataacgggatttccagcagttggtggacaaggcgattcgccaagaaaacatgtacgataggatggaacagaagaagcgtagggctgctcatttcaaggctcaacagggtagtagccagaggccgcgcattctatgggacctcaagctgcaccatacccacagggaagatcctcttcagttgctcgccctcaatgccagttctacaacaacaacactggtaatcgcagcaacaacaatcgtaatgtggtcactcgtccagtagcaactccaactcagaatcagcctgtcaggaaggaacagggaagcaagctaggggtgtgcttcaattgtggtgatccaggacattatgctaataagtgtccaaagcctcggcgtgtgaagactgctcctgtccagaacaactccaatgctccagcaccgaaggctcgtgttaatcacgttacagctgcagaagcccagaatgcacctgatgtggttttgggtacgtttcctgttaacactatacccacaactgtgctttttgattccggtgctacacattcctttttgtctaaaagttttgcgagcaatcatgggatggaagttattagtcttgggaggcctttactagttaatacctcagg

SEQ ID NO: 67153 - DNA, 124445 bp, Oryza sativa
cgggagggaaaagggaaaaagggggagagaacccttgcctccttgccactttgggaaaaaggaggagggagagggggcgacgcggcagagggggggagctctgcctccgtcccttggaggcacgcgcggggagaggcggggccgagtcgatgacgacggcgatgacggcggggcggtttggagtggagcggcgacacgggcggcagacgcggggcaggcgcggcaggcgctgacggcggcggcgactggccggtcggccaccaaggcgcgcgcgcgcgcgggcggcgcggcgatttgggcggcatcggcgggaacggcagcgagagcgggagggagggctcggcgcggctcacggcagagcgggcagagagagagagagagagagccggggagggagggggagatgggcctagagggattcggcccatcgaacccgagggaggcaaaatagacttttgcggaggaatttgatttgggaaggatttggattcgggattgaacttgacgatagatcggggatttgagatctgagatggcacggacactagacaacaagcaaagaaacggatttcgcaaataggatttttaagagatagttttcccgctaggcgccacgacggaacgggcgctacagggcgcaagcggagaggcagccttaagcctaaaaaaaataatttagggaccctgccccataatatacatcagtataaatattagttatggtccaataaaaattaggagctactgtacagtatacactacagtttttttaataaaagacttttaaatataatgtagtataatttgagattatattgtaattataatatgattatagtgtaacttatatgtagttgaataaaacgttcatgcaaccggttggctagcagcacgacatccacctcacatgttgcatgttcaacttgtacgtattgcacagattttttttcccctctccgcatgaatatcaaggtgatctgacaatcataaatctgaaggttttggttgaaaaattgtcgaacatttttaatttaattatcaattccggtaaaaatcatagtaaggtattcttgctcaaatcctagaaggtgtagccatctagtattttttttcttctgcgcatgttccccagctaattcaggggacgttgtgtttgtgtccgtggcggtgcataccacatgtgtctcgctgcccggggcaaatctaatgtggattaagcccccccccccccccgccccaatttcccaccctgttggatccctatggggaggagagaaggggaggaagaagatcaacccccctccaaaacctaactagacccaccataatgatttcattgccattttttaatattaaaaaaaagcatgctgcttttataataaataaaatatgcttctctagcttaatttagtcttgtccattgaccaaacgtcgcctcaagtcacctgcacgtcaagggaccaaacaaaccatttccgtgcatagatgaccgactctatagtagtgatatgagtcactatgtgcaactagtgaggttgccaatgcgcattcaaccatcaagattgtcaatattgctccctccaaaaaaagatcgtcaaagtagtatgttttcacaacaagaaaaaaaaacagatacacactaccatataagtgtttattctttttttaataaagaaaacagtggcagagttcactacttcttggtctaataatacatatgcaaattccacagtacgtaattggttgcttctcgacatgtaatggttcaacacctgtgaatggatcttgctccggcggtggctgttgccagatggatgttccaggacacatatatagttatgatggttattttgacgaagattacaatgatagcaaaatatggaggagcagcccttgcagctacatggcggtgatggaggataaggccttccaatttagcaccacttacctcaactccacggtattcaacgacacgtacaaagagggagttccagttgtgttggactgggtcataacattggatacatgtgagaaggctaaaagcaaaaccacttcctacgcttgtgttagtacaaacagcatctgcaatgatgatccgagtggaggttaccgttgtaattgttcacatggatatgaaggaaacccgtatattaaagatggttgtgaaggtaccatagttactttttcgttattcttcttccttgatatgacaatttcaatcaaacttgcaatggttgcttgatttcagatatcaatgagtgcctcgacaatgttacttatccttgtccggggatatgcaataatacaatggggagtttcacttgctcatgccaccaaggaaactatatggagaatggcacttgcataccaaatcggaagtccggttttcttgcacttcctatagtaggttggttcccctcttccgtaatcactagaactaatgataacgccaaccatttgtgcacaccaatatgagaattgttaatatataaattttgcatgccttactagtcattacacatggctagctcatggatcttccataattccatatcttaggccaatcccaacccaacacactagacatagtttccataaactccacatcataaaaaaaactagtacaagacactgctctttcaatgcaaacaccattgtttcatacttagatttaatgctacttatctcatatgatgtcttggatgttgtgtaaaaaccatgcatgtctcatgcaagacctggtttccttttctttcctcatttattcacttgccacatcatctttcatcctaggtggtagcttatttaatgctatagacaccattctagtcattgggttgggactggccttactagtcattcacacaagcttttatgattgtgtaggcacaagtgttggacttgtcatcctagtgatcaccataacttgtgcatgcttaattcatgatagaagaaagctacagcacatcaaaaatcaatactttcgacggcatggtggcctgctactatatgaagagatgaaatctaaacaaggtcttgcattcaaaatcttctcggaagaagaattgcaacaggcgacaaacaaatttgatgaacatcaagttctaggccaaggaggcaatggaattgtttacaagggacatcttaaggacaacttggaagtagcagtaaaaagatgcatgacaattgatgagcaaaagaaaaaagagtttggcaaagaaatgctaattttatcccaaatcaaccacaaaaacattgttaaactattaggttgttgccttgaagtggaggtccctatattggtctatgaattcatcccaaatgacacactttaccatctcatccatggaaactataatggttggcacatccctctggttactcgcctacggattgcccatgagtctgctgaggcacttgcctacctccactcttgtgcttccccaccaatcctccatggtgacgtcaagtcgtcgaacatcctccttgatagcaacctctcagcaaaagtttcagattttggtgcatctatcctagctccaacagatgagacgcaatttgtcacactagttcaaggaacttgtggataccttgacccagagtacatgcaaacgtgccaattaacagataagagtgatgtatatagctttggagttgttcttctagaacttcttacacgcaagaagccgttcaatcttgatgcgcttgaaaatgagaaatgcctgtctatgaggtttctctctgcaatgaaggagaataagctcagtgatctattggatgatcaaatcaagaataatgagaatatggggtttcttgaagagattgccgagttagcaagacaatgcttggagatgtccggtgtagataggccatcaatgaaggaagtaagagataagcttgataggctgaggaaagtcatcgagcatccatggacacacgataacccagaagaattggagagcttgcttggtgagtcatcatgtgtggtcatctcagaggttgagagtacaggaaattttagcattgaaaggaaagttgtcaagggtttggaatcagggcgttaagcagtactctctctggtatagcttatgtccaatcctattgtgatttatcatagattccttgtagagccaaggaactcttactcatctatgtcaattatttgtgtaaagttgagatcttgtgaaggcaaggtaattgtatctgttagaatatcctcctggtatcactactcttggtagattgggattcaaaacatgtattaactttaagacagatcattcatctctcttgtagatgaaaaggaaagttatacaatagagtgtcaaatttaagaaattcttgccaaaggtaatagaagggattgcatatttgtgttggaacaaatgagtaattctttacatgagtataagagtgaatagaatgtgtgcaaaattatttgttgtatgaaaaaaaattggtgaagtttctctaataaaagaacttttagtcttatcaataattaaccgctctctctagctacaaagatgaattatggcttttctatatttatttcttttagataatatgcttctcctattgatgaacaactaatttctcattgattctttgtgtattaacaaaacaattaaataatgcatcctatcatttttctaaagaactataggctatggttttttaaacgctttgataacaccttggggacatttatagatatcactatatctttaattggataggcaacatcgcaatttcagaaatcattggctcatgaggtagatagaaaactcaccacaaggaaggaaagaaacttaaataattctaagttatacctttgaacggaaaagaggatcaataataaaaggaaattaacaagataagaagcctaacaatgatttgtctatgtatgtatgcacatttttctctagtctattatagttattaatgcattgatcataaacgaatatcttgttcttggaagcaaaacagtttaacacgtggcgaacactggaggggtcaaaaaaaattgaaaaatccccaaaacgcaggaatctgaccgaagactactaggtaagtatttgcattggtagaatgaattgtagattgtatagtttatataattgtattggttgttttggtctagtatctgaagttctgaactgaaaacggccagaaaatgtgaagggtggaataacatagtctgtgcttagaatttcagagttaaattatttataaccatgcctacatatcttttacaagtttatccagtcggtaattgttgtgccaacttcttgctcttttttaactgcttacttgccacatactccgtccgtctcataaaaatcaacctaatactggatgtaatagattcgtagtactatgatatatcacatccagtcctagatctttttcgtgggacggagggataatagcattccaaagaaagagaaacggatgcttctatggttgtttttcctcctgagtgacaagacgggttgtttgggcagccatgcacgcgaatgaagcaaccttcaaattcctctttaatttctaccactacagaacaaaaaggatttcaagatcaaatctggtactctctccgtgtcacggactcgcgttgggctagacatccatggtggattgtggcctgttaggcccaatatgctacatcaagtaattactacaaaaaggaaccaggcacaatgggaaggggatcaaagaatataagaactgaagcctattgcctggctgttccctccctcttgcttcttcccaaatcctactctatttcctctgatttcctgatctcctttctaccaacccaatctcctgctattccttgtctaaactcttctttctctctgttttgtatatgaatatttcagtggtttgatgctggttttgcttgtgcttacttgaggtgcttacttgaggttggcttgatctgtcaaaattgatgttggaacgtaacacaccgtcccgatataaatacagttgtaagtttccgtatttaatatttgactgttattcttatttaaaaaaattgtgattagtatttttattgttattagatgataaaacatgaataatactttatgtgtgactatttttttataattttttttaaataagacgtatgtcaaatgttaaataagaaaactcacatccgcacttaactatatttagatgcagccatgcaggtagtacattttttttgccgtactgctcccctcaggcaagagcattgaaatgtacaatgtgtcaacaattcgttagtcccctcaggctgtgttcttctccctgttttttcaacccacatctctcgttttccgcatgtatatttttcaaactgctaaacggtgtgatttataaaaaattttctatatgaaagatgttttaaaaaatcatattaatctatttttttaaaaaaaatagttagttagcacttaattaatcatgcaataatacgaattttattttgcgtgctaggaaacccctactcctgaacacagcctaaaacagagtaggatatgctgagtattgaacgtgcccaggtgcgctacttctatacacgatgtcgtgaaggcaaatagctgaagcctaaatgcatgaatggccgccaccaccaccgccaaccatgatgacgcagctagtggcggagctagaaatttaaccctttaaaatcggttactactagtttgtatttaaatggagtcatttctataattttttgaatttgtacatgaaagttaaaatttgtaggcagcggcggcgccggcgcccggccatcacgcgcaattgcctgggcaccatgcgtacagcaacacactgctccaatgcatatgcagcgtattactcgttaaccatatacttaggccatgtttaattcagcttaggattattttaatctggattattaggagtaagctgaaacaaatagatagcttattatgatatacttcctccgtttcacagtgtaagtcattctagcatttcccacattcatattgatgttaatgaatctatatagatatatatgtctagattcattaatatcaatatgaatttggaaaatgatagaatgacttacattgtgaaacggagggagtattattataatctataagccagattactataatctggtgagccactctaaaggtgcttttcttagattattgggtggcaaacaactaacaaacagataataatttagagaaacaaacagctagcagcttattctatgtcggcttattataattcagcttatagtaatctagttctataatctagattataataatcttaagctgaaacaaacataatcactttgtctcgtaagttctaatgaagattaattagatgaataatcagattatcagaaaacgagatagcaaggaccaaaccatcaagctgtagttataaaggccaaagcaatacaacctactagcaccgatgttcaagatgacactagctttaaaatctaaattatcagcgataatattaatcttgtctaggcttcaaaaaaatttaaagatctgccaccgtttgtagggatgtttttcaaaaacgaccccacagattgtgcatggatccgacacgcagccaaacgtttagcgtgtgtcaagcagaataggggattcaaggagatacaattgcaggattaccgtgctttggtagggaaattggaagcaaaagcggctggagggcgctgggggattgtgcttccagaggacctcgcgcccctgcttgaagtggcggcgctgcgtgcgcccgcgctttactgcctcctcgcatggtcccttcctccctctcactctctcgcacgggctgctcctgccgccgcctcggtcactctctctcccggcggcggcgcggacgaggccggcattggcgtgaggggaggagttctcttgggtttaggaacggcgacgagtgatgtgggtggtggcccaggtgggagtggcgctagttgggctggaatcgagacgctaggtaaggaaaaagtatacttggactcccttaactatcgtccgagtatgattcacaacctccaaccacaaaactaggtatatcgactcttccaagtatcaaaaccggtgcaaacaatgtctcttggtggttttggagatggttttggctgacgtagcgcccacgtggcagtcttgactgagtctttatcctacgtggcgcttacgtggcatcaaaataaaaataaaaataaaaaaatatgtgggacccatatgtcattcacacacacacacaaaaagtgggacccacatgtcatcctccctctctctcccttatctctctctccctcccttatctctctctccctcaagagcgacggcggtggcgatggccgatgggaacgaggcggaggggagcggtggcggtgggaagcggcggcggcggcggtcgcggtggcggtggggatgaggctcgccgcctcgagaactccatccgcctgctctccccgacgctcgtccacgcgcgtcatctctggggccgccgccgctggccgcgtcgacctcgtcttctagttcttccgcttcgcctaccgccgcgccggcttcaaccccgagccgtccaccttcgccctcctcatcccgatcgtcgcctcccaccgcatgctcaaccacgcccgctgcctcctcctcgacaccatgccctccttctccattgcccccgaggaggccaccgtcgccacccttatcgccgcctacggcaaggccaacatcccgcaagaatccgttaagctcttccgatgcccccaccgccaccgccgcttccaaccgccgccaccgccgctccagccaagagaaaggccgggggagagagagagagataagggagagagaggggaggaagaaggaaaggagagggaggatgacatgtgggtcccacaatacttttcttttgtgtgaatgatatatggctcccacatatttttttgattttgtttttattctaataccacgtaagcaccacgtaggacaaaaactcggtcaagactgccatgtgggcgtcacgtcagcaaaaaccacctctaaaaccaccgtgggacattgtttgcaccggttttgataattggcggagtcaatatacccggttttgtggttggaggtcatgaatcatactcgagcgatagttaagggagtcaaagtatactttttccgtagactaattttctatgggaataagttcatatgaggtcccttaacttgtcaacgaatctgattttcattcttcaaccggaaaaccagatacaacgggtctctcaactgtcaaaaccagcacaaaataagacccaagacgatttggatggcagtttcagctgacgtggcccttgcgtggctaatttgactcggttttcatctgacgtggcatataaagcaaaatttaacaatttaaaaaataaaaaaatgttggacctcatgtcggtcaaataataagattaaataatagtgggaccacatgacagtgggtcccatttccccacctaatcccctcctttctctatctcctccccatcttctcatttgtgagacggctcgccgccagtgccgagtcactactgcccaagaacccccgaccttgacctcaatccgtcgcgggcggatctggcagcccctcgccggctgttgatttcgccgcccgatctagaggacgagcacaccaccgccaacttcatcacgcagcccaggtcttcaccaattccatcgccacctgcagccatgtccacctccggctcccttagcgtggcccgctggcacgcccgcgacagggctcccccttctctacattgctccgacggcttctgcgacctccgcctcccctaacgatctcagccccggcctcgcctccctcatcgacacccttgcgtcggattggaccgacgcttccgccgatgccaccgctgctactcactgacgtctccgcgcgcacctgctcgcgctggcaacgggaagcgcaagaagctgtcaggctgcgtcagtcgcatccgtgcccttaataccaccgtcgccgccgtcgaactccatctccgtctcgagcgtggcggcgatggagggcggcgcgttcttggcgcgcgcggcggcgatggcactggagttgtcgtcctcgtcggcggagcctgcggtcggggcgctccgactcctgcagctcctgggccagcagcgtgagaagccacggtcaccaccacggaggccgcggaggacgacgacccgttggagaggaaggcggcggcgagggtgtcaccgctgtcggttcactccacctgccgctagcctcgctcgccgaggttgttgcccgcctctccccaaaagagatgaaacgtgaggataaggaagaaagagagggaagagggaagaaaggagtgaggatgacatgtggggcccacgtgggccccactatctttaattattttgtgtgtggagctgacgtgtgggcccgtagttttttatttttctgatcgaattgccacgtgggacaaagatctagtcaaactaaccacgtaggtgccacgtcagccaaaagcgctttccaaaccaccgagggatctcgtttgcacctgttttgacaattcagggccagttgtatctggtttttgggtttaaggttgaaaatcggattaagtgtaaagttaagggaccaggttgaacttattcctttcctataggagcacaagttggccaaaagggccgaggcacgacggtccgacccatgggacggggttttggcttggcccaacctttggattgtgcttggccctttgcctcggctcgatgggttggcccggcatggcccaattcaacgatcagagagttaaatagatgaggaagtcaaaacagacttattctcgcgatgtaagtcacagcccaaaaagatgagggatgcaaaaaatagacttattaaggccatataagaggcagaccaaagagatgggggaggaggcaaaatagactttttttctaaggagaagcacgatgcgctttcgtgcctttgggccggcccggcacggcccgagtcttattgggtcgtacctttgccgatggtgcaacaagtgggtaggtccggggcagcccaacgtgtaggttaggccgtgtaagcccgactaatctcggcccaggcccaggcctagcggcccatttggcatatgtagagcacacgcttgccatctgtaataactgtattgtcgaggagcttgttattgcgcgcctgggcgcatgccccaggtaccgcgcgacgtaccccctctagtccctctagtgtgtagtctaatataccatacgtatgtatttacatataaattttgtagtatacacttccggcacctataaaactatgtctttgtgtagtagtgtttctagcaatatttttctttttatgcacaaatctcgaggcaatccgatagctataactctgaaagttttggaagtatttgctgaagttttctagcaatttcgttgacattttagtcctatggttcgatttttttttagcacaccggagatggcctgagctagctgatggctacgggacctcttggaagctagctagctctcatctcaacaaccggcattgacttggtattataagtctccctagtccctaggaacgaagagttaatccaagccaaatcgagggagatttgttgagcggtagagctgatcggctaattactgagaagcgtagtgcccgagaggcaactaggcaagctagctgaaactccgtcctttcgatgatgcgcgatgcacctgttcctatgctgcaagtcttgctacccgcttgatcgatcggttcgcgttttcacggacgtgcgtagcgacggaaattagcggaaacgaccctgctttatgtgcgtaaatacaccacgtcgtcgtcaacgtccacgaatgggctcggctgggaccgagtctgggcgtctggccacgaatagttctgataatgcggtgtcccatgtgatgtgattgtgagcgacctcgcggtctatcggcattggtcaggtactctcaatcgtcaacgtcgatatagctagcaaggggcagcgtatgtctctatttaacacgcagcccagagaattcagaacatgtacagtacaaaccacacagacaacgaaatggctaagcttcttctctccgctcttttgatctgcatttcagccatctgggtggtagccgcggccgacgtcccggcaggacgccgaggctgccagacgaggtgcggcaacctcgacatcccgttcccgtttggcatcggcgatcagtgcgcgatccacggtggtttcggcctcgactgcaagaacgacagcggcacttataggacattcattgggccgttcgaggtgactaagatctctgtgccggacgccaaagcctggatgaagatgggaatctcttggcagtgctatgacccggtcacaaaacagatgaatgattcgatggttgggcagaacttcaccaacacgccctatcgattctcatacgaggataacaagattttcgtcatcgggtgcaatacaatggcctacatgagaggtgtttcggtaagtatttcctttatttatgtttatgctttcaacctttttgacgtcaaaattggaaattttaacaaatacttgtatctattttgcttatgttaagtgactatgcttccagatcgttacataatttcaatctcaattcgtagatcacaagataagctgattttttacactaagctaattaattaacatctgtgacttaattatgcagtatgtcataggttgcttatccacatgctcggatgaaccaacaaatggttcttgctctggcgctggctgttgttcggtggatgtcccaccagacctaggctatgtcgaggcttatttcaataaagattataacacctctcaaatctggaactacagcaggtgcggctacctggtagtaatggaaaaggctgctttcaggtatagcaccacttacattccctcaataaacttctggaatgactacaacgggactgttccggctgtgatggactgggtaatcagaagggagacatgcgaggaagcgaaaagggacatgagttcatatgcatgtgttagcgacaatagcgactgccataattcaacgaatgggcatggttatctctgcaagtgctccaaggggttcgacggcaatccttacatcaaggatggatgcaaaggtctagctacttctatcctccacctcctaaatgatcgatttgtgtatatatacacttaaaacttttactcaataacatatacatttttgttttgtttcagatatcaacgaatgtcttgataatactacttatccatgcgctggactttgtcaaaatacgatggggggttacgactgttcatgccatcaaggacaacataaggtggaggatgtctgtgttccagatcagaagaatcagaagtcctcttgggagatgcctgttgtaggtatgtacgtctagcaagattaatatttttgctaagatttacatattgattatcttattagtgcattagttgtaatattgagattcacttacttttaaatgttaagtggtcatctgttcgtcctagtattgttgttggctaacaaattatattcggcaactaggtgcaagtgttgggtttgtcatacttgttatcatagcaacttgttcgtacctgatccacgagagaagaaagctgcaacacatcaagcagaaatactttaagttacacggtggtctactgctgtttcaagagatgaattcaaatgaaaggaaatcatttacaattttctcagaagcagagttgcagcatgctacaaacaagtttgacaaaaaccaaattcttggccatggaggtcatggcactgtttacaagggacttctcaaggacaacactgaaatagctgtcaagaaatgcatgacaatggatgagcaacacaagaaagaattcggtaaagaaatgctaatcctatcccaaataaaccacataaacattgttaaactactgggatgttgccttgaagtacaagttcctatgctagtgtacgagttcatcccaaatggaacactatgtaatctcatccatggcaaccatggccagaacatttctccagttactcgtctgcggatcgcccatgagtccgctgaggcactagcctacctccactcctacgcttcaccacccatcatccatggtgatgtcaagtcctccaacatcctcctcgatgttaacttcatggcaaaagtctccgactttggtgcttccatcttagctccaataaacaagtcacaacttgtcacgctagtccaagggacttggggttatcttgatccagagtatatgcaaacatgtgagttaacagataagagtgacgtttacagctttggatcttatagaactgctcacaaggaagaacgttttcaaccttgatgctcctgaaaatgagaaaagtttgtcaatgaggtttctctctgctatgaaggagaacaaacttgagaatatattagacgatcaaattagcaataacgagaatatggagtttcttgaagaagttgcggatttagcaaagcaatgcttggcaatgtgtggtgaggatagaccatccatgaaggaagttgcggagaagctcgataggttgattaaggtaatgcaacacccatggacgcaacaaaatcctgaagaattggagagcttgcttggagaatcttcttacattataagctcaggagccttgagtacaagaaatttcagcatcgagaagaaagttgtcaaggacctagcatcagggcgttaagctggaatctctttgccacccagcatacatcatatcaccatgtcgtaccgcgtcgtattgtatcatagttttcacttaccctagaaattcagactcagttatgttcattattaattattttttgtgtaaaaataaaaaaatattgtttgtgtacacctttagtctttatgggactgtgtttcatcatatatgagaataagaagcaatcatacgaagtcaagttaatgttctatcactgtactattttccccaccgatttatgtgattctgtctaccgtgtggtaattgcctatggtacacttggtttcagcattttcttgaccaaaccttacaagatatgctgacccatgcatcttgcaacccatcctaaccaacttctaaacccaaaaaatgttgtctcatcgtactcggttgcgcattgacaaaagctgcgtttggtccggacattttcagcaattcgatatgtaaaaattaagttgtcaatgctgtgttttaattataaaagctgtgtttgaagcggatgaaaataaaaattaagttgacacgcacaaaacgagaaagtcattaactaagttttaattattacaaacttgataaatatatttgatattttaaagtaacttctaaatagaaaggcacataatacagtaaaatctgaatcttaaccgaaaataatagagctacagctcgcaatggaaaatgtacctttgtagttttgcacgcaacggagcatcacgcggaattcaccgttcgaagttacaagaccctgtgggctgtgaaacagtcaagtcttccatgatactgagcggagcgaagagaaccagaactgtcattagagaagaccgaccctgtgaagccccccaattgtacccaagacccataaacatcgctcgccaggtcgccgagaaattgtgtgatatggacgaggccaggttttctcaggtgaacgcagcctgtttttactcaatttcttggattaaagcagggccaatgtgatgtgaacggtggccgattggtacagttagactatcagccacacaaatttaacggatcaagtttattcacttatcaatgctgctatcacgcatgactgccaagttacgtcagtcgttcgaagtcttccgttgctatgtgtagttaatagagctggagatcgattacgatggaggaaaaacattttgaaaaaaaaaaaggtatatgcactctttcttttcgacgtaaagacccgggagtcagtcgtcgtccataattcttgggatatacttcatttatgatcaaatatacactttctgagatcttattccctctgccctattttatgtcctattttaagtacaacgataagttttttttgcctaactttgatcgttcgtattatttgaaatttttttataattagtatttttgttgttatgagatgataaaacatgaagaatactttactcattactgacttatgtttttaaatttttttaaaagtttttttaaataagacgaacgattaaaattgggcatatctggttttgcggttcgaggacgttttttatcccgataataagttgagggaccttcggtgtactttttcctttcccatgggagcacactctctagctataataactggattgtcgacgtggcactcatttggattaaaaacccacacaaactgtcacaaaccaagaaagttactgcaccagttagttcgaatttcaagttgttgttctaaatcatatccatccgtcgcaatttacttatagaaaaatgagtaaagtacacggccggtccttaaagttggagcgatgtgtcacttaggtccataatctaggaaaatcgtcatttgggtccgtgatcttgtttaagtgaatcatttaggtccaaagcgcctttgaccaggttgactggcttacgtggccgtccacggtgatagcatatttgcattttagccccccgcatcttggctctcccatatacgatccaaccattctcccccaaatcctcctcggctcctcctgtgtgatttctagggttagcgattgcaacggcgattgggtggcggtgtagatgtggcggcggccgcgaggacgacaacgacgatgagggaggcgcgtacggcggcaacggtaagggagaacaagcgttcgtcgtcctcatggtgtcatcagcggccgcgtcggcctccacctccgcgacggtgtctagctcggtccccgtggggctggcggctaagaacctgaagtcgatgcacaagggcgcgtaggacctcaacctggcgttcccgcatcaccacggccgcgccctgcagtcgccggagttcacagcgttcccgagcttggagagtagcaacatgtgcaaccccggaggcaacatggcggtggcgaacggcgttggtggcaggggcagcgtgggtgcgtgttctcggcgatggagttgctgaggagcattggctgctacgttcctctgcctcagatggggccgctagggatgccggcggagtatgcagccgtggggttccatctcggcgagttccgcatgccgccaccgccacagcaggagcaacaacaagctcagaccgtgctcggtttctcccaggacacgcacaacgcgggtgcaggcgacggctccggggtgttcggcgggtgcagctagtggctcatgcatgcacgcgtggtggtcagcaactgacaacatgtggagatagagaaatgagatagagacaagggggagccaagatgggaggggggctaaaatgcaaacatgctgccaccgtggacggtcacgtaagccagtcaatccaatcaaaggcgctttggacctaaatgattcacttaaacaagaccgcggacccgaatgacgattttcctagatcatggacctaagtgacacctcgttccaactttaaggaccggccgtgtactttgctctagaaaaatagaaaaaaaagtttgggatccggagttaagggcttgtttaagggcttaagtttagaaaaatatatatatcaacgggatggctagacagaggattaagggcttgtttagttagaaaaaaaatttgccctacatgtcacatcagatatacggacagacatttaaagtattaaacgtaatctaataacaaaataaattatagattccaccaggaaactgcgagacgaatttgttaagcctaattattctgtcattagtaatatttaatatagtaccatattgtcaaattatagtgcaattaggcttgaaagattcgtctcgcaatctcctggcgaactgtgtaattattttttttttacatttaatactctataaatgtatccaaatattcgatataacagcgtgaaaatttttttttaaactaatcaggccctaatacgagcaagacaaaaaatagtctttttagctggtgcaacacttgtctactccaacctccaacttgttccgggggaatcacacgtctcactgtctcagtcacacaagacttggactcattcatcagtctccacaatcgtggaccgactgctactgtacctcttggaagctactccagctagctagttgctctgatatgctctgagctcaacaacagcggcattgacttggcaagtctccctgggaccctagagttaatccagccaattagagcgacatatactaagctgaccggctgactgagtaaagcgtgcatgggcgagggcgagtatttcgttgatggaccatcctgaatcctttagacgccacgtattataaaatatagcaatcgggataaaagacatattttagtagtatgaaattgaacaagaacctatctattatattattaaaggcatagaaaaatgagtctccacgttcgctctcatggtctagaaattctcacattaatcaaagaaaaagaaaaaacagtgtccatatataaatataatttagaaatagctgaaattcagaattaaaaaataatgaatattagaagaggatactagagtccatatagaaataaaatttagaaatagttgaaattcggaatttaaaaataaagaatattagaataggagactagagtccatatagaaatacaattaggaaataactgaaattcggaataaaaaataaggaatattagaagtagagtatagagttcatatagaaatacaattaggaaataatagaaattcggaattaaaaataaggaatattagaagtagagtatagaatccatatagaaatacaattaagaaaaaaaaagaaattcggaattaaaaaataaggaatattagaagtagagtatagagtccatataggaatttaaaactaactaaaatttgaaataaacataataaaattaaagtagagtttagagtccgtataaaaatataatttacaaataactaaaatttgaaattaagaaaaacatgggaagaagagtttaaagttaatataggaatacaatttagaagtaactgaaattcaaaattcaaaattaaagaatattaaaagatgagtatagagtccacatagaaatacaattagaaataataaaaaatcagaaataaaaataaataatattggaagaagagcctagagtctatatatagaaatacaatttacagaaaatttaaaattaaaaaaaagaaatattaatagacgagtctagagtcaatgtaggaatatatataatttacaaataattaaaatttgatattaaaaataattaagaactaacacatatataaaatactatatgaatattacacattaacattagtagtttcgtaaagttattgcaaaatttaaaattatgttattattttaatatatttgaataatataataagaaaatatatatgctattatatgagagaaaatataatgatactatcatgctagtttagatttatagaattaaattatatcaaatctaatactagtttaatatattttagaatgtttgcctttaggggttgtatttttctcctgctatatttaatgaaaaagcgtaatctcgtgtggtttctgttaaaaaaatatattttagaatggagagtacatgacaacagactttaattcctcgtgcgtgtgcctagctataaggaattatgtcatttaaattttttttaaagaagtagcaaaaggatatgccatagtataaaaggtgataggtggaaggataaaataagacaaaagttgataggtaaagaataaactattacacaagttgatagatgggaaaataaaatactatcttaagattacaaaatcccaaaaaaataaaagggtaaaattatttatatacatggacgaaagtatcatatcgggaatgatcaataatcaaccaccagcttttattaatcacatactgcagggcaagctgcccagggacagtaaagcggatatctctatttaacacacaccgcgtcacgccccagcaaagcacacactctcctgtctcctccagtctccacacacacacgcaatgactaagcctcttccctccaccattcttctgatctgcgtttcagccatcgggatggtagccgccgacgtccccgtggctggacacccaggctgccagacgaggtgcggggacgtcgacatcccgttccccttcggcatcggcgatcactgcgcaatccaccatggcttcaacatcatctgcaagcctgtcaacggcaccaagaggcctttcaaggggtcgtttgaggtgacgaaaatctctgtgcgcgatgccaaagcctggatgaagatgcggatctcttggtagtgctatgactcggcctcgagcaaaatgaaggaatgggtggatttccaaaacttcacctacatgcccttcaggttctcatacgaggataacaagattttcatcatcggttgcaatacaatggcctacatgagaggtgtttccgtaagtatctcctcatatttatgctttgacgacattttgcttatattaatatactaggcgctcagtactgatcgttacataatctcatttaatttaacgtcatagatacaaattaacatctgtgacttatgcagtatgtcataggttgcttgtccacatgctccgatcaaccaaaaaatggttcttgctctggcgctggctgttgttcggtggatgtcccgccagacctgggttatcttgaggcttacttcaataaagactataactcctcagaaatcagctacagcagttgtggctacgtggtagtgatggaaaaggctgtgtaagtgagtggctggacttctagttttgaactatagcaccacttacattccctcaacaaacttctgggatgactacaacgggactgttccggccgtgatggactggataattacatgggagacatgcgaggaagcgaaaacgaacatgagttcatatgcttgtgttagcaacaatagcgaatgcctcaattcaacgaatgggagaggttatcgctgcaagtgctccaaggggttcgatggcaatccttacgtcaaggacggtcttcttggatgcagaggtctctctgtctctctctctctctccctctctctattcagcaaagtatacaataagaacttatattcacgaaagtttgctttgtttcagatatcaatgaatgtcttgataacactacttatccatgcgctggaatttgtgaaaatacaatcgggagttacaaatgttcttgccctcaaggacaaaatgagctggctcggggtgtctgtgttccagatcagaagattcagaagtcccaagcttgggtgatgcctgttgtaggtacgtactacaactagcagtagatattctttgctaatatatatatatttacatattgattatcttattagtgcattggtacgtactacaacgcttgcttttctaagtcaagtcgtcgtttgtcctagtattgttattggctgacaaatttatattcggcaaccaggggcaagtgttggatttgtcatacttgtgatcatggcaacttgttcgtacttgatccgcgagagaagaaagctgcaacacatcaagcagaaatattttaagctacacggtggtctactgctgtttcaagagatgaattcaaatgaaaggaaatcatttacaattttctcagaagcagagttgcagcatgctacaaacaagtttgacaaaaaccaaattcttggccatggtggtcatggcactgtttacaagggacttctcaaggacaacactaaaatagctgtcaagaaatgcatgacaatggatgagcaacacaagaaagaatttggtaaagaaatgctaatcctatcctaaataaaccacataaacattgttaaactattaggatgttgccttgaagtacaagttcctatgctagtatatgaatttatcccaaatggaacgctatccaatctcatccatggcaaccatggccaacacatttctctagttactcgtctacggatcgcccatgaatcagctgaggcactagcctacctccactcctacgcttcaccacccatcatccatggtgatgtcaagtcctccaacatcctcctcgatgttaacttcatggcaaaagtctccgactttggtgcttccatcttagctccactagacaagtcacagcttgtcacgctagtccaagggacttggggttaccttgatccagagtatatgcaaacatgtgaattaacagataagagtgacgtttacagctttggagttgttcttctagaactgctcacaaggaagaacgttttcaaccttgatgctcctggaaatgagaaaagtttgtcaatgaggtttctctcagctatgaaggagaacaagcttgagaatatattggacgatcaaattagcaatgaagagaacatggagtttctcgaagaagttgtagatttagcaaagcaatgcttggcaatgtgtggtgaggatagaccatccatgaagaaagttgcggagaagctcgataggctggttaaggtaatgcaacacccatggacgcaacaaaatcctgaagagttggagagcttgcttggagaatcttcttacattataagctcaggagcctcgagtacaggaaatttcagcatcgagaagaaagttgtcaaggacctagcatcagggcgttaagctggaatctctttgctacccagcatacatcatatcaccatatcataccgcgtcatattgtatcatagttttcacttaccctagaaattcagactcagttatgttcattattaaaaaaattttgtgtaaaaataaaaaaatattgtttgtgtacacctttagtctttatgggactatgtttcatcatatatgagaataagaagcaaatcatacgaagtcaagttaattttctatcgctgtactattttccccactgatttatatgtgattctgtctaccgtgtggtaattgcctatggtacacttggtttcagcattttcttgaccaaaccttgcaagatatgctgacccatgcatcttgcaacctatcctaaccaacttctaaacccaaaaaatgttgtctcatcgtactcggttgcgcattgacaaaagctgcgtttggtccggacatttttcagcaattccatctctaaaaattaagttgtcaatgctgtgttttaattataaaagctgtgtttgaagcggatgaaaataaaaattaagttgacacgcacgaaacgagaaagtcattaactaagttttaattattacaaacttgataaatatatttgatattttaaagtaccttctaaacagaaaggcagagaatacaccgtttagtaactttagtatgcaatcgaagtaaaatctgaatcttaaccgaaaataatagagctaaagctcgcaatggaaaatgtacatttgtagtcttgcacgcaacagagcatcacgcggaattcaccgttcgaagtcacaggaccctgtgggctgtgaaacagtcgagtcttccatgatactgagcggagcgaagagaaccagaactgtcactagaaaagaccgaccttgtgacagttctggttgccgagaaattgtgtgatatggacgaggccaggttttctcaggtgaacgcggcctgtttttactcaaattttttcttggattaaagcagggccattgtgatgtgaacagtggccgattggtacagttagactatcggccacacaaattgaacggatcaagtttattcacttatcaggtcgctgtaaatttccttgtactgttgtacacactgctgagaccagtagctaggctagctcacagtagttcgcctgcggaggtttttccctatgtgccattaaaaaagatggagcatgtctatctaccaataaaaagttcgagcctccctctatgtcatcgtcgaactttattacgccctccacaccattccgtcgctattctgttttggtttaactgtttggcagctctgacatgtaggccgggcggaaaaaaatgtctctattgccctttcttcttttgagtgcgagagagagagagagagagaggggggggggggggcggttgagtgcggcggcgcggcggcagcctggaggaggacagggaggcatacatgcgtctctcagtggtgtcgtcgtcggagaggggtggtggtggtcgattcctccggtttcttcctctcactccttccccctttctcccacgcgcgagcgcacacaagcagcggcagccagcgcgcggtggcgcggcgacggccgggcacggcggcgcctggtgcttggcgcggcggcacggttgcagcagcgtgggtcaaggtgagggagggcgatgcgggtccgacggccgtggtggcccttcggcaaaatggaggaggagacggccggggagcaccgtcgacggagcgccaggcaggaggcggtctggcgccggatggggaggcagccggcggtgtcgctgcctcggctcggtggacggcggcgccggtggaagagaaggctgtcgtgcagggcgacgtggccgtggaggtggagctcgccgcggagtcggcctggccgtgcgcagcggcagcactcacgcgggccgatttggctgcgggcgcggtggaggacaggcgcggcgctggcgatcgagcgggcggtggcgatgttcgcgctcgccgcggagtcggcgcgggcggcagcggtggaggacaggcgtggcgcggacgggatccggcgcgcatcgctcagctcatcggccctggcgtcgagccgcttgagctggccctcaagctccagctctcctccagtagcgcggcgagctccccgtgggtggcgccgacctcgccgtcgatcttgcggtcgacggcctcgagcagcatccggaaggcgcgggcaagagacgcctcgacgtcggcgacgagggcgtcgtacccggccatcgcggcctggtcgatcggctgcgccacgcgccaggtgaggtcgccaagcaaccccatgggcaacaaactcatttggctgcgccgttacccactgttagaaaaaaaacagatggaatgatgtggagggcgcgataaagttcgacgatggcatagagggagacttgaactttttagtgacacagaggcaggcatcattttttttttaatagcacataggtaaagacctctcgctacagtggcaggatagaattaacatggatgacaacaggggagatgaagcggttgtcactcaatgctgctatcacgcatggcctacgcgcttaagtcacgtcagtcgttcgaagtcttccgttgttatgtgtagttagtagagctggaggatcgattacgatggaggaaaaacattttgaaaaataaaaatatatgcactctttcttttcgacgtgaagacccgggagtaagtcgtcgtccataattcttggaatatatttatgatcaaatatacatttttcgagatctttattactccttctgtctcattttaagttcatgtgtataataatgagtttttttttgcccaattttgatcatctgtcttatttaaaatttttttataattagtaattttgttattatgagatgataaaataggaataatactttactcgtaacttatgtttttaattttttttttcaaaagttttttttaaataagacgaacgattaaaattggacgcagaaaattatacttacacttaaaatgggacttagtctagaatctcacgagcgagacaagtttatccccctctgaattctttttccatcgccacaagcatatcctacccatcatatttaaggaggccgctgccgaaattcccaagcacaccaaccaaaacgcacaacaaaccggctacctaaggagtacggacaagcaagtgcagcatatggagcgtcatcagcttcttcttcttcccggatgccttcttctctaccttggcgccatcgctacgcttgccgcggccgacgtcgcaattccggccggtggccagcctccgggctgccggacaaggtgcggcgacgtcgacatcccctaccctttcggcatcatcgacccagacaggccagactgcgcctacagcaggggcttccagctgaactgcacgtccgtgaacggcgccgcgaggcctatgtttcacaatatcgaggtgaccaacatctccgtgcccaacggaaaagcatggatgaagacgaacatatcctcccagtgcttcgacccagaaacaaacagaaccttgtacgatgacatatggaacagtttcagatattcaccttactggctgtcaaacgaggacaacaaacttatcgttgttggttgcaactcactagcttacatgcgcagtacctcggtaagtaatttttgcatattttatacattatcagtttcttaaggaataggaaaggttgatattctttttaatcgcaaatcatgacctcacaaccccaattccgaaaacagagcatctttacctcattcaagctagcccactgtacttggtgtttctcagccactcaaaagttatagaatccataaaataaagtagagttaattacactttgggctaggaatttttaccaaagtttcactttggacgagggataaagttatcttatcactttggactagataaatttacaaaagttttaaattggaccacccttcttctccatcaatcttccctccttttctctattaagcagccgcgctatggaatctgagggatgatcaagcaaagtaccaggattccttctctctctgctctgttccgagcttgaggaaccagcaaaatcaagactggtggtagctggctgctgtagctgtcgcttgcaagctcaatacagtgacttgttctaagctcacatgataaattaagggaaaaatggtagaaatcaagcagctaaatcaatgagtaaagaaatcaaggtcaggtggaatattgattggtttattgtgttgcgggtaagctcgctaatgaaatcaaggagtggcaaacaaaaaagtggtccaatgtgcaatagaaggtaagaaaacctggaccaaagtgaaaacgttagatataacctagtccaaaataaaacacaggcaataataaccgggccaaagtgcaattcactcaactaggccaaagtgcaattcactcaataaactatttgtcagaagttgagaaagccaacttctatagattctagttcactagttgcatctcataatttctgacttctcatgtaaggtcttatactaattcttaatataatcattatgttatattgatgggtcatttctaattgtcgatgcatgttttttttttgactggaactaaattggatatttatgtgttttttgacgtttgattcaaaaaatgtgcaatcatttatccttgtttcaaagggtaagggtaatgtaggtaaaattaggattcaatttttttctgtaaaaaactttgcatatcttaatttttcaaatgagacatgtttgacatgtgaaaactagttcgacttgtcataacatacatataagtcgaaattccccctcccaaaaaaaataaaaagaacttgattgggtggattttgtgtgcggccaactatatcactacagggcatgttcggctgcaaggtgcagctgccgaacaggcccacaaccaaagagggcttagagcccatttccatatgaatcacaaatgaactctatgttgaagacactaatcctagttctactatgttaagaaagctatctgttttgcagcacttgttttaacaaatataattgcaaactctcatggggtcgtgctgttatttgcagtttataacccgccaatccatgcagtacgtaatcggttgctcatcaacatgcgacaacgtagaccttaagaatggctcatgctctggtgctggctgctgccaggcagatatcccgaaaggcatacggtattaccaaggttatttcaatgcaaactacaacaccactgcaatatggaggagcagcccttgcaactacatggtagtcatggaaacttcagcattcaactttagtaccacttatgtcgactccacagtattcagtgatacgtacaaggggatggttcccactgtcttggattggacagttgaatggaaaaaatgcgaggaagcaaaagagaacagaacttcctacgcttgtgttagtagcaacagttactgtgtcgatgccaccaatggtcgcggttatcgttgcaagtgctctgatggatacaagggcaacccatacatcacggatggatgcgaaggtccctttccggccattttgattcctctacccctgcaaattaagagatgtagaaaaagtattatatttttaagtctttttttggcagatatcgacgagtgccaagatgctcatccatgcacgggaatttgcataaatacgcaggggagctacacatgtacatgtcaacgaggaaaacatctgattgacggtgtttgcaagcagagttcctcttcttggattatacctgtcataggtccgttacactcttcagcgtctcaaaaaaaaaggagaaattgtacattgacaccaatcttgaacataatagcgcattacagtaaaaccaatctgaacatatagtaggaatcaatcatattattcatgttcattaaaatttaaggttgaaaaccccggaaatgctttcaaatcatcattttggagtaacatcactttggaaaccatgcaggtggaagtattggagttgtcacccttgtgactattgtgacgtgtgcatatctcatccaagaaagaaataagctacacagcataaaacagaagtactttcgacagcatggaggtcgactgctatttgaggagatgaagggtactgcatttaaaatctttacggaagaagaattgcagaaagccactaataatttcgatgaaaagaaaatcctaggtcatggaggacatggcaccgtttacaagggatttctaaacggcaacactgaagtagcaatcaaaagatgcaagacaatcgatgagcaacaaaagaaagaatttggtaaagaaatggtaatcttatcccaagtcaaccacaaaaatattgtcaaactattaggttgttgccttgaagtggaagtcccaatattggtgtatgagtttatcgcaaatggcacactgttccatctcattcatgatggccacggcaggcacatctctatatccacgcgtttacagattgctcaccagtctgctgaagcattggcctaccttcactcatgggcatcgcctccaatcctccacggggacgtcaagtcatccaacattctccttgatggtgacttcacagcgaaggtctctgactttggagcctccatcttatcgccaaccgatgatgcacagttcgtcacgtttgtgcagggaactcgtgggtaccttgacccagagtacatgcaaacatggaaattaacggataagagtgatgtatacagttttggggttgttgtcctagagctactcacgagaaagaaaccattaaattttgacgggctagaggatgagaaaagcctatctgtgaggttcctttctgctgtcaaggagaacaagcttgaggaaatcttggatgatcaaattaagagcgaggagaatatggagattcttgaagagattgctgagttggccagacgatgcttggaaatgtgtggtgagaataggccatcaatgaaggaagttgcagaaaagcttgatagcttgagaaaggttttgcaccatccttgggcactgcacaatcttgaagaggcggagagcttactaggagagtcatcaattgttagctcggaggttgtcagtacgggaaatttcagcattgagaagaaatctttaataggcctagaatcaggaagataatcgctaataaccttgttgtatatcatatcccaggaaattatataggtatactccaaaagtattacatgtataggtaatcgtcatcatatatggaatgattcatacatgttttatatgtgtagctcaaggttgcatcattgttaagatccaaaggtgaggttgttgtttcaattgctattgtagctttacctttcaaaaatctatgtacaatagtaattgatttgatatttgacacacattttctttttatagtttgatcaattctcatactgctaacaaatcacgacaacatgtacttttcaagaggttaggatccatatgctttgcaagtttatttattctcagaaatagcttatcagtaaccattcacctgcacatatattgaacaccaaggcctgccgacatactataattagatctcctcataagaaactaccgttcattataatcttgcatactccaataatcaagagagtggcataatatactttgcttgtaagccaaccgcttaaacattctattacccataggtcaatctccatcagaccaattgaaaaaaaaatagttttattacccataggtcaatctccatcagaccaattgaaccaaagaaaaaaaatagagcaactatgtgtatgtaaattgtttcatagcaaaacaacattacctcacaatggcatcagtcctacagtggctggtaatggcatccgtattgggagcatatactcctgaaatcaaactatttgtcccacccttccttgagaatcgttgtctgctcctgtaagaagtatacataaatataaatcagcatcttaaattatataaaaaaaaggattaatctgaaggcagtttctgaacaaaccgattgttatcctactccaattaacatagactttttagagaaatattaaaacgcttaatttaaaccagaactataaatctatactctaaccaacaactaaaaaaagggttggtactccaaccagtatgcagttatgcacacgagggttgggatgggagcattggacctcgggatgctgcatcaggcggtggcggcaggagattaccggaggacgggatctaggcgttcttccgcgcctgcttgatgcggtggtggcggcgccgcccttcctaccgccggtccgcccgtctctcggccgccgcatcgattgatgatgaggggaagaaacctgcggctgcttgggcttgcggtgcgaggctgcgaggtgaaaaagaggccagtgttgatgggctccaaaattcagattggtggcactggtagcccaataggacttttgtttcggtaattgggttttacatggttctgtagttcgaattgggcctcgtggtggataacggataactggcccgtacatcagcagagctgttgatgacgaggcaaaaagtccagtttgagtccctcagatataggtcgaatctaaagtgcatccctcaaccgtaagaccgggtacaaagactccttcaactattaaaactgggacaaaatgactcctaagatagtattgaaggtggttttcgctgacgtggcatccacgtggcagcttagtcactaaataaactaaaaaataaatgtggggcccacatgtcggtgtcctttctttttctcccctctcttttttttcgaccacgtcagcaatacaaccctccacaacaacggtgccctgcactcgctcgatccgccttctcccccttcttcagcatcggtagaggcggtggtgccgtgcactactacaagaaggatttctccgtgcagagcttttgtccatctgtagccaagtgtctgcacccaaccgcacccgtgcggttgggttaagtggaccgcacgggataattgattatcccatgcggtcaaattataccgcccgcacgcaaccaaaaaaaaaagccaaacaaaaaatagaaaaaaatcaaaaaaaaaacctaaccttaaccctagaaacacccgtcgctgcacccggccgccgcccgagctcgcggatccgggcggggggcggtctcccgccgccgagcctgccactcctgtcgcaccgaaggagaaggagaaggagaaggagaaggcgcgagagagaggagagaagggggccgggggagagagagagaggggatagtgaggagaagataattaaagggggacagagaggagagaggggcggaggggagagagagagagaaggaaatttgaaattttttgaataggttgagagggaatggatattttcctgtgcgggtggattaggaggcccacatgtgaaaattgtgtatttttccgtgcgggcatgttaagagggccgcctgccaaaatcgattttcgcgtgcggcctcttaaggatccgcaggtaaaaataggaggcccgcacgtgaaaataggagtgatttttacagacgcacatgaaaaagctccgcacgagaaaatgggaggtccctgtctagaaaaatcttatgtgtagtagtggtggtaggctgcggctagcagaccttcgcgatgctgccctctgcgacgttgccgtcacggaaggcagggtgattgttatccacctagccttgcccacatcctgatggccctggacttggatgtggtgtaaggcggtgcagatggccttgcacttgtagcggcactcgtggcagcatatgtgcgaggccgttgtagcgccggcagcgcagtacctaacagctattctccggcatctccagggccatttgaggtgatgggcatcgtcgacaccctacgtgcacttgtgcttgctttaggtaatacaagctttcaatcatatgatgccataaaattttgtttggtttggttggttggtcaaggtgtttatgactttagttgcttcagttcatccacaccacctgtactactgatgaagaaaagtacacacattactttccaatagtagagagctaccgcaaggcccacgagatgaaatgagatgaaagcccaccaccggcaccgccctctcccctaccgccgctgccgtcgatcaccgttggttgctcccgctctccatcggctccaccctctcctacaccctcctcctcaccaccttccctctccccttcccctcctttgccggccggttgtgtgcaaagtctgggaccacgacgtcaatccaacgccccaagggatgcgagtgtgggactgcagcgtcgcgaactgtggctagctgtagccagcgccatcaccgtccttgtcgatgccagagaagggggagaaggcggattgagtgagcgtagggcgccgtcgtcgcggagggccgtattgccgatatggctgggaaaagaagagagtgaagaaaaagaaaggacgccaagtcgccgacatgtggatcacatgaatattttttttactttattgactataggcggccacctaagtaaaaaccactttcaacgttgtctttggagtcattttgttctgattttaatagttgaaggagctgttatatctaattttacggttgagggatgcactcttgttttgacctatattcgagggagccaaagtgaactttttcctcatgacgagggagaatatccggtgaaaaccatcgtgccagtgaaaattcataaaaacaatgcctaaaagatttctaaatttataaaaacaatactatcaggtatagtcataaaatgtattcataccagatcttaactccaaactcaacttccttccttttagagagaaaaagaaaagacaaatttcaggtaagtagtactccctctattccataatataaggcgcgcacgtattttaagatttaacatttaaaatatttgaccaacatttagtataatatgaaatgaattttatttgttaaaagttatatcattagattgacatttaaatttactttcatatgattatacttttgttgctacaaatcttatagtatatgagaaattataatctaaagattaattttggagaccgtgtcaacttttaccatgccttatattatggatgaagggaatattacgttagtattcacctagaaatttatctttttattactccataataaggtgaattgaacttgatatttgataataatgtatttcatgcatgcactctagaaaatttttttatgaatttataaaacttttaagtttggtttttatggattttcacttatttgattatttttaccggataaatcccctcgtaacacttttaccatgattgctttgtgatacttaattaattatggtttgtttcctggagaaaggacctgcatgccttatcgtcctcaagatgtacgccgtgccattttcattgctgtgttgtgtgtaagctggctttggagggcaagcagatcgatgattgcgacaatatagaaattcaaattagcatcagcgacgacttgttcccaggctcatatttttttattttccacgtgcatacttttcaaacggctaaataatacgcttttttttaaaaaaaatctataaaaaattactttaaaaaccatgttaatccgtttttaaaagtatttttaagctaatgcttaattaattatgtgctatgcgtgttttgctttacacgccagagataaggagttctaatcagtagggatgcaaatagatcgatccatgaatccactcataaacaaaattagtgggtaactcacaaattgaccggtggattacccaataatttagtctacaagtgagttcacgtgataactcatttgtattcctaggtacggtaaccagacctatacttatttgatctataagtgatttgcagctcagtccacttacatcactaccaaccagccagcgctagtagcaatttgaagatttcatatgtgtgtgcctattgtggtaacatgcaatggtcgatgaatatgcgaccgacaccggctagctagttcatgtacatacccaagttgaagccaagatcttctagaccgtggtattaacaaaacaaaggacccattaccatcaggtagtaaggtcgttttcgtgagttaagtgcacatgcatattgacatagtcttcctttgagggctcactagtcattaaatatcggcttaattaccggaaaatctacaagtttcccccatttcgtacgcgacaactaataatttcatggaatgtgaaacattatattgcagtttctcgttactgagaaatattagttttttttattaattttctcctaccccaatctatgcactcccgtcaaatccaaatttaggtctgaagcgtgtggctttagaaaccattgcatcaacttgccaaactaaagcatcaagcatggatcgaccagaagcacaaataactaggtgcctatttggtaaagttataactcctaaatttaacttcaggagttgggtctgtagtgaagttgtgaagctacctaaacccagctccaactctctattacagttgcctaaacccagctccacctcttttattttgtgagaaagctccacgtagctccactcctattctaggtagccgaaattgtttggctaagctctagctccagaaaaggtaaaactggcgttggagctggaactttgccaaacagactcaaggattctcacactaacctttccaaagagtaaattggacatatgaatttcacacagcataattcactccgacggtttttcaagctagtgtgcacagggaccctatctaatcatagcactttgaactatggcagtgtttagttcccttcaaactttcaaaaattttgtcacatcaaatgtttggacatatgtatggagcattaaatgtggacgaaaaaaaccaattgcacaatttgcatgtaaaattgcgagacaaatattttgagcctaattacgccgtgatttgacaatgtgatgctgacggattaattaggcttaataaattcgtctcgtactcccttcgggctgataatacttgttattttagacaagggtgaagtcaaactttagaatctttaattatcaattatttttaaaatatttgtcttttaaatatggtgactacatgtatagattagtcttaaaaagtactttaataaaatcatatatttgttaacatttttatacatattataatagaaaataatggtcaaagttattttttggagaccgtgctcttgtccaaaacaataagtattatcaacccggagaaagtagtttacaagcagaatctgtaatttgttttgttattagcctatatttaatatttcaaatgtgcgtccgtatatttagaaaaaattaacacacgaactaaacacgacctgtaatggactaggtatccacttgcatcaaaatgacacgtatatttgatcagacattaatgcgtttctcttcaaaaatgtgaaaaaataaaggtacatcaattctgcacgtagccgatcagtagcaccaccggctagcagtatagcgcgcggaattttgtgcagcgtgtcgatgtcatacgcaatgtctttttttttcctaaagaaagtcagtacaaacgcaggtcctcatacatatactcacccttgtaaacataaatacacacatcctatccctataaacattttctaaagactagatcagtatatcttgagaataatgaagtcatcactacggacatctcgttgtcgataggtacatcgtctataactaaaataataattagtcgtaactacgagcacctgtatcaagtcatgcactgtctttgatagtgttaagcatacaaagctcttccaactaagtaactttacctttttaaaaatttaccgaaaagttacatattttttttaaaaaaaattagcattatagattaagatttaaaatttggaactgaaatttctaacatttcgggtccatcgagccccccccccctcccccaaaacacacccaaaaaaacgagatgattgcgggtgattttttcgcgtatttagaaaaaaaatgttcctatttaatcaaattttgttcaacattacaaataattttgaaccgaaatttcagctatatcagtacttatagaaatagagaaaacaaaccgttataccctgctccagatatttaagtacatcacttcgagataccaaaattcatacgtcgatactttttcaagtatcgtaaaatttgcccttccaattaccatagacctgtcactatacatcaaagtatcaaacgaccggttctgcgaagcctccctggtgtcatttcaataacaacatgcatgcatccaacataagcagagagagtcttatttaggccagtgcatgcacccaaccaagcaacccattttaatataaagctacggcatcatatgccttggactgacacacaagttcttaatttgtcattagaatatcacataagtcctttcacttgcttgctctttgtgtacatctttcgccggagcagccagagccatcgccatcgccatcaggccgctaatggccagccgcccgccgcttcttctgcagtactcgtcgctgctgctgctctgccttgccgtctcggcgccgccggccgcagccggcaacgtgccggcgccggtggcggccgtctcgaagccgggctgcccgaccaagtgcggcgccgtggacatcccgttcccgttcggcatcggcgagcactgcgggctcgaggcgccttacacaaactacccgttcaagttcgactgcaagcccgttgacggcaccagcaagcctttcttcaggggtatggaggtgaccaagatctccatggaagacggcaaggcctggatgaagatgaacatatccaagaactgctacaaccagtcgacgggcaccagggaggacaacaccaacacaacatctgtgagcttcagccgctcgcctttctggatatcggacagggataacaagatcatcgtcatcgggtgcgaaacgttttcgtatatgcagatcaataatgtaagtatatgcccataattcgtcaatctggttgcattagatcacaaatactcaaatgtgttcataatatatggcctttaaaatacatgatagtctaaattattattcctttatatatcaaggacgacttaggatttgtcatgtgagaatattattagtttctccctttcacatgcatgtggaatgcgtgtggaaaatttgaccgctgctatttcaagttgacttttgaaaacgatatgacaatattttcctttaaaagtactttcaaaatattataaatgtgctatattttgtgtacattttaatattagtaattaataatcaaagtgatgtattggtgattgtgtaggtatccaaaacaacacttacttgtgaattggaggtagtgtgtatatatgagaaattcagagcataagtatatataattttgtagtggttggaagttggcatgtggccaaatggctgggtggtgtgattgtaagcctatcaatgtttaaatcctacatttcatattagtgtccatcgacattaggagtaaggagtacatatgagcatattcgttcaatggaaatacatgtgcctacctacaattcagagccttttgatacttttgatggagtatatgaaattgtgaatacaaacatactcttggtgtgtttagttccttggccaatttttttttaagtatacagcacacatttaaagtattaaacataaactaatagcaaaacaaattatacattccgtctgtaaactgcgagacaaatttattaggactaattaatccgtcattagcaaatgtttattgtagcatcatattgtcaaataatggtgtaattaggctcaaatgattcatctcgcaatttacatgcaaactataaaattggttttttttcgtccacatttaatgctctaacatgtgtccaaacattcgatgcgacgtttttggcaaaaaaaaaatgaatctaaacacggcctttctcaaaattaaagggtgtgcttgaaaatcgtgtcaattcccaaataggatgtgtgtgtgggggggaattatttggatcattgtcaaatcttgtattaaggtgtatatataatacgtaacatgtgcaggttttaacaggttgtgtgccctcatgcagaaacgaccccaaggacggtatatgttccggtgaagcgggttgctgcaaacttgatttccccaatggcacatggtactatagtacttatttcagtaaaagaaataataacagcagtccttgcagcttcataacagtgatggaaaccacaaccttcaacttcaacaaaaattatttcaactccactacattctatgacacatacaatgggttagctaaggtttccctagattggatcataacaatggattcatgtgatcgagtcaaaagaaacactacttcatatgcatgcattagtggaaaaagtcgttgtgttgatgatccaaagggaggttaccgctgcaagtgctctgatggatatgaaggcaatccatacgtcaaggatggatgcaaaggtatagtcatacacaccttcttatgcctgctgcctatctttgttacaaatgtataagataatgcaacaattttaaccaaatgtgttgatggtttggcttcagatattaatgagtgcctcgacaatgctacttacccttgtccgggaatatgtaagaatacgttggggaatttcacctgctcatgctaccctggaaactatatgatgaatggaatttgcattccaaatcagaagtctggttttcctaaaaatcttgtaataggtgagttcgtctcttcctataagaattaaaatggcatgtgagatcgatatacatttatgtttttgcttatacatttgtgctatatttagttatttactatatagtagctctatcgttttcctcatgcagatatagaaaaatataatcctaatttacaatgcctctactatatatatagttatatgtttaaaaatggtattcgttctggctttcaagtttaaacaataaggtgtgtatgcataattaatgtatttttcattctgaagctagccctcatttatctacccttttactttagcatttagtatacattcattcttgcaactatatctcttttctagatattcctaatattaatttgtacaccatagcaagaccagcaaccactgatgaatcatgcatgcatggtgtgtatttttctatagtaagaagaatggacacattttttgatcatgaacatttcatgttccaactaatgatgaaatcctcacgaactcctcaagttgctaaagaaaaaaataatttagtgaatcttcctctgccaatgccgatgtggcatatgtgggacttccttggggctagcataaagggatcaactacacattccaataatcttttcatagcaattctaaagttttctattatatatgcaggagcaagtgttggggccgtattactagtgattatagtaacttatgcatgcttcatcagagagaagagaaagctacagtatgtcaaaaggcggtacttccgccaacatggtggtatgttgctattcgaagagataaaatctcaacaaggcatttcattcaaaatcttctcagaagaagaattgcaacaagcaacaaacaagtttgacaaacaacaagtccttggccaaggaggcaatgcaactgtttacaagggacttctcaagggaaacacggaaatagccgtcaaaagatgcatcacaattgatatgaaacaaaagaaagaattcggcaaggaaatgctaatcttgtcccaaaccaaccataggaacgttgtcaaattattgggttgctgcctcgaagtagaagttccgatgcttgtctatgagttcattccaaatggcacattgttctctctcatccacgggaaccacaatcaacacatctccttggatactcgcttacgtattgcacatgaatctgcagaggctcttgcctatttacactcatgggcatcaccaccgatcctccatggcgatgtcaagtcctcaaatatcctcttagacaaagattatgtagcaaaagtttctgacttcggtgcttccatcctagcaccaactgatgagtcgcagttcgtcactctcgttcaaggaacttgtggatacctcgatccagagtacatgcaaacatgccagttaacagataaaagtgatgtatatagctttggagttgttattctagaattgctcacaagaaagaaagcattcaaccttgaaagccctgaagatgagaggagcctagccatgaggtttctatcagccatgaaggaaaaaagactttctgatattttagatgatcaaatcatgacgggagataatttggagtttcttgaagagattgcagagttagcaaagcaatgcttggaaatgtctggtgagaatagaccgttgatgaaggaagttgcagacaagctcgataggttgaggaaggtaatgcaacatccatgggcacaacaaaatcctgaagagatggagagcttacttggggactcttcttacgagatcaacaactcaacggttgagaatacaggaaatttcagcatcaatagtgaacttcagtgtctagaatcaggccgttaaatagaagtttgttatattgtgtcataaatgttatagtgtatcataggttgaagcacgtatggtatcatatatgccttgctgtatcttgggaattgaaagaaattatatttaattatttaagtacaggatgtatggcttgtcagtctttcagggtcggggctgtgaatcaccataattatacatatgcagatgcaaattttgatgtaaaggcaaaggcaattggctgcatcgtcttgtttgctctcctagtttctctttgttgtgataattgcctatctttatattcgtattcttggctctggggtttttctttactagcaaaggacatgtgtgttgcaacagaaaaatcaataaatcaatggaaaatattagtgaacagaaacaaaggatgtcaagcgtggggaataattcaccgcttataaacttttctaccacatacacaccatatcatagacttttaatatttctcatgaattgggaaaaagaaagtcaaattttgtcacatgacactcaaagtttgtgtaattttctactagacatcgcaaaagcgtgtcacggttggaggacaccaaaaaactcataatttgctatagggcacttttaacccaatcaaagagaatttttaaaaacgagaatacccctatagccaaaaacttctaacctagaattggagtgttgatggaatatgatatatgctagcaatatacttcggctgatggaagatttagagttgcataatttttattttttaaaatccaacactaacttagaagcttgtggccccaaaagcattctagtctatttaaagaatttttccaatcgagccgaaagtgttcttcaggaaattatcaaaatttgagggtatcatgcagccatagcacacttttctatgtctgatagaaaattacacaaactttgggtgtcatgtaataaaattttccaaaaagaaaaaggaagggaaaatagtgatgcagtgacaacctacacggtaggagtccatgcaatgatgcaaacggagtcaagtgctccactgaagagcaaagagactaagtagagtagaaagtgtcgggctctctgaggtactaaggtatgtcgcaaacgtgtgcagtcagacgtgtggggtgtaactgatatcgtgcgaggaactatgaagtcatatgagacgacggaaatatgttagattttttactagtcgagataaaaagatttaccaaatcctagctttacattggatggatgaaagtgaatattgatggatcctttggatgaaagtgatcaatgttgatggatcctttgaggctagccacaaaaaagggggtgttcagggaaacctatttccgctgcttgcacttatctgaacaggtgttgcaacgcactggaagctgaattgttggcgatcagaaaagggattgttctagcgcttcaatggaccctagctatgcccgatcgctttggaaacagattgctttctagcgctgcaattgatccaaacaaaagagaagaatttgtcagaattggctttcttagttagagaggtgtgtgaccacatgaatggaagtagggagatcttgctcgggaaaatcactgaagtcaaaactttgttagccactctttagctaataaggctagatatgaagctttttcgaattcttggttagattctaattgtgatgagttagcacagattgtaaaagtcgattttatttttgagtaattgattcctttcccccacaaaaaaagaaaaaagaagatgggaaccacatgcgtgcctactaatcatgtgtggaattgaccgcgccaaacccgctatgccaatcccggtccgcttttcgcctcttccgaagcctagccggcccaaccgcccaaatacatgcacgtcagcacatggtccatcatctcaccgaccggcaaaacctgcaccccgaagcccatcaaccgtgtaacttaaagtataagcccaaagacgagcgccccatgccgtgcaaaagcaaaccgttggtcctcgcccgtgaaaaccacttccgccacagcgaagccgaattcgtcaaaaacccgcgcgccggcctttgccccaaagttggcatcaatcgcttttgctcatctccttgtcccgtgcaggggaaccacgcatgcgtcgaccgaaagcacaaacctgtacatgtacgcctgtgtactgtgtacgtatgcatccatgggggccgcgtacgctgagccgtgcgcgtacgcgttgcacacttgcacccacacgtctacgtactagtggccggtagcagcgtagagctagaccgtttccacgagattttatcccgtctccgtcaggccgtcgtcctcgcagccctggcccatcccggtgaggagcgtagggctcctcaccgggagaccgcgcaggcccacctttgccggttcggccgggggccctgggtgagattctaagctctcggtgtgtggaaggctcgcgagaatggaaaaagcacaagacacgggcgatgtatacaggttcgggccgctgagaagcgtaataccctactcctgtgttctggtggatctgtgtatgaagaagctacaaagagctggagagccagagagctcttactctagaaaccctcttctccccttttttcctctcgtgggatctactctccagatcctccctccctttctaagtgggcaaggtcctccttttatatctcaaggggataccacatgcaccatctctctcttttgtgtggggacttatcctatcttttcataaatggacggagatttgtatggttgccgtctgaatgaccttctaatgggacggcccatacctacctccacttccgccggaagcaggcgcgacgtgggaacatggctgtctgctgacgatatgaccagtgtcagaccggtcacaaatcggtcattcttgtccaccacgcgtcagtttatcaatctgcatgttcgcccttcttcatacaatatcttgcttgtaatggttaggatgaagcctggcatatatctgaccgggaccaacgtgccatctccaggaggtaacacgccggctccggctagggacgagtgcttggaggctctcatcttgacgggatggagcgaggcatgtgtcagaccgcctgtcgccacctaatccacgatctgatcggtctgtgactggtcacagaccggataaacgagcgcgctgcactgcgttacatgcggcgtgacgcgcttgaccaaaccgcaataaatgcggttaggtgagccccgctgcgctcgcctaacccagacacgcggcgcaaaacccccaaggggtcggggcgcctcaaccctcggggccgaaacgggagcggtccgacccctcagggagacaaagaggggggcggccacatcaccctcgggcccgacccccccgagggggtcaggcctcgtgggtgattgctcctgcccaagcctctagtcatgatactcccggtcccatgtcaccgacagtagcccccggtgttatgccagggcgatcgccctcctcgagggaagcggtcgggcgtgacgccacttcttaaggcctggtgacaggtgggaccggtctccacagttgggcagaaacccaacgatcgcaaatcacgcacatcggcaatggttactcggctgccaataatgagcggtctcttcaagactgccacattactcgagtagcacgcgaatcgggacgagccggttcgttttgcctggagatatggtgatggcgcttttctcggagccatcagaatagcgtatagcatcttctgggcctgagggtatcgggttttggcgtcccggagggcctcgctaacaaagtagacgggccgctgcacctttcggcggggccgatcctcttcgctaggggccgcatctccagggcgctcttcatccgagaggcagcgcggggcgccctcggcttctgtgccgataacctcggggtcagagggcgacaggcgcggccttcccgtagtggccccgaggctatcctgagggtcgggggcgcctaacaccgtcggacaagcaggcggagggccaactccggccgtcgggggccttgggccgccgttcggcttgggggcctctcggaccctgacttctccccgtgggcagcgctggaagagttcccttccggaaccgaggacggcgcacgcgcgcaggtccgggacgccgccgaccacatcgtccacagcttcgagggtacggcccctcggctcgcgttcgccctcgactccgacgaggagggcggtgacggtggtgcggacgacagcgacgacaaggctggtgacccgggcgcgtcggagtgagcccccaggcccccgccaatcttgaatagctttttctttcttcttccgaggccttcgggcccccttcttgtatagactaatttaatctgcaaccaaataaagaggaaatttctatgtcaattctatttgttgtgtgtatgagacgaggatggtctgtgccgcggtccttctgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccaattcccccccggagttcaccacgccccggggcacggctcggttctgggccccgtttggcgattttagccgacccgagcccccgaggacagggtcgagcacgagtgtgctaattcaagccaagattcttcaaaaggaaacaatggcacagacacagtccttaggaaatcgaaaatgcttttattgaaatacggaagagaaaaaagataagcccccggccaaccctgcacgcccgggggggtgcggggttggcccgagcccaagacctgacacccgacccccactaggggtagaagcgacgaaggtgttcgatgttccacgggttaggcagctctgtgccgtcgcccgtggccagccgaacggagcccggccgggggacgccaatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcaaggagcgccggccttctttctgtcgctcgcaggcctcccctttcgggtggccagcgaaacgccctcgacggcgaggacatgaccctcgtcgtcggaatgggccgacctcttcttcctcctcctgtcccgccgccctgtctgagcagcggatccgggggcggccgaagctgccactccggaaccggaggggttccaggtccatgcctcctccttacgagccactcggtccgcaagctaaaaaagctccgcggtagtctggggctctttagaggcaatcttttcgagcatgcggttgtgccgcacaccccccctgaacacgtagatcaccgcgtgtgcagggatgcatggtatggtgttgcggacttgacagaaccgctgaatgtatgagcgaagtgactcatcatcccttcgctggactgcatgtaagtccgcttctttacctgggcgcggatatgtgccttgaaagttcatggtgaactgttggcacagatcctcccaagagtggacggacgcgggtggcaagttcattagccaaccccgtgcctgtcccttcagggccatgggaaagaaattcgccatgaccctgtcgtcacccccggcggcctcgatcccgatcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaaccgccgccgctcgccgcgccctccgccttgatgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagtttggagcgcgccctgggcgtgctgccatcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagaggctgtgcgcctttgcttgttcggccattgggctgaacaggaaaagcttggcgcacacgaaagagtgcgagagcttagaagaacacacgcagaaccccctacctggcacgccagatgacggagcgtggggctcctcaccgggagaccgcgcaggcccccctttgccggttcggccgggggccctgggtgagattctaagctctcggtgtgtggaaggctcacgagaatggaaaaagcacaagacacgggcgatgtatacaggttcgggccgctaagaagcgtaataccctactcctgtgttctggtggatctgtgtatgaagaagctacaaagagctggagagccagagagctcttactctagaaaccctcttctccccttttttcctctcgtgggatctactctccagatcctccctccctttctaagtgggcaaggtcctccttttatatctcaaggggataccacatgcaccatctctctcttttgtgtggggacttatcctatcttttcataaatggacggagatttgtatggttgccgtctgaatgaccttctgatgggacggcccatacctacctccacttccgccggaagcaggcgcgacgtgggaacatggctgtctgctgacgatatgaccagtgtcagaccggtcacaaatcggtcattcttgtccaccacgcgtcagtttatcaatctgcatgttcgcccttcttcatacaatatcttgcttgtaatggttaggatgaagcctggcatatatctgaccgggactaacgtgccatctccaggaggtaacacgccggctccggctagggacgagtgcttggaggctctcatcttgacgggatggagcgaggcgtgtgtcagaccgcctgtcgccacctaatccacgatctgatcggtctgtgactggtcacagaccggataaacgagcgcgctgcactgcgttacatgcggcgtgacgcgcttgaccaaaccgcaataaatgcggttaggtgagccccgctgcgctcgcctaacccagacacgcggcgcaaaacccccaaggggtcggggcgcctcaaccctcggggccgaaacgggagcggtccgacccctcggggagacaaagaggggggcggccacatcaccctcgggcccgacccccccgagggggtcaggtctcgtgggtgattgctgttgcccaagcctctagtcatgatacttccggtcccatgtcaccgacaatctcgatcgtcgatcgacgtcgtctcgctcgtctacttgcacgatccctgcaccggatgcaccgcaccgatgagatgtgtgctgtcgttggctaagctcgtttgcaccctcaaaagtaacatggatgtctgcatgcatatgggccgtgtgtcgtcagaaattcagaagctgtacgtacgtacctgtccagtgctgttcctggctcccgaatagaccgtacccgtgcttgctttggcattttgtttctttcctggagaaagttcctggatgctatttctaagctgtgtgacagtgcgagctggctcttccagtattgcgacactcctgcaggcaagttgtccaagttgatggttgcaaaagaaaaaagttctccaagttgatgtttcagagatattccttcaagttgagaatgggatcggctagtatggccggtttgcctgggccaatctttatatagctttgtagccttttatatttatataatcaagttactaataatcgaaataaatagttgaagtagtgatatggtttgatacagggcatatcacgaggaatcagatggactacttgtcgtgatctttcgaggccaagataagtttcatttatcaagatagtgcgaaacgcactattgctacgatcgaattgtttcctttgttcccggtcatgggttgggggaccagaaaagtgcagtcatattctcatatgggcggggacagtagtcacagcctcacaggagtcctacccaagattttattggtggttaacttgttgttcggcaaaaacattaggaaagcatgactaaaacgccgactccattgtgattaattattaatttatattgtgatatgaaatgatctagtactacatttgtgaacaacgaccataaaaaagtttgaaatgaaatttgtgtttgatatacacgtacgtgtagctaactttttattaatttaatactccccattttaaattataagtttttttgactttggtcaaagttaaattgtttgaaattcaaccaaatttgttgaaaaaactagtagcatttttaacccaagaaaaatatattataaaatatattcaattagcgatttaatgaaactaatttggtgttataaacattattatatttgtctataaatttgattatacttaaagtagtttgatttttaactaaagtcaaaacgacttataatctaaaatggagtaagtagccgacttgattgtttaggagttttcttacaaaagaaaaggatagttgatgaattcattagtcccattatcataccttgtaagtattctgatccgtttcaaaaccatactaaggctgtgttcggatgcgccttttcccaacccctctctctcgttttctacgcgcacgtttttcaaagtgttaaacggtgtgtttttttgcaaaaaagtttttatacgaaagttgcttaaaaatcaaattaatccatttttgaaaaaaatagcaaatacttaattaatcacgcgctaatggattgctccgttttccgtgatcactgttccggatgggaacttgttatagcgaacacagcctaattgtcttgttgaaaaatactaagacttgaatatatgttaattgagttttttcccatgctgttgttaaacctatataaattggaaacctttttataagaaaattcccatgttaaaatatatctagcagttgactattagttaggtggatatatgattctagatctattgaaaattattgttaaaaatatacagtcgaaaataacatgaactctttaacttttactttgtctctgaactgaataaaacatgatcaatatcgtggatccttccgttgatttttttttcaaaaaattagaatcaataaatcaagctgcacctagagttttccagcacaaaaagctttatatcgcatcatctttcagagcaaagatcgaagaggccagaacttgtgttgcaacaggcgcaaagcacctcttacttatgctgccatagtattttactacatccgtcccaaattagatgtcattttgatattatactttcgtcttatttaaaagattagtgcaaatataaaaaaaataagtcataccgaaagtacttttgataataaagtaagttacaataaaaaataaataataatttcatagtcttgtaaataagacgaatggtcaaacgttaaaaaagaaaacttaaagcagcaagtattgtatttacttcttgtacagttttttcttaattgtacaagtaactttttactcctactttttccaatgaaattggcacgtttgttgccggtttaaaaaaaagttgcacctaagttggactctcagttattgttttattaatttattttaaaatttaaaatggatatttagtaagtcgtaactaatagatcatagaatccttatttggctataactctggaacatagccaacatatttattgtatgattaaaattatagtatttatactatcaataataatagcatgtataaaatcaggttgacaagatttattcaatctattatacgaatttacgtatcatgactattggataagaagttgcttatccatgttcattactagtcatctctaccacttctcttcacatttaattagatacacatcatgagttatcttaactcatttgttcaagttagtataaaattaccaaccattggatcaatgagtttcttgttcttatttattaatcctctcttatgctaagacatttgattgtgttagtataacattatcaaccgttagattaagtggttatttatccgcattcattagtcatctctacccctcctattcccctttaactagatacacataatgagtaatcctaatccatttaattatgttagtataaaattgtcaaacgttcgatcaaatcctaacctatttgattatgctagtataaaattatctatcattggataaagagttacttatctgctttcattagtcatctatgtccctcctctccacctttaactagatacacataatgagtagtcctaatccatttgactatgctagtataaaattatgaacagttagataaggagttacttatcttattcattggtcatctctagcccttctctctccacctttaactagatacacataattagtagtcctaatccatttaattatgttaatatgaaattattgactgttggatccaagagttacttattcgcattcattagttctctcttatcctaatccatttggttatgttaatataaaattatcaaccattagaatgggttacttatcggtttatattagtcatctctatcccctcctctccacttttaactagatacacaatataagtaatcccaagtgtttgatcatgttagtataaaattaccaatagttagatcaaggagttacttatcaacatttgttgactctctcctccctaccttttaatacttatatatgtagtaacaactcgtgatgaggaatacgaactaaatgggagatcgatgcagtacaatcaaattgcagtatctaggttaaacaagcacgtaatattttgattttatattagtacatattcatttcctatatttttcttcaatgaaatgatgctttgaaaaaaaaaaccttgaagcaacattttcatccgataattttaaatttcaatctttacacaatgctaaatttaacaaatcccacagctaagacgtggggtattttctactgttgttgtacactatagtaggcctagtgctactacaccacttggagagatagaggtgacaacaaggttttttttattagtatgtttatctaccctcccatgcatggcagacaattctatgggttactaaagaaattgtgtaattggttttagcatttggatgattcatcaagagtgtaaaatatatctcttcatatcaccttaattgtttttagtcttttgatgatttagcaagagtgtaaattgcacatcttcctcctaaaggcacaccatacaacctaatcatttataacctttggataattgataaagttacaaaaatatataaacatgcacacaaaaaaatagtatagtaggtaagaaagaaaattttagaactcatatatactatattatcacacaattctcccacaacaacacgcggggtacccatctagtagtaatagaaaacacatggtaaccccatcaaactcaaacgaattattaaaataattagattttttttcataaattttgtgtgcttttcacggtttaccgtaataccaaggttactgcttgataaccgctcttactgctagggtgtggtaacccgagaacatattatgtgtacacaggcttttttacacatcgtgcgcactagctaacaaagtttaccaaaaatcattgaaaaaaatttacatgtactttcaatagtattacacttatgtgtaaagttttaacctcatatttgttatgttttagccgcaaaagaataaaaatttgacagttttaaaggttataaatctgacagaatttttttatgctacgtgtatattataaatgtgaatatgagacattacaaacaatactattagaagtatatgtacaattttttataaaaactttgataaaatttattagtcattatgcacgatatatacacgagaagacttgactcggcctcttacgataaggtaaatcttactctgttgtatagctgtgccaaagcctatgcaactatctttatctttgacctagtgtggaagagtctcaccattgattatgtatttattcttatttattatgtttatctacttttagctacttctatcttttattcttatatatcattaaatatttgtgcctttatttttcctaataaagaatggcactaaaatactacgccttctttttccaaccggaaaaagaccccaagtcaccatcgttttttacaccgctgctctccatttgctccccatgttcccatgattccatcccggttcctgggtcaacatgaacaaaaatcaaaatccacaccacacacaccatcgtcaatcacactcaactcgcggtcatcacacactacacaatcagtgtcccatagctaaaaggtccttttgattatgtttttagcttattaactacacgtaaaataaataaacatgattaacatataactaattaaatactcattccatctacttttgatagttatatttcatcttgacacacagaccaaggataaataagtctacttatcatccatttaaacatgttactagtcattcctcgtaacaagcgattcattaatatttacatttctcgatgcccatgtaggcagttttgtgtggaagaatggagattaacgcattaaattcgagaaaatcattaagatgataggttgttggattgaaatatgtctatcaaaaataatttttttagatttagaaatatgactgtgaaaaatagatggagggattattaattaataaaaccctaaaattagatttatttgatttttttaaatatcttctatatatactcattctattttaaaatgtctaacgccgttaacttttcgtgtagcgtttgatcatttgtccaatcaaaacatatatatcatatattttgttgtgacatgttttatcattaaataaaatataatttaactcacatttttacatatttatactaaaattttttaataagacgaatgatcaaacattgtacgaaaaattaacggcaccatactttttcaaaaaaagtaatataaagttttcataaaaaacgcaccatttaacggtttgaaaacgctctccctaaaaacaaagagatagccaaggctagtactccttccgttttataatgtaagtcattttatcattttccacattcatattaatgttaatgaatctagacataacatcaatataaatatgaaaaatgctagaatgatttacattgtgaaacgtgaagtagctgcttagaacgcgccccaagtcaatgcccccctccttccctactccctatcaccggatgcacccgtgctgatatttttgacgcacgcgctagtacgctacggtcagcaccattcaccaacgccgcacccgcatgccagcctgcgccgcgcccggccgtactctaccctgtacaacagccaaaccacctcgcgtcctcccgtccgtccgtgcagtgcaccactggccggctgggttcccctgcaccgcgcggcccgtgtgtctcccaccctcccgtctcgagtctcgactcctctccccgtcccgacccgacacgtacctccccttttctataactacccaccaccccgcccgggcgctagtagtacagagcagagcacagcagaggagatcgagcagagacagacagacccgcaggcggaagcggaggcagggcaggcaggcagcagcaacaatcccccacctgcgcgtgtgcgtgtctgtttcggtgcttcctcctcctcctcgccatggcgctcctcctcctccgacgcggcggcggcttcgctgcggccacggtcctcgcggtcgtcgtcgtcgcgctcgtcctctcctgcggtggtggcgcggaggcggccgtgagggacctcagggtcgggtactacgccgagacgtgccccgacgccgaggccgtcgtccgcgacaccatggcccgggcacgcgcgcacgaggcccgcagcgtcgcgtccgtcatgcgcctccagttccacgactgcttcgtcaacgtacgtcctcgtatcggtgatgcgattcgaattcttccgtttctcctcctccgccgtgccgcgaaccgatctgccctctcgcggtcactcttcgtgggtttctgtgtgtgtgtgtgtgtgtgttttgtttttgtttggtttttctctccatctgatcgggcgatctgccgtgatttggttcgtcgtgttcgagcaggggtgcgacgggtcggtgctgatggacgcaacgccgacgatggcgggggagaaggaggcgctctccaacatcaactcgctccgctccttcgacgtcgtcgacgagatcaaggaggcgctggaggagcgctgccctggcgtcgtctcctgcgccgacatcatcgtcatggccgcccgcgacgccgtcgccctggtacgtacacacaccccctcccgccccgccccgccgcgtccacgcccactctagtagtagtactagtagtactacgtttctcttccattttcctcgcgtttccgtgcaaaatccgctgctccgcctctgcctctccccaacccggcatttccctcctctcaggaggcacccagcctcccccaggcaaaagacaaggaagaaaagtgccaaatatctcgatcgttttttgtcatggctggctgcccgctgtgcgatgcaacgcctatgcgtaacgaacaaaaagttagttcatctcttcgctgcatggttggtcacccccaacccaggtggcacaacacagccctgacctcgttgacgaaccaacgagcgattgagaatcgcctcgcctgggagtaaaatccggcggttggcgctctcgtcatcgtgcgtacggtggccgtagtcacgtgtgtgtcacatgccgtttcatatgaacttgaaatttggattactccgcatgaattccattcggaatcatccaaaacaaaggcgtgtgtgcgtgtgtttgaaaatcatagggactgacgaaaatctccgaaagaatcagtgacccgaattgtcaaaaccatctttcgttttcctctcccttatcctttcatgtgcactatagtcctatgcccctgatagggacggtacagtgcatgtacccgtgctccctgtaaccaccacactgaacatcaagcgggggcaaggttgcatgaaccgtcccctcggcgtgcacaagacaagcgcgtttgacgtagccgccgtgcagcgagccgggaaaggccggacggtgggggagctaggggccatggctacgtacgtgaagccgaacggccggagctgcagttgtatagtcctttttagacttttccgtgcaggcgatcgtgtactgtgtcggggtgctgtcaaaacttgtccttgttgatggctcatcgccgaggggaggaggaggacctaggacggagacaaagcagcattgctttcgcagtgggtcacgctgccgatttgtcactatgctagattgctagctagccatgttctttttgagttttacacttttcacgcggttgacatggagccgagtatgatttatccttccgttgcattttcattttctgacatttgataacgtaaacagcggctcttaactgtactagtaactgaactgttctgtcatgagtgggccgtactaatttggatgtaagcaaaacacataatgctcttattgtcattacgatcttgggttgaatttgctgttttgcatgcaaatgtacaaatgtagatacaaataaatgatcatacgttgcaatcaatatccatgtctgcacaatgctgtaacattggaagatttgggttgttaatttccaggttcgtttggctggtcagtgaaattattgacttgatttgactctctctcctcctttcttgtgtctgtatcacagacaggtgggcccttctgggacgtgaggcttgggcgcgaggacagcctgacggcgagccaggaggactcggacaacatcatgccgagcccacgcgccaacgccaccaccctcatcaagctcttcgccggctacaacctcaccgtcaccgacctcgtcgcgctctccggctcgcactccatcggcgaggcccgctgcttctccatcgtcttccgcctctacaaccagtccggctccggcaggcccgaccccaacatggaccccgcctaccgcgcggggctcgactcgctctgcccccgcggcggcgacgagaacgtcaccggaggcatggacgccaccccgctcgtcttcgacaaccagtacttcaaggacctcgtccgcctccgcggcttcctcaactccgaccagacgctcttctccgacaacgccgggacccggctcgccgtgaggaaattcggcgaggaccagggcgccttcttcagggccttcgtcgaagggatgatcaagatgggggagctgcagaaccccaggaagggagagatacgacgcaactgccgtgtcgccaatgccccggcgccgccgcctgtggaggcggaggtggcggcgacgtccaaggcggtggtcctggtggacttctgacgaacgagctgctagtcccctgactccccagctgttggtgttcgagaggagctgctcagatatgagagtgttgtggctattcatatatgagtttttggtccgatggcaggtttgcacctacctgtaagcttgtgatttcagggttacccgcttattgccgattattgaatggtgataaataactgagaaatcgagctaatgatcattgcctgatgtggtttggtctctcctttctagtatgagtgataaggctaagccaaaggtggcatactggcaccaaagaccgggtctggttaattctcggtaatgcaaagttaactaggagtacgtagtagtagttcataaatggagaggtctattccaaacagtgggcagcttagaaaactagtggtagccattgacattgcgtagaggagcacaagagcaaaactgtcaaaaaagcattccaacaccaactggtaaataagcatggtagaaagacaaaccgacaacacacatgcataatcgtatatacaagatggcgaggtgcaatgtattgtccatgcaaatgctactttaagaaaagcagtgagagctatctgatctgatactctggaaaagcagagatcagctatctaattatacatgctgtccatgtctattgtgagctcggggcctacatatggggcccctgcaacacggaaaccgtcaggcaagtctgcctcttccagtactgcaaaacctgagagaaagccatcacactgtcagaaatctcaacagatcatcattccacggtcacctgtgctgctatgcaaattagggaccttctatcatcatttgacaaaaaatcctttaatattttagaccgcccgattactttatgttgtgtactactcccttcgtcaaaaaaaaaatctaaaactagatttgacatattctaatacaatgaatctagatatatgtactagcctattaggttttctatgggacagagggagtacaagacaaccaaaccttcaaacccctcccttactctctctttcttccgacttcccctcatcgccactaccaccaccatcgccgctgccacccaagcttgtcaactgactagaagtggtcaacaacatcggtaagatccctaagctagcctcttccccgcttcctctcctcaccttgtcctcaagccggctacccctgtgccgccatcttcccgtggctccccataactggatccgccaccacctcctaactttgttctacatttccccaccagcccaccggcccactatccacttccgaccctgtagttttggcaataccgcggtcgccttgctgcccacccgaactgttgcctcctaggttatcctctaaaactaacgaacttctctaacctaggactctaatccgtaagttctctatcaaagtttggaatgttgccagtgttggaaaagatgaggagatcatcggggcttaaaaaaaaagacaggagcatgaaacgtgaagcacacccaatgatccaaaatatgtaatatttgaaggtattttatatcgaatgaaggttagcgattcctatgcatgcatgttgtgtgcgtaccagggagagaggggatgggaatgtcggagaagtaggtggacggccggccgaggtcctcggcgtagggcggcgctagcacgtcgaggagcgcgcacggcgtgacggcggtgagggagtggatgttgccgccgctccgcgggaacaggaccgacgccttgcacggcgcctcccgcatctcgtcgacggcgaccactcgggctaaaccacctgcatgaaaaatactatattcctgtgagaatttcgttactgtctcttcttgagaggattggtggacttttggatatcttgccatattggaaagcagtgggatggcgtcacttacttttcttttttttttcttagtataaaaacggcaatttctgatactactagtagtgcagttgtttcattctatgtacactgttgtttttccaacagcacgtggcttgggcttccaaccgaagtaagctagtagtaattcaaaaattaatcgacagaggctgcaagtatccaaaaagttattccagtttcaggcgagagctatcttttgcaaattccaaaccattaaaaactgtatcaagagtagagcagtggacagggagagataggttctcctgtttatattgctgaaaaaaaatgctggtttggtgagacatcggtgggatttggctatctgaaaccgtcttttacaaggattttgtagggaggtattaatctcatcctgcttgtaaattatcagagacctttttctgtccttgatcatagccaggtaacctcaaactagtatatgtaggtgagacaaggaacaaatgttagatgcagttgacaacttgacatcagaaaacgatcgagtttttttgtcgattgatcatcagcgagcgaatcgacggcaaacaggcgcatgcattcgcatgcagctgagacaaatgcttactcttccttgggcccgagcacgggggcgcgttcgcccagtcgtacgacttgacccgcatcgagccgtagagaagcttgctcagcaccaccatttgcgggtggtcgtgcagcggcagcgtcgcgccggccgggaagcagaacacgccgatctgcacgtacgtacgcagccgcgcaacaccgccaccagatcgagcgtcaaattggtaccatctcacccttttgcgaaagtgcaaaaaaatactaagaagaagtgcatcgttgcgcgattgcgcgcgcgtgcatgcgtaccgagaaatcgtcgcactcgtggatgtgcacgtaggtgatccgggtgaacgcccgcgccgagagaaaccgccgccccggcgggctcctctcgtcgtcgtcctccgaggacgacgacctctcgccgccgctgccgccgccttcgatcccgacgtccgccgcctccatgccatctgcaaaatcagcaaaatgaaccaacacattaattaatttgcacacgtatgaaccaagatgcaatgaaagataggagtataacgtaccgagcaggtcttgcagccacctgatctgcttgagcgtcggcaaccctgctttactccccgacgagaagacggcgtcgcacgcgtcgtacagccgctgcaccttgctctggtggtcgtccatggccacgcgctagctgtgctgccacaggaagcgaagtgacccggctggttttaactttcacacatctacactacacaaaacaaccgagcaacctgcacttgtacacacgtatatatccagcgcgtagtacatacgtgcgaccgcagaaagctgacggtgagcgcgcgtggcgattgagagataactgtgcaaatgcaagtgtgtttcgtgtagtgactacgaagctttctacctagcttcgtgacgtgcgttcgtgcgttatgaggcaggaagaattcaagaatttcaaggggatcgaagggtcgcgagggcgtttaccggcggtacaaaccgtgggcgattcgactttacagggggctggctggctcgctctgcacgcacgcaccggtaggcgagctgtgcgatctcctctgctcgtgtacatattgtgtggcttgatcgatgcgagagtggatcctaaatcctcgagaagatattttctgtttatatgtatgtcatttaaatgactatgaaaaaaattaaaaaatataataagataattaatatataataaatcactctataaaaataagttaaaatttaatttctacatgttacaacgaaaaaaacaaattaaactatgaccagttaacgtatattcacagtcaaatttatttttttcgctataacttgtagaagttaaatttgaccttgcatatttgtgaaataatttatcacatattaatctatctttttaatttttttaattattttcatgacatgcaaataattagagattagctagagttaaaaatagttttccgttgatacggtcatcacgaaactactgttcgcgatactaaacaatcggcgaatgcagctgggtaaataggaacttttggtcgcatggaatccggacacggccacacgggccattttatttttcggtttttccatgtgggcgtcgctgttcggttctgcgaaaagagtttgaaaacggcgtaaaaataatgtacgctaaattcttgcaggggattgattgatctgaagaggggcagacgagcttggatgcttggttgcctggttggaacttgctactgcgggtcggttattttatatcgatcggcatgcaagattacaaaaccatgggaacgctgcactgtgcatgcttatccgttaagcatgcggcccaggctgggataatactactcacagaccgggtcgttcttgggcagcagtttaatactagtagtatattcaaaaaagattttgagtaaaaaattcagttttagcagcaagccattgggtgcagtcgtgcagagcggtttatacgctctggagctggagcaaggtcgctgccctgtttgcagttggcatggcggcgatcgatcggagcacaaagttcatccatcggacaacagattgacccatgatattacgccatgcaacgcaactccaagaggacaaagacagagaaccaagaaaccgaagcggaagacgagaacaccggcgccgtgtcgtgcgcaaccactctgcggctcggctccgtcgtcgccgaccgtttccgattcacgcggaagcggcaaaacgctctccctgccgcgccgtctcgcgttccagccaagcgagcctcttgcctcgtcccgcgcgggggttcggagtagcttttggctactttataaccatccgattacgggtgcacggtcgcagatcgtggcttaacttaacacaattgcgtgtatttttgcaaaacgtggcattggttggcgaggcaacggcgagttggtgacgctggcaacggtttccggctccggcggacggcggcgagctgctggagtaaagtggtgtgtttgcaatccccatgttcccaacccctctccctcgtttttcgcacgcgtgtttttcaaactgctaaaccgcagcttttcttgcaaaagtttctatacgaaagttgcttaaaaaaacaaattaatccattttttaaaaaaatcagcaattatttaattaatcacgcgctaatagactgctccgtttcccgtgatcactgttccgattgggaaccgcttctagcaaatcctgctcatgcttgaactaagaccttgtttagatcctccaaaatggcattttgccattttgtaacactttttgccattttggatctaaacactagtagcaaaagttggtaatttggcatttggcatttgctagtccatagtagtaaattgtgccaaaaagtgctttgggaccactccttctctctttctctctctctcactttagtgctagaatggcaaaactttaacatgcatctaaacaccaactaatacttttgcaatgccaaaacttttgccaccaaaatttttgctatttgccattccaaatggatctaaacatgccctaactaatctgaaattggacagacgtgtttggacaaaactctgaatttgatagcggcaattagtgcgacatgtatatcagaagttcagaactaagagcacccgcaatggtaaaataaggtgctctctataaaatatgtacatctcagcaatagactagattaatagtaaaccacctcaatagtatgtctacatgggtatctatagctctctaatccattccctcatttttctctatagactatctctaggttagtagatagttgtgctctctctctcttcatttaatctctttcaagtagaaaaatatgctgatatggatctcttgtagagagcctatagataaccattgtgggtgccctaagctaaaattcctctgaaatcgttgaaaactgtgtctcatccacaatctttcatcaaagcgtacgatataatagtttcttatcacggtaaactgaaacaagcgagagtcagatatttaccggatgaaccatcactccgtcagttcgtcatcagcggaagatagcaacaagcattgcagcaccaaagtctaaagatcagaccacgtcacgatctgccggcgacggtgggaattggggatgcaggaggttcaaaagttttgcaaacgaaccctcttttccaagtctatttgcccattacaactcctaagggggttcggaaaataaaactccgaaccccattggttattttccaaccattggatcacatgtagtcctcctctgacctctcttcttccccacagaggcgcagacacgctctgtctctcagtcttgagacaagtgcgaccgtaaaatcaatctatgattggtgaactacttatctgaatgaatttagagagtcgtatttaagacaaaattatatatgaaacatagcaacagcaaatagagcaacgagtactttttttttccgaacgcacaaagggattacgcgtcaatatattagaagaaaaatagttttaattacacaacgcaatcggccaaacaggcctatgccgggaggtgggggaggaaaaaccaagaggctactgctaaacataggctactcaaaacaaacgagagatagaaggctgagccacgctacacttccagtaaaccccaaaagctgtaattcttctggaatcgtagaaaattgtggatcatctctaaagcactcatcaaacatgcattcttatctcaaaacactgaaacaagcgacagttacatactcaaatgaaccatcactccatcagttcatcgactgaaacaagcatgaactgcaagcgaactcacgatctgcatcaccagcggccgtagccgacggcggcaatgacgacggtgggaccggtgaggctgggaggtgcggaaacttttcaaaacgaaccctctttttcaagttatttacgcgttacaacttttcccaaggggtacggataagaaaactccaaaccccttgggtgttttccaaccccgcagaggtgcagacacgatccagttctcatcaccggcctcttcgattccaaaggttccagaaacttctacaaccataggtccctcgtcgcaatggaggttaggagacttggggcatgcttagctccactccctgtcgctatgttcgttcgctctatcgtcagccttggccagtggtggatctattatgggggtgggggcttaagcctccactactaatatgtaagtttatctagtttgttcagattcccctacaatttatttctagattcgttcctcggccagttgtcctgccgccggaggacgccgcccctgacgtcaataaggaagaaggtggcgtacatctggtgatcaaccgatgggcacggttacatggtgggagcacggaaatatcatgagttttcaagcaccggtgggcacagggttttcaatttcaaaattggtttttataccgggggtcatcgaaatttcagaaattttgagccgaaattatttgaaaatttgacttaaatttgattaaaatttgaccaaatttaaaaaatataaaaaaaagagaaaattttgggcgagatttgagcatgctggtggggggtgaaatttctgaaccaaaatttcaaaccctgggtgggcggtggaattgaaaatctctcgaatcaacatcagaagcaacgtaaacgtgcgagagctgacggcatttgcaggatatcctacgtagattttgatagtttggatattgcagcgtcaaatcaacatcagaagcaacgtaaacatgcgagagctgacgacatttacatgatctgctgcgttggttttatctgatgtatcatgtatggataattggatattgcaatgtcaactagacaacggaaagctatggtaacatgcgagagctgatgggatggcgtttacaagtttatctgattggatattgcaatgtcaaactctataataccccttctggaagcaccagggttgcagaaaaaaaaatcaactctgacctcccgagggatccatctggtcttctctctgtgatgtgtgaacatgtatggaatacaacaccagtagagttgaaaacctctccgagaagagtttaaaatggcattcacattctgtgtacatgatatttcatccgttccaaaatactccatgagcatattctttggaaaaattttgataaatgaaaaaaaaaacttttagtcatttcaatgatcaaaatttgaaaaaaaaaattgagagcatggtacaaacacgaacactcacatacacatgctcaccctcatttctatgaatattttgaattttgagttacttaaattcctgagcatcaggggcggcgccaggaaaattacaaaagtagggctgaatcagtgtatttcaattagacacaatatatgttcaaaatttttatatagaattcaaaggggattttggcccgagcctagggctcataccttaactgccctaggcccggctccgccattgccgagcatctcattggctaaaaacatatagattttcatgcattgaaattagtgtcctagaaatatttatatcatggtataaattttaaatcacataatatttatatagttaaagtggatggactaaatgatgtcctagcattacaacggtggcttctaatggcagtggtctgagatttggtgattgtgataagctgcttgtaaaaaatgttaccgcccctaaccccacggcctagttagggtgaaacgagaagccaagggcccatgagcccatcttctcgcgtctcactaagaaaaaggcccagtacaacatacaccaagcccgtctcatcgctcgcgtgacaaaaaggagaaacgagctgccattccatttccagctgtgactgaccgtgaggcacagacatgcttcccactggtatttccagaggtacttcatagttccttcccagagctaacaccttggatccttattgcaagactatctcaaagcaaagttgtcagatgaaagtagatgatcccgaaacgtcagcgatggatttcagtactttacgaactataatcaccaccagtgtagagaaagaacatcagacaataatccagaacccttcattcaggacaaacaacaattacaaacgttgggtgcactagacaaatgtgcaacgcaatgcatccgatggtagtaaactaactctcaaaatattgggctaaccctaaaaaacaatttgccttccggggtactaaaaaatgcctcttccagcttacaaactgtcctctccaccacaaaccgaaagaaaaggaaagagaagccctacactgcctagatcaaaagtaaggaccacctaaccaaacttgtacagatgctcaatggagatgaagcagcgaaaaatgataaatcattcaccctctccaagctgcagctgctgcagcagcctgttcatactgaatcatgctccgtttgctgtataaatacgaacaaatcaacaaataacttgattatataccatggaggtatctacagaaggattgagttgttgctcctgatcatcatttcttattgttgtggacagaatgtcggaaatgaaaccggtcgctcacaacaaggttttctgcaaactcaaggatgggggccatgatggcttcagcatttggcgcgactgattctggaagactgggtaggcagattggtatatgttcaccattctcctcagggtgaaaatagaatataactgctcggcagaaaataaacctgcaaattaaaagaaggaatatgatttggcacaatgcaataaatatggaacaaaataatgtcttggaatgcaacatggagagttctgattatgtacaggtatggtgctgtaaaaccatccttccactgttcccttttacacctccatagacttgttcacaagcccaccggcggtttgcaggaaatatcgcaatggacaggagctcaagttgtgtactattaactagtcatgttaaataaccactttcatgttttggaagaggtcaagatactatcttcaagcgatgatgcaatgctaaccttccaaccaaatggcagatagtcaaaacattgaatgtggagatatatggaaaaaggtacctgacgatcaggcgcctgagaaaaggatctggtaaaatttgtccccagacgttgttcaatccaacagatgtgcagaggattccttcatattgttccaaagcggagaaaagtatgatttccgcgttagcatatgtatcctgaaaaccaagcagaagagctcaaaatatagaaatcaatattccacaaatactcgactcttcaaggaaagtgcatacgctgtctatgtcagaagttatcccagctaattggcagaaggcttgcattggagctgtgaggaagtacgtaaattggcttccattactcgtggattccacaccaggcattgctgatgctatcctaggtgaaagtagcaaggcagctggctctcccttctctgcattatgtatagcctgcaattatggctcatataagaaattcgttctcccatttttttaagaacagggaaaaaaattgttagaaacataatgaaaagagaaaacccttcgtagtattaagttaattatcttttttttctgaaagaatattttgtttaaagtttttaaaatgtacttggaaaaatacagaatcaaatgatggattcacaagctactatggatagccagtgcctagattttagcaatacagtgatctatgaaaatggaaagaaaaatcatatgctctgttgaaaaaaactactgcagcttgctttatattacagtaggttaaatagtaggaacttcaaaacaaatgagaatacaagacccttcatccacaatgaatgtaaataaagccatataggaactacagaacaaaaggcatgggcaatccagggtagtaagtttggctctgaaaaataacaaaatactcatgataatgattttcatctaccaagctaagattaagttctgacaaacctgccttgaatgcatgactattttcactatcgataacaaggaatagtggatatcttgtaaagggaatcagatcttctggataaagattgtttggacctggtaaagatacagtcatgtcagaatagaaaatgcatactgtatcaacctttcaacaagaaactagaccatcagtctagtcggacactaacctagtataccataaaaagtgggcttaattgaactatatcattacactgagatataattccagaaatcaaccctacaagaagacagatgctttacctccacttccacggggaccaagccatagatgattatctgaattgccattggaatttggcttatcgatgggatacacggaagttgcccttgcatatgatgagcttgaggcatacttttgagaagtaatgttctgctcggaaaaacctgaaattttgatcactaaagttagaagggtaagaacctaataactactcaaaacaagaatgttactagatgttttacagagtcagatcaagaagggaacctgatgctgatagatagacaagtaagatgctatcttgagaaagctcctcacagactgtggctagaacctgaaattacgaatttctgatgtaacactacaaaaaaggttcaaatagcaaaagaacaaatcatatggaccatcaaactcgtgaatgaataaaagtacattccaatggattgcaacaattaaccccattgtcaatcagcactgcaacttggcaaagctgaaatattctcacatttttccatttgtgtcatgagaaatggtacagtatactgccaaataagtgggtggttccaccaccaaataaattataatgtgcagcagcagccgatctaactatgacaacatccaggcatgatgaggacttgcacagacttgctaacccaacacaaacgtcaaccagacaattgtattgatataaagctaatgacattgttaaaggggaaaatacgcatccagttcactggatggtgagcataatatatcatttcaagagtaatctcctaaaagaagatccgtgattctatcaagatttgatttccatcttatgtaaaactgagcttcaaagagaacaacatgcataaacaacctaccgctagaagatgagatactgtaggatgatatatgattgccttttgaggatttgcaggaagatttccatcagatatttctgatgataggtggatatcaatcaggccagagggtccactctgatcacttatagtgccattttctgtaagctctttggcagcaatctgataagacccagtgggttcccactccagacactgtagcattctgaaagtgtccagagttagttctgtgaacttcacctgcattacatattacaaaatgtcaagcttgttttcacagtaagataagtgggtcaattattgatggataatatatgtgacctcgtttctgtgatagcttgtcaatacagcttctttcagtttcagtactctttttgaatggaatcgtgcaataggtgcaaggttcgacggaaaagagtcaaacaagttgtcatatctcagtgatctagatcccttgtatgctccatcagctttcaagaatctcccaagctcttgaagcacttgtttccattccttgaagttggttttctaagaagtatgaggtcacaaagttgttatggaagaattaaatggcaaggtgttttaattagaaaggatataaatatgtgattctctattgaaatatataacattgcaagaaaatgggaaatatgtaacaaggcactcatgtcataggctcctaaatgctaagctatcgttttagcataacattcattattcaaccctcaaacaacatatcatttctcaattaagcactgacaaaacaatgtgatatatatgctattgaaaggtaatagagcttgtgaaattgctctagttcatacactttagtacgtagtaactttaaaattatcaaaccaactaaagagaatgattctactttagcagctaaaactgtaaaccatacatgattcgaaatccgttatcctaatgaaatgtacgactcatgcaatgcaatatcccaaatccgaatggtaagacgagcattgaacagtcgtattacttcagttcaccacaaataaagtaagattttaaattttaagttacatactaccagaacgaatttgccattttaaattacatataatcgaattgggaaataaatagaaacccttgattaagcagcagtccaggtcaaaattcccaatcagaattctttatacagaaaaaaaaaagagcactgtacatatcacttctatcaaaatttcaaaaccaagcggcaaaacaaccttcaaatcaacaagttcccactcttcttcactactctaatctagaagttaaaaaggtctccttactccttaggtttcctaaaatacaaaacagcaagcgcacaaacttaactcggggttcccctattcaaagcacgagaggagctaagcttcttacggggtatgccgacttggtctcctcgacgagcgaacggaggcgggaagcgaggtggtccaccgcctcggcccgccgcatcagcatggccacgacgaggaagcgcgcgatgaaccgcagctccttgtaccggatcaggaggccctggtgcctgtagccgccgcccaccaccacctgcgccgcggcggcgaagtacccgcggctgtagatggcctcgtagaacacgtaggcgccgacgagcgagcgcggctcggcggtgcggaggtagcgcgcgtagtagagctgcccgatccgggaggccacctccccgatctcccaccgccgcagcccgcccgcgacgagctcccgccgccgctcctgctgcaggcgccacagccgcgtgtacgccttgaacgccttccggctgtggtggtccaccccgccgccgtagagcggcacgtcgcgcgcgcgcgcgaacttgcggtccgccgcctccgtcagcgccttgaactccctgtacgcgccggaggaggcctcgccgtcggccatcgccggcgacgagaggaggcgcggcgcgcgggggggctattcccctcgccgatttggtcgaatgggagaggggaggtggtggtggtggtggtggtggggaaacgggcgagaaagagaggagagagagtgtgtgtgtgataaaaagggggagtttgttcgagaagagattaaaaaaagtattacgacgagtacggggtgagcagcgcagtgagctcaagctgctgtttgttacagggacgctgtaatttaggtgcctaattgggctcttattagtcaatcatttgcactttgtttaatggcttgtctgcctctactcactgctttggttccacagtgagaaattacccggtatgattttgatttggacactaccaaatctatgtaactatgtttgatttgatttcttaacaaaattttatgttaggcatgtttaattcccaaacagaatttttcgtgttatcacatcgaatgattggacacatgtatggagtattaaatgtagaaaaaaaaataattacacagtttgccaggaaaatgcgagacaaatcttttaagattaattgcgccatgatttgacaatgtggtgctacagtaaacatatgctaatgatagattaattaggcttaataagttcgtctcgtaattttctagcggaatctataatttgttttattattagactatatttaatacttcaaatgtgtgtctatatatccgatgtgacatgcagggtaaaaatttttaacaactaaacgtgaccttataatatgatgaagggaggatagattatactatatttgtgtatgattttgtgataatatttgaggatagaaatgaatgaattaactattgtaaagtttaaaagttgtataaagttttttaataattataatgtttaaccgtttagactggccataataatctataaattataggagaaaaaagtgctaaattttgacgtggttggggcattcaaaggaggattagtaagctgaaacaaattaatcaattggagaacttatgtccgagtacgtaggctgcattctcccccacagcctcgaaagcgatctcaaacgaagaacaagtccacgttaattaaagtgaaaatgaaggtaaccagacatttgaccacccaaccgtgaacgctttcaatgagaacacgacaccgttcagtctcgtcagctcgattcgatagggatatccatttgcggaacacttgacagttgacactgataatcaaaacaaatggcaggagcagccgggctgatgagtgacgacctctactcactgctttgtaaatatgaatatttgtttttttatttagtaaagattaataaaaaaaattcagtcattcaggtgctcatatagatgaatggatagaatacgtgtgtactttaatataggtgaaagtgtgtatgttgtaagcgactgtgttggtattatatttccaaaaagagttaaccatatcgttgtcgtgattcaattttaaattctaagcatttaattggctaaaaatactttgatttcagtgtataaagaaacttatattagagcaagtttaatagtatagccaactactaactccaaatcatatatatctaatataatagcacattcatacaatagttaactatagaaatatattacatcattaatatccggttatacctctcatacacaaataatattttagagtccgtgttgcagctagctataaatatgtaacccgctttcttctctctcttcacttttcttcttgatatgtggttatagctggcttatagccttctattgtacctgctcgtagataccatcagaaaagaaaaacttatgttagataaaaaattaaaattttaaaatgcttatttgaatacaatgagagggattcaccaattgtcctatagtttagccgcaacttgctgcccatgcctagcctagcccccacctccgcttacgccggccggagacggacgcgccgatcgcgacacactggttgaagtggtcgggaaagcttcaggcgatcgcgccatcttcgtacactttgccttgacgttggttgttccatgtcattattccctagctcgcgggcaggtgggcagccgttttcacgcctcgtcattttccggtgaagcagcggtcaattagcactcgctccgctgatgagacgcccgttgcaacctccaactagcacaactggtagtctcctttcctctacctaactgaaatgcaactgccaagaaatcctactagtagtagtagctgtctactgttcatgttgttctccattttgtgtttcagtacaaaaggagcccgagttaattcttgcaagaatttcatactctgctcgggctgagaccgcagtaaccactggagtactcaccagttaacgaaagagggcatctttgctcgattaaagaatggcactttcacttggtatcattctttcacttgccatcattctgctggaggtagaggattcagtgttcagtgcagtggcctctgcctctctggtcggcgcaatcattcggcgcaagtctactcgccccaattctttacagctggagtacgtgcaacctgcatgcaagcattcgccccagcggctcgcttggaacaggttggctccgcgttgccggcctggactgagcaagtgtagcagaagtagtacgtgtaaagagcaattaacaattggtgatgcagtggttagcgattaagtaatctgatcatgggaatcttaatctgaacgggtttgtgctgctggtgttctgataaaaagctgctgttttgcggtgattagttagggcaggattagcttagcttagctgctataggcttttggagctggtcccaagggatgcgaccatttagtagaacacacatcaagacataaaccatgctttcggcatgatttctcccgtaccggagtactcactataggtcacatgaaaaaaagtgaaatggagcggtgattggtactgtgcgctagctagctgcatagatgcacactgtgacacatatgagatagcttttcacttcctaatttcttgacgagctagctatatattgtacgtgcatgtatgtgcaaacccatgaaggagactgtgccctagttaaaagaaagaaagaaagaaccctcagcttagttcatgctactaatagtactaatgctactaatagtattatatgcacgggtctcgactattagatctgtctaacaaacaccttctccacttgtatagtactcccttcgtttcagaaagattttatttttatgtttctgtgttcgacgtttgaccatttatcttatttaaaaaatttataaaaaaatattaacaaatagtcatgtataaagtatttttcatcttctatcatctaataacaataaaaatactaatcataaaaaaaatttaaataagacgaagagattaaaagccaaaaaatagagcctttatgagacgaagagagtagatatttatgcacctcaaataataaatctattcaatgtaccctggcccttggggagagctagtttttgctaaagaaggtgaactaaaccgatctgttagttggaagggacaaacataatactccctccatttttaatagacgacgctgttgattttttctcacatgtttgaccattcgtcttattcaaaaaatttacataattataatttattttgttatgagttgttttatcattcatagtactttaagtgtgatttatatcttatatatttgcataaaatttttaaataagacgaatggtcaaacatgtgagaaaaagtcaacggcgtcatatattaaaaaacagaggtagtagttgaatagggtaatatggtgttctcatgtatcaacactaacctataaacggatgcctgcctaaatcgatgctctttcgataaatgaaaagtacaaatagcacattacattgctagtaagaattgtgttgattcttcaattaatatactctacatccgatccgcgtcatccgctctaatgtataataatttttaaatgccgagatacctagctaaaagttgttatatttgtatagttttatttgaactcctaaaagttgatatattagtacgattttgtttaaactcttgtgttcttgatgaacttaaattgttctcatgcgtaaatatcactcgcctctaattatgctttgcattttggtggggaatagaatatcagttttcaaactagtgcaactatggccctatttggtagggctccaaactctaactcccagctctaaactcctacaccagttggagctagctcctattagcgttggagacccacccaaaagtgtttggtaacctttaactccaaatctgaaaaatatcaaaaaaaaaagaaaaaaaaaggaatccccgctatcgatcggctgtgcgtcgctcgagcatcgtctctgcgcacaccgcccgccgccggccgtgcgccgcccgagcgtcctctccgcgcgctgcctcccttgcaccacctgcccgcccgcgtcggcgtgttgcccgtcgcaggccatgcgccgatcgcccgttgtccccgctcgcgccgaccgcccccgtcggagcaccgtcgccgcctgtgcgtcgtccgccgcccccgtcgaagcgctgccatcgacgccgccgccgctgccgcctgtgcgtggcccgccaagcaccgctgcccgtgcgctgtcgctgctcgcatcgcccgccgccgccgttcgcccgcccgccgccgccgcaggagcgtcgccatcggcccgccgcctttgcccgcccgtgggagatgaagtttcgggggagagagcggggggaggtgaggaggagagtttgggggtagttcaatggtatatttttaaaaatatgttaaaaaattaaagggtaatatgtcttttgggttggagtggagttgtagagcagtaaaaacttatctccacccctgtagttcattttttaggagtagctccgttaactccaccccaaaaacagagaatctggaccgtttggcacagctctggctctaggtaagttgaagttaggagctagagttgtgccaaacaggccctatacaagcggacaagtggtgttaaacacatgtacgctaaggctgtgctcgttagtctggcttcccaacccacacagcatgcacggaaaacggagcattccattagcacgtgattaattaagtatttgctattttttttcttaaaaatagattaatatgattttttatgcaattttcgtatagaaactttttgtaaaaagcacaccgtttagtagtttgaaagcgtgtgcgtggaaaactagaatagggagttgggaaccaagagttgcgaacagagcctaaggccctgttcagtttgatgccattttcaattttagcattaccaaaattttagcatagttgccaaaattttggcaggatttcttatatagttaccaaaatttgacagcaaactaaatatagccaccttttgtaactttaccaaaatttagtaaggttgaaaatgatatcaaaataaacaggccctaaatgctgttaaccaaaccacctcccaaaagcagcaatttgccccaaaattttcggagttccacacgtgaataatcacttcttcgtttcaggcaggaccgcatggctgcatgagcatgaaaaaccctctgtcgtgatctcaaagaggctccacatggaagagaattgaagtactcctactagagactgtgtagtgtgtacacactgtacacggtacacctcaaattttggaccaaatcggcgagatgcaggacaccgtgctcctactgtagcgcatttaacaacacgattcccattgtctccggcgccttcctgtccgtctgtgtccttcttcccatggaccagccggtcctacagtctaaccatgcttcgggtctggctggctcaagctggctggcaatggcaatggcaaaccgtgcgctgcctggcgcgcgcacatatctacatggagactcgtgacctcgcactggaatttttcggggcctgggcgtacgccgactgacacggctggattttttcttatcgtttccatgctcttgactttgatgcatgtcccttgtacaccccctcttctccctggtgtttccatgttactctatgcctgcgcctgagtactttagggagtagtagtagtactggattagtggagagtgggagtacgagtagttcttcattggcccccgttcgaggaggaaacaatggcacgtgaaattgacagccgggggggagtcgtcaaggtgagccgttcgtacgtagtatagctgaccgctgacctgactactagtcgtacaagctgctcctactacgttctgtcactggtacgaggacgtatggacggacggagtagaggagactggagacggagacacggagtttggccgccgcgccagcgtgtacgggctatatgaacgagctattccgcccgtgctagtgctacggtgtgcgtgcaccgtggaccgtacgtgccatgcatggaacggcaggaggcagaggcgcgccacgcggcggaagagatggggttttggctgggcgccttggcgcggcctcgctagcctcgttccgtcacgccgcggcctcaagaatacagcagctagctaacacacatgtccgcttgcggcgcaacgccgcggggagggccgggggccgtttggagaggcggaccctgcgtcgtgcgcgcggcgatgtcgggggagcttatatattgtcatgtcaggtcgacacctatcgtgttgggcccgtttgcctccaattggagagggtccagctttgcgtcgtagtactccgtacgcatactagctacggtagccatagacaatgaaaccaaacaggaccaccacacagccagtcacctcatgtcctccgcggtggcctgcagccggctaataacgcgccgatggggaagctacaattaactcgcgtggacgtgtacgcgtacagcgtactactcttcttcgaaaattgtctacactcgtctaggtcgtccttacctgtcagtacttgattcaactccaaccatgcatctcccatctcttcccgtaagatgtactcctactctgtacagtgtactagcaatccactaaaaccctaaaaaccgtggcaacatgtaatgccttgacgacctggatggcaattgacaagtgccttagaaaaaaaaaatccttgtccagcggcagacgttcgtacgcccgtgctcccggtggcacggcaactcgtcgcgtcaaacgctctgccatcgctgagagattgtccgggcctttttgagcaccagaagcgccacggagttcgctgcttccgaaccaacatgtcacatgtgagtgacatgtcgtagtcgcatcaaaattgaggcccgtgccgctgtcggcgtagcggcccagccattgtacccgtacgccggtgaggagcgcatgcttttaggttcagaaaatggctagtgttttttgtgcaggcactcgtgtttgtgtttaactttggccctgtttgaatccaatggctattttttagccctctctcaaatagcctaaatagccctaaaagatccaaaagggtgctatttgagggctatttggaaatagcccacccaaaaaaactatctcacccaaagggtgctaattggagctattttgagtggggcccactgaaaagtgtcttttctctctcccataggctcacgggattagaaaacgcgacctcctctctctctctctctccgcacgaccacgcgcgcgcaggcgcggggcattttcgccgccgccgcctccactcctcgccggcccccagcagcgccgccgcccccacctcctccccaccagcgccgccggccccgctccttgccgaccgtcaaccacgtcgccgccctcccccacttgagccaccaccggcccccactgctcgatttgttttcttgtccatggagggtggtggcttcgatttcttctccgaaccccactgctcgatttgttttcttgtccatggagggtggtggcttcgatttcttctccgaaccccactgctcgatttgttttcttgtccatggagggtggtggcttcaatttcttctccgaagatccaaatccaagcgtctggccgtcggtgatcggccccggccatgctcctcctccccatgccggcgtggatgcgttggatggatcagtgcttatgcaatggaatgagcagtacacgcctccacagagcaatttgatctctcttttttaaagaaaaaactttattgttttctccctttatgctacaagcatacgagatagagcactgtcctagtgatagagcacaacagcatggcatatgcagccggccacaccaagacacatgcacaaaagatctagtggagaaagagagaaaatgggtagttatgattgggaaagtgtactaaaggtcaagtagctcttgcatccaaacagctcaagggctatttcattgaagggctatttcttgagctaaaaaaatagctcttaaaataactctcggctactcctccaaacagggcctttgtgtggttttcctttctttggtgctttgccaattcgtcaaagctagtgggggcgatcaaaggatgaggaagatggctactgcctttgtgtgctttatcaaaagcgatggatccagtatccactacgaatctagtctaggaagaaaaacaaggcagagcaagtcaattcaggaaagggttaaaaaaaacgaaaagaagagcaaagaacataccaaagccggtaggtccaaagtgcaaagtccaaactttatgtcaaaggtgggcgctgcttttcttcgctagtgcagttttttcagcgtgacaactctgtaattcttccacggagaagaattacgggtccacaggccgtgccgattgggataagcaacccaatgcgcttaacagaccagtccgcgtatcaattattgcatgattctgttcaattttgcgcacacttcaacattttttatcatcttatcaaaccataattcaaacacgaactgaaaagtctacttgtcttggcattcaaaacttacatatgtcatttgcatgtacagtggcgtcttacttcttaggtggtgttttgcaaatgggaaagggaaatgattttcaacccatctttaaattctaaccattcattctccctcttatatttaatcctaacccttcattcattttccaatcctaatcccaccccccatttcccattattcaaacacgtccttagtgtccaaaacatcttacgtataataagaaaaaaaaattatctcaccttgagacagagtttgtcaccaaattatagagggggaataaaacagacagcatatgtcaagttgtcgaccaccaacgagtgaattggcagtttgacacagcatgagaaattttaagctcagcccatgagatcaacctccctcccctgggcctgtatactttgccttgggccgtcgcttggcgtgagatcaatgaaggcccgctacaagtaatgaactcagtgttgcttgcttaaagttttttttttttgggacgcatggcattagcacccgttaaactatcaccatcgacgttccacgtcaaaccaacacaacttataggccctctgcaaggctggtacacactcactctctttttaaggcaaatggaataacattatggtgcacaaattgaatcattttcattaataatttgcatgaaacatttaagatttttcataaaatagtatgagattttttacaacgttgtaaaaatatatacattgactaacataaaaaatatcaaaaacgaaaatttcggaacaaagccttgatactttttttatgttccggtattaccgatatcactatcgtttccatttatgttatttcgattctatttaaatagtaataatagcgtaactggtttgaagattcctattaccatactcgacaatttccattgcctagaaaaatgatcctaaaatgtttaagattgagcattcgacacaagatggaatattgggtgcattagggactccatgcatttcatcaccatacaacctccaatcttatcttctcttccctgttacctcgtgctcctcttgccctaaagtttgcttgcgcagctccgtcactaggaacgatctcacaaacgacgctacaaagggagaaggagatgcggagggataaggaagattgagcgatggcggtggcttggccattggctcaagtgcgatgaggcgaagcacaacgatagttggctacgatcgaggagcttgtcgatgaggaccgccatgagttccaagaaggtagcatgaccactgcttcctgtgggtagacatgcgaacccccgtgccccttgctccacggctttgccggttgtcatgtcaacaagatgttggttgtgacctccttgataaggcccagatacgactctggtgggtagaagaagaaggtagtgtagcttttttttatatagtttgacgatgttgtaatccattatttccttttgttgcacctagctgcgttaagatgttccattttgttctgaatgaatattgaacatattgatatatttgtgttgtaatatatagttttcaagtgttacacctagtgaaaacttttttatcccagcgatgaaacattttctcgaagtgatgaacattgaatttttttttctccaagatacaaacatctgaaacattttgttaaagggcctgtttagatccatttgaaatggcaaatggcaaatggcaaaaattttggtggcaaaagttttggcattgcaaaagtactagttggtgtttagatgcatgttaaagttttgccattctagcactaaagtgagagagaaagagagagggagtggtcccaaagcactttttggcacaatttgctattatgggctagcaaatgccaaatgccaaattgccaacttttgctactagtgtttagatccaaaatgataaaaagtgctacaaaatggtaaaacttttgccattttgaaggatctaaatagggccaaagtaattttcactgagcggtaaaacacgcaccttacaccatacgatattttgaagatccgacataccgtatgtaccatccgtttcatcacgctgtaaaccaaaggttaaagtgttaaaccacacacggtagggctgccacgtagtcacgtagatatatgcttcttgtccatgtaatccccggcacgtctcggcccaccgagcacgaggcgacgggcctccatccgaggatcgtcacgttgcctttcagattccgtggcccacgcaccaccaatgagcccacatcaccgcacggagaaaaggacaggagacggaggcactgccccggtggtctctccctgcccgtgggacccaccacctcccgggcccacctggcactgtggtggatagccgcttgataggttccgggcctgacgtggactaccaaataccaattgccatggtccaatatggggtccgcgatctgggcctgcattgattcggccattaaaaaaggttatcgtctcgtcgacgtttttcatgggggcccaattcgctagtaggttgaggctgctgtcacgccagcatggcctcgtccctctggttgacggtctcaattttgtcactttcatgttactcaagaagaaacccaagttttcgtttttgcaaaaagttcacttactttcctatgtaaatgagtgtttattgaaatgtttagcaagactagtacaagaggttatagacacttacagtccaaaaaggagagaaaaatccgtccattagcgtccggatagtgaagtactaccacaaacctcgctgaaaatgatcctgattctaggagattgctgacagtactcgactatacaaagcataggataatctgtccgtctctgttacctccttttaactatgataacgttgcttttgtaaggttcagaaagtcctcatgtctgtatccttaaaatatatatcgtatggttttgctaattttatatcgatcggccacaaccacaagtatatcatggccacaatagttttatatactattatatcactgtttatttggttcaggttcttaatcggaagtcacttcaacgtcatgcgaccgtgcttcacgcgagctctataaaatactactgcaaagcacgattgtttatccatctaggtttcacatagctaatctatatttctgtgcaccgagatctaaaatattccaattataaaatgcatgggccacaagaaatctaatgctggtaccttgaaaccagtaaaaatgtttctttctttttaaaaaacatatgaccggcttgcagatgtagtataaccggatgtacatctcacaacttgacctggtccgttgcacgaacgtcgctgctgaattgctcaccacgtctagctttcaccaaactcgtactttccatccccgtttgtcttctctatcgcgatagcaaagcccgtactccgtgaagaacaagcaaaacgagatgagtatatcgcgatcgcctgatacaatcacagtgtactacgtgacactgtgacaggttcaaattcgtgcggagcaaactgaaaatgtcactgttccttccaccactagtagtagaagggtgtgtttacttcgcaaattttttttgtcatatcgaacgtttgaccggatgtcggaaagtgttttcggacacgaatgaaaaaactaatttcataactcgcctggaaaccacgagacgaatcttttgagcctaattaagccatcattaatacatgtgggttactgtagcacttatagctaattattgactaattaggtttaaaagattcgtttcgcgatttctatccaaactgtgcagttagtttttttatttatatttaatgctcatgtatacaaaaattcgctgtgatgttactagaaaaaaaatttaggaataaagcaggccgaaaccacagtacggtactagtaagtctgattattactccatgctgttacagaaccgggaggatctgcttcgagaaacgaacaaacgcagtgacgttcagatcagcgagtctattttactctctctgccgataattatgccgacaaccgcagtacattctacctgctacaattacaaagccaggcagtagcagcaacaatcgtcaccggaatattccactcggtgtggtcggtggtcaggagcaccaaggcaaaagtcgcgagagaatattccggcaaccatatcgatgattttttcagttttccactgcaccacctaccactagcagagtagcagtagcaagtagaacacatcgcaacacattcatcaaccttctccatgcacttcaatggcatgcaagcagcaaagcttatacaacaaccctgacgaatcatcgaaacagatggcactgaacgctgcacgagctgctgtaaacacaggcagtttatgtcgtactctctggtgttccggctcacaataactagctcaccgtaccggttgttcctgcgtagtactcctactacaaccagctgcagtagtattgaaatctactgggagttgtgcacagggtttgtaaaacccccgataacagcatggttaccgtgcttatcatgggttaagtacggtaaaaggtaaaagaaaaaccgtagtaaccttcttaaattcaaataaatttaaaaaataattaatgataaattttacacggtttcgtgctgttaccgtccttaccgccggggcgcggtaactctagtcccggcggtttgggaaactctggttgtgctctgatcccatcacatcgccatggtgaaatcacaagcttttgttccaagttccgaaagggaacgacgctttcgcggaggcggccggagcaggcggcgccgtggccgtggaaagcgcgaagccaaagcaggtcgacgtcgtcggatcgctgtccgcgaggcgagagtcccggtcagtgaggaagaagccaacggctgctcctcgtggccgccgggcccaccgaacagcgacactgttcaggccgtgggccgttcgttgagtcgtccccttccttgctcagccagacttcctcaaaaagtcctaattaccatcctactgctagtgacatatttatggtccattttggatggcatatgcttacattagagctcagatgagtttaagtagggaagtgagagctagaaattggagaggtaatggagtagtaggattttactacactgcagtgctacagctaatgtgcgcgagaattggcaaaagagactagagaagtacgtagaggtccattttttttacaaaattgcagataagaccctgctttcctgcagaattctttattcccccaggcatagtgttttccaactctctctctcggctgcggttacgccggatttgcttcagttccagtgctccgtgggctcggcccaccacgacgacagcggcgggggctgatcgtcggcgaagaacccgccgcacggctcgtcgtcgtcgaggaaccccgtctcgtcctcctccaccttgaggaaattgccgtggaagaacacctcctcgtggctcgccgccgccgctgcgcccgcgcccgcgcccgcggcgggcggcgcgccgagaaacgtgcacgcctccggagccagcgcgtccgtcgccgcgggcgcggcgccggccgcgtccacgtcgttcagcaccgcgcttgagtcgctgtcggacgacccaaatcccgccgccggtggcccgtcggaggccgccggctcctccttcaccgacgtgaagctcgccgccgcctcctcgtccccgagcttcgccttcagctccttgatctgccacaattcgcgcgaccaagaagccatcagacattatgcgcgcaaacgaacgactgctcgacgcagtcacgcagagcaacagctcaggcggcacggcagggcagcgactcagtcggcacgtacctcggcgaggagggcgtccttgtcgcggcggagcgcgtcgtgatcgaggcgcagggagtcgtaggaatggcggagcgcggcgtagtcgcgctcgagctgcttggtcttccaccgcgcgcggcggttctggaaccagacggcgacctggcgcggctgcaggccgaggtcgcgcgccagccgcgccttccgctcaggctcaagcttgttctccacctcgaagctccgctccagcgcgcgaacctgctccacgctcagccgccgcttcttctccccgccgccgccgcacgccatcatctcctcctccacgtccccctccgcctccatcccaacccctccatatccatcatctaatcaaaacacgcatgtacaattacaaaacactcaatttcccgcacatatcacactacaccatcacctccaaagaatgaattgccacaaaaggaaaaccaaagaacaaagattaccactagaattagccatcgtgacgagcgatgggctgcctccgccgccgccggcaccgccgggtcgcttcatgccgagttctagtaaaattcagtgaacgcctggtcgatctctctctctctctcactgcgagaagacgacgggcacagaagcgtaggaatgacgcgggtgcctccgtcgctgagtcctcgccggtcttaattccacgctgcgatccatggccaaacaccacgtagccaagtccccggtccaaatgctgcctagaattgcaattttgttgcgcggtttctcatgatccaagaaagggaccaggggatgagagtgtggagtgtggagtgactcttcttccctccctacctctctctctctctctctctttctcggtttcctttctgttttcgcaagacggcgcgctgtaccctgtgtgtattaataaaggcgagagagaccaagagagaggagaggagaggagaggggggcgctcgggttaggtagagagggggtggtggtgcggttaggaggtgaccagggttaacgtgacgtgcgtttgcatgctcatgtgcaagacagtacgaagaggcgcggccgttctttgcgttgagtccagtaacaaccgaacgaactagcgcgagtacgacgactgactgtactcccggcactgaaaaacgactgaatcgacgtctgatctagcgtccaaagtcgaatggatttttcacctttcgtaggcattagcttcactcaccaatggtgggggtgcttcctgcgttggtcatggcctaaagtttatcaactttgctatacgtccaactcatgtgtccgacgcatgtacgactgaaacggcagaaaaaacgagcaatgacagcgtcagatatgactacgcgtcgctgagcctcgttgttgtttgcttgcgtactgtgctttctatacactgaggccagaggctagtccggctgagacatgtatcgatatagcttaggttgctattaaaaggattcactccagatgttagattagtttaggccttcaggatatgaaaccaatatattttcacagccataacatgcaagtcctcttaaaaaaaccataacatgcaagaaaaaatgattgaccagacttgatagaaaaacaaggcaccatggcttcaatttccatatttatgaccaaaatcagttgaaaaatcaaatatggccatgtatatgtttgcaagcatggaaaaacaagagatgttgaaaaacgaattgagataaaagattaatagaattgttcatggggcctagaaaatcagagcctaaaataccttctgttagcttcaacctgaatactctgttgcggttgccgcaaaaaaaaattctgattaatcttaactgattggtatggataggagacgaaggggattagaatgagggtttagggtgagaaaggaaatgtagaagatgaaaagtcatggatgtgtatagagtaatatcgagaagaggaatcgacgtcggaatatggagcttcggctggagttgggcttttaaaaggcccaacaatcacagctcacgctcacagataacgccgtcgactagtcgtatgatggtcgtacaaatccgtcgtgtgtatagcattttcgaaagtttatatagccctacgaggactggaacgaggcggtggtcaaggttcggtcacgcccatgcttgcacgcacacaccgtctcacaccgaatcggtaggagactaggaggcggcaaccaagacgaactactcctccaaccgaatgctaatccgcgcgtaggcaagcgacggcgaggcggtggcggtgagagatgcgcggattcggcgacggatcggcggtggaacggttcggcccgcggcccggcgagaggcgtggagaagagcgcgcggatggtagcggcagcggcagcagctgctctgcttctgctgcctgcttcggttggtcggggcatcaaaagggggaagtgccggtaaaagccaagcgatacggagcgcagctttcctggggaatggtggagcgcgcgactgcggagctgcaggtgcacagtaaaaatcctcgcggaattgcggtttggtccctagattctgcggtaatacccctactggtgtaggagtagtagctcccagacccacaacgagggacgacgcctcacatgtcgggtgctgagaaagtggctttcgtgtggatttgagggaacaatagctgtgtttgcacgacacatggtagagagattttaacgtggcttagtcccagtttagtagagctctaactttaaaatttagctctagaagttgggttagagtggagctgtggagtagctaaaattcagctccacatctgtagttcatattgtgatagcactctacctaactccgctcctattttaggtggagctgaaactatttgtctgagctctagctctaggagagattgaactggaactggagctgtgccaaacagacccttaaaaaaaggtgaaaccacatactttctccgtccaataaaaaccaatctagtaccaaatatgacacattccagtattagaaatctggacatacatatgtccagatttatagtactagaatatatcatatccggacctagatttcttttttttggcggagagagtaggagtatgtgaaccagtgttgttgcctcctccttcctataataagtttgtttatagattctcacatatatctctaaaagtttttacttttaactatcatatacctgagtttatgaaagtagagaataattgcatttagagttgaacaagggtaaagtaattgtgttatgatttgataaattagagatatattggtcttttttattggtatgtgtggaatgagtgaaagatgaacttatttcaggacactggagtacatgtatatgttgttataccaatcgtggtagggaaatgtgtatgttctacactactaaagaaaagatttttgtgtacgagggcctctatagaatgcaggcagaccgtaactactcatgcctacaaaaatcgacctacttttttatttttgcatacgacttcttaaaatgcccacatgcaaaaatcaattttcgcagacgagcctcttgacatacccgcatacaaaaataagtaggtatgttaagaagtgggtctgccacattaaaagtccctttgatttgtaggaaatacataggaattttggacgattttaatcctatacaaaaaaaactcttatgaaggcctttgaaaggattgaatcatatcttatcatttgaaatttcaatggaatggacaattcgatagagattatgagcaaaaattagcaagagctctaacctattgaaaaatttcttttgagtctatctctttcatccggttcgtatgtttttcatgcggccgaatcaaatagtcattcctatgttttttctgtgttctgtaatcctctattttgcatttgcattcctatcaatattctgtgtttcttttttcctattccttcgtttttcccattcctgcgattcaaaggggccctaaaatatctaatttcctcctccactcctcactctctccccacccctctattatcatctccttgtcccactcctctcctctcctcacatgagctcatcttctaacccctctcctctcttcccattgcggtgggagcggcatcacccctcgcctgcccggaggcccgtggaggaggcccatcaaagacggagtggcggccattccccacgtagatccaccggctgaggaggtgcgttgacggcgacgacgacgacgagctgcggggaatcggtgacagcgacggcaaagacgacaagcgacgacatactacgacgagttggcgatgatgttactggcagaccgcacctagctaaggtttcgagtatttatttttggggatttttttctagattttttttgtgtgcagacaacataagcatccacacgcaacaattgagttttcgcgtgcgggtgcaccgcccgcatggaaaaatagcgatttttgcagatacttttgggcaaacgggcagctcaaccgcatataaaaatagatttcgagtttagattatcggattcacgccaagatttgtatttggactcctcttctccgatgatggtgacaccactactccaatagaggacatgcgaattagggtttggggttaattagggtaggaggaggagttagggaaggagggagtttacttggggcttagcacgcgagatggccatagacggtggaggatcgggggtgggtggtggatacgggcacatggcgaggtgccaaagctgtggggttgatggtaggcattgggccagtgttagcggaggaggtaaataaatcaagtggttggtaacagatttggcggtggagagccactggagatagagaagacgacaaagagggcctcgccaccatcgtctttaaggaggaggagttaagggtggggtgagcgggggtgttaggggagacttgacatcgtcgttcgggccttttggccaaccggcgaggctagggaagactgggaagggaaggtaaaaagataatgttactgtacacacatatgatttaggatggaaatttttattacaagttgtgtagacagtcctgaaatctatctatctattatattattaaaggaatataaaaaggagcctccacgttcgctctcatggcctagaaattctcacattaatcggagaaaaagaaaaggcggagtccatatagaaatataatttagaaatagttgaaattaggaattaaaaaataaggaatattagaagaggagactagagtccatatacaaatacaattaggaaataactgaaattcggaattaaaaaatgtggaatattagaagtagagtatagagtccatatagaaatacaattaggaaataattaaaattctgaattaaaaataaaaaatattagaagtagagtatagagtccatatagaaatacaattaggaaatatctgaaattcggaattaaaaataaggaatattagaagtagagtatagagtccatatagaaatacaattaggaaataatataaatttggaattaaaaataaggaatattagaagtagagtatagagtccatgtagaaatacaattaagaaaaaaaatagaaattcggaattaaaaataaggaatattagaagtagagtatagagtccatataggaatttaaaactaactaaaatttggaataaacataataaaattaaaactagagtttagagtctgtataaaaatacaatttacaaataactaaaattcgaaattaagaaaaacatgggaagaagagtttaagatcaatataggaatacaatttagaagtaactgaaattcaaaattaaaaattaaagaatattgaaagatgagtttataattagaaataataaaaattcagaaaaataaaagaaataatattgaaagaagagcatagagtctatatagaaatacaatttacagaaaatttaaaattaaaaaaagaaatattaaaagacgagtctagagtctatataggaatatatataatttataaataactaaaatttgatattaaaaataattaataactaacatgtataaaaatataatatgaaaattcagaaataaaaataaataatattagaagaagagcatatagtctatatagaaatacaatttacagaaaattcaaaattttaaaaaaagaaatataggaatatatataatttacaaataactaaaatttgatattaaaaataattaataactaacatgtatataaaatataatatgaatattacacattagtagttttgtaaagttattgcaaaatttaaaattatgttatcattttaatatatttgaataatataatgagaaaacatatatgctattatatgtgagaaaatataatgatgctagccacgcaatctgcgcgggccaccatgctagttatattattaaagaaatagaaaaaggagcctccacattcgctctcatagcctagaaattctcacattaatcggagaaaaagaaaaggcagagttcatatagaaatacaatttagaaatagctgaaattcagaattaaaaaaaaggaatattagaagagaacactagagttcatatagaaatacaatttagaaatagttgaaattcggaattaaaaaataaggaatattagaaaatgagactagagtccatatagaaatacaattaggaaataactgaaattcagaattaaaaataaggaatattagaaatagagtatagagtccatatagaaatacaattaggaaataatagaaattcagaattaaaaataagaaatattagtagtagattatagagtccatatatagaaatacaattaagaaaaagaaatagaaattcggaattaaaaaataaggaatattagaagtagagtatatagtccatataggaatttaaaactaactaaaattcggaataaacataataaaattaaaagtagagttttgagtccgtataaaaatacaatttacaaataactaaaattcgaaattatgaaaaacatgggaagaagagtttaaagtcaatataggaatacaatttagaagtaactaaaattcgaaattaaaaattaaagaatattgaaagatgagtttagagtcaacatataaatacaattagaaataataaaatttcagaaataaaaataaataatattgaaagaagagcctagagtctatatagaaatacaatttacagaaaattcgaaattaaaaaaaataaatattaaaagacgactctagagtccatataggaatatatataatttacaaataactaatatttgatgttaaaaataattaataactaacacgtatataaaatacaatatgaatattacacatttgtagtttcgtaaagttattgcaaaatttaaaattatgatgtcattttaatatatttgaataatataatgagaaaacatatatgctattatatgagagaaaatataatgatgctagccgcgcaatctacacgggccaccatgctagttaaattataaagtatcgcgatgatttgttaaaaggagtgagttaagtgggagaaattgttatattttatgatagaattttaaacattagaagtcagtatattttgtgtgggagggaatctcaacttgagtacactatacgtcccaagagaattaaattctggcgggtaacgagggtgcagttgcttaagatattaaaatgtgtgttccctcaaaaagaatattaaaatgtgtgtgtatgcatcggaattcagtggaacgcaagggggtggaggattattcttgttcttgtagcaagttctgtaacttaatgtaatcaccgaagattctctgtcccatttctgcagacggcgacccgaaatcgttttctatgagcttgtcgttgtggaaaaagcagtagcggctttcgtaacacctcatttttttatctgtttaattgcattttttatcctcccaaatctccatcgaatccctggacgcaaaagactagggacttttttaatcgatctgcgcgactatagaattcgtcccgaaaacgatgaatcgtaaaagctggattccttggatgttccattggttcgtgccctttgtgaattgtgatgtacgatcacggtcacaattgtaaagctagcaaaaggttcttgcagaatttcagccatggagttattttgtgatcatgcgtcttttgtttatgtttgttcattgatttctttgaagttatatatgtggccttatgtgcctataaaaccaaccacatcacatcaatcatattagaacaactgaagagtccaggccttgacacatgccactcaacatgaaggtacatggagtaaaatgttgaactagttcagacatatttacaagaagaatagatgaccactttgtcaaaatttggaatagttaaaggcattaatttcttctttgcaaaaaaaaaaagcataaggtccaataagatggggggcatgtttggggagcttctaacagctgcagtttctactagaatcttcagttaccataaactctcttaaatagtccagattttcatccagattctgagaatgtatttgtagaatctaaaaaataagctagaagttgagtttcccacatttttcaaattctcactagatatttctcagaattttaagcttccctaacattaccctaatcacctttgtcaaaactaggaacagctgaaggcaaaaatggtataagttccaataagattaaacaaataaattgtagcttacatcagctagattataaaaaaaggcaaaatttgctacaggatacccaaaaaatgtgtaattagttgtgggacaacgtaaagacgtgaatttgctcgaggacacttcaaaaaatatgataatttgctacaggacactggacacattaaaatataatatctagtcaattgatgagagagaaaccacgtaaaatgacagttttgctcttatcttcttctcccttctctcgttcttcttctgaatatcctcttgcgtgcgtaccctgctgcgagtgcggtcacaggccacgcccgccgccacggactcctcgccgttgttgtggtcacgaccgccgcgccagacatctttttcttccacttctttttttcggccactagcacggaacgaccgctatccgtcggtgcgctagcatgagagggtagtggggacaggaagaatgactcgcacgcatggccggctcagcggcttaccgcagagctggaggttgtcggcgaaggactccggcgagaagcgtgcgagcaaggtgttggagcacccgtgagcttggcgacgtcaggcgggacagagccaggaagggaaaagaggtcacctgggacatcaccgaagaggtggttgcatcgaagggagagcacccggaggtagaatccgatgaggctgacgccaggtaggcggagaccaaggacagtggcgttggcagcgtcgcaggcgaagcggacccagtcgtaggccggcgtggaggagttccaagcgatcggccgctggtgcctgtgcccatgcgcgctccacacgacaaagctgtggaggccctactctaagttgggcaagatcgagaggaagaagaagacaagggcaaaattgtcattttacgtgctttctctctcatccattgactgaatattatattttaatgcgtctaatgttctgaagcaaattaccatatttttggagtgtcctcggacaaattcacgtctttgcggtgtcccacagctaattacatatttttttgggtgttatgtaacaaattttgcctaaaaagaattcttgaaaagaagaagattgcagatagtagtatcttgggatgacaatagtcaaggaaaatgctcaaaccgtttttctcggaaaccaaattgggacgtacaccaataacgatatcagtaatgctgtagtatactatttttgaaacgaaattatcgaaataaagcctcaaaaacaacatactgtcataaggatagtcacagtatgtttacattttaaattagcgtcatatacaactactagtaaaaattcaaagtattaattaagtactacttaatacttttgtggttaagtttttttttaaaaaaaatgataggttgacgatactcatgttaatttcttccgaaattccagatgaaaacggtatagcacttataaaaaggtcagaaaaaatcaggatcccggttgggtccatcactttgcatatttttattaacggccttatttggataaaataaatcacgtataagtagggccactgatataggtgtggagtgtggtcaatttgttggctgaagctggatggctagacaaacttatatttatatatatctaggtaggtaggtccatcgtatggcctacacggttactccctcttgctagtattcaggataggatcctcatcctctcccagcctcatgcggctacggataagaatggtgcggaaacaaccaggttttacggtggccgttgtggttgatcggagcctcggataagaatggtgcggaaacaaccaggtttcacggtggccgttgtggttgatcggagcctatttcgttcgaggttacagtgtggcgtccgtcgccgtaggtcgtgagcatctacgtcacgctgcgtagctactaacgctagctgaggacgacgatgatgcgcggggcttggctgccgtcgctgaatcaaagggaggtgccgcgttaaggagcaacgcgagcttggcgtcagagctgatggacatgggttgtcgcgacagtcggggatggtgctgtcgtcggagtggatagacgcggagcaaggacacggccactggcgacaagctctgacgtggcgtggaaggtggaggatgcggccatcaacgactagctccagcgtggggcgtggatggcggaggacgcggccgctggcgacaagctccgacgtggcgtggacggtggaggatgtgaccgttgtcgatgagctccggcgtggggtgtggatgacggaggactcggccaccgccgccgagctccgatgtggcgtggacggtggaggatgcagccaccggtgatgagctccggcgtgagacgtggacggtgggaccaccggcaacaataccttggtgtccggctcctgataccttgcaagtatcacctatacgtggtaggaatcgcctgatatctgacaggtatcacctagcgcgtgatacctctcaagtatcacctatatgtggtaggaatcgcttgataactgatagatatcacctgatacgtgataggaattgtctgatatcggttaggtatcaggacctaatatctaaccggtatcatcccatctcattagcagctctcaagttttgtatgcccaatgccctgcagcacttgtgcaccattgcaagtttgcaactgctggagacctggagtagactgtaatttagcagctagatgtgctgaatgattcataaatttgcatgactcgagaataaaaatttggtatacttacttgatccagtactaatgtactatacacgaatgcacgaaacagtgacggccagggtctgctacttagttgtacacaagcgcagtcgcagcctcgcgcagtcccactcgcataacaacacggtgcaggttgccgtgaaatgatcccttcaggtcgtctcgatctctcacgggcagcgtacaagtagtagcagtacacgcacctgttggcgttgggcaccgtccgctatacctcctcctgacctcctgcctgccgccggagaagacaaaagtggagcgtctgggatgtctggaaccgtacgccgtgagattccggaagaaaacaaacgcaatgatgtgacatgcttacagcgacaaacggaaacaggcggatgctcaccgggattggggaaaataccctgtgtgctgcgtcgcaacgcaacttgcccacttcactcgtcctgatgatttttttctctttatccccctcctgtcttcctcgtttctttgcggctgcgtgccgtcgtcatcgtcgcacctttgcattggatcaagttggtgacccccgcgctttccgttccacgattgggcgtgcaggtttgggcgtttctgtgtgcgatgcgaagtgcggtacgtgctcctaccacgcgacgcgaggggatgggcgtgaagttttttgcgtggaaccggaagggtatcgatatttcgatatcatctcgccatcattccggcgtactacgtggattgggttgggctaggcgcggcctggccgcgtggtggggggcgggtacgtacgtggtggtgtacgcgcggacggcgcctgcgcctgcgtgtgtgcctgcctgcctgcgctgatgacatccgggcgcggggcagagcctggtccccttccgcggtggtcagcagctgaaagccgcagggcccccggccgctagcctttttcttcttccccggcctcctctcctcgcgccgttgccggcgcgccgcgcgcgcccgtcgaccgcgtctactcgcggagcatagccatatttcaccgtgcaaactttcacttgtcagctagttttgcgtgacatacactactctacagtctacacatgcatgtagtagtggctaacgtattgacttttaaacaagtggatttgaggctgcgttcgttttaggtgatagagtgagaatacacatccgcgcgcacactttccaaagtattaaatggtgtgttttttaaaaaattttctatatgaaagttgctttaaaaaaatcatattaatccatttttgaaatttaaaatagttaatactcaattaatcatgagttaatggctcacctcattttacgtatcttctcaatctccttaatccccttctcctcaaacacaccctgagtcgattctgtacatgcgttttactgtgctggtgagatagcagcggtaaggttaactcgatgcgaaagggcgcccggccggcagaagggaccgggtttttactgtagtgcagcagcagtgttttgggcacagtaacaaccttacagaacaaaaggaccggggaccaaaaggtgattggtgatctcactgggaaatggagaaaacccaacagcaacgaggaaaggttgtgggggcctccaccacacacatgttcttctccggtaacacaagggtggtaaacgtgttgtgtagcacctcaactttctttcaacaccttctccatttacatttactgcatgacacggttcatgctcatgttgaagaaacggactggtgaaaggaagtggcagcagagttaggaattttaacttgtaatgtaaaatatcgttgctttatgttttagtgggtcatgtttgtaaatttcaatcgattcaccactggtagagaaatgctctttactcccggttggaaacccccctatagtcccggtttttcaatcgggagtaacaatctgggactaaagatagcaatctttagtcccggttcaaatacctgggactaaatatcgatctttagtctaacaccaaccgggagtaaagaggagaatctttagtcccggtaaagggttagtcctagtttttttttcattgttcctttgaatattgatttcacaccaatctctccaaaatcataaaatcaatcacaaattccaaatcgaaatcgagatggtcccaatatccccagatcaaatagcaacatcacaaatcataatattcacatcacaaattatcagaaaaaaacatcacaaattctaaaaaaataaatacatcacaatcacaatcacagatacatcacagatcacaaatacatcacagattaaataacacagatctagatccaatgaatcacaagttattaaaaaagaaaaacaagaaaaatccagccgcctcctgccacgggcgacggccaccacctcctcctgcatgggcggccgccacctcctgccgcgggcggccgccaccgccgcctcctcctgcgcggacggccgccaccacctcccggtacgggccgccaaccgcgcccgggtccccgccgccgcgcttcgggggcgagctcctcgtcggctaagtgttgagagagaagaatagaaagagactgagaagaggataaggataagtgtgtgagagaggaggaggaatacgagatagaaatttttgaggatagcagcaagggattatatatatatggtatatttgatttttagtcccggttggaaacaacaaccgggactaaagttaggattttagtcccggttggtaatatcaactgggactaaagaactctagggactggcatcctctgacatgactaaagatgatctttagtcccggttagtgttactactcgggactaaaaatcatctttagtcccggttgatgacacgaaccgggattaaagatgatatagtccccttacagttataaactggcactaaaaatactttttagtcctgatttttaatggaaccgggactattgtgaatttgggtgaaccgaccaaagatggtttctccaccagtgcacatataaaaatttagtctcacgagagggtttacgaaaaagttatgccttctacagtaaagtgtggttaacatatagtgtagcgccttgtctttctttttacggcttattcatttgcattttcataataacacggttgagctggttagaccaatagattgatgagaaagacaaaaccgattaatgatcgagataaaactctctatgatagtcgatcgactcgactgactaggttaaactctaggtattgtcatggagctctcggggaaacacttgtggaagggatagaagacaactcaagaatgtagttgctctaatatcatacttcctccgttttatattataagactttctagtatatatgtgtctagattcattaacatctatatgaatgtggataatactagaaagtcttataacctgaaacggaggaagtatttaacaataaaagatgagatcatactagttgaatagtgaatgtagtgtactgagattcgcgtgacaatatatatccaaattatgtgggtaaaataaaaaggcacataatcaatacaagtgaattacattttgctctaattaactatcatatatatactcttaacaagctgtagtaacggttgtacacccacagctagctaaaccgagcacgccctacaattcgatcgtgtctgccttcattatagctactagcaaattaccttttgaatgcaagccagttaaagatcgttatgtaaactaaaatctccacgtaatgacacaaacagtccaacagggcagtcaactaagagaggcagtcatgcctgcctaccgtaaagattaatgaacctattcatgacaggtacatatgcatccaatgaatttttttagacatattcaaggaccagggccccaatttttcagcacacgttagctaccccgtccgtccggaagaactaccggcacaccgccgatgggcctcccccccctgtcgcgtctcgttagtccactgccgtgttctctttccaacctgtcagggaatcgtctagtaaacctagagaagagagagagatagaaagagtgtgtgtgtgtgtgtgagagagagagagagagagagagaggagaggagagggaagggaaatgaaggggacgtgccgggccacgccacggaaacgactcggcaaggagccaaagcgcggcacctgctgcccccaaaaggcgtcgtgccgcggtgcatctagctaggccggacgggctaggaaagcgatgcatggtgtggcccaatatattgaacacctttttctagctccacgtccatccatccgggtacgtacgtactactgtgctagatagctcggcgctcggcgatgcctgcacggaccgaacaaccggtccaaaccccacacacgcactgactgcacgcacccaccaccgaatagcgaacggattccttcgctttcttgcgtgtgtgcgtgcctgcatgcatgcacacgcacagcccggctggccggcgatccgcgcaaaagctcacggctttaagtagcctctctctcctctcttcttcctgcccgatcgtcgatcgatgcgatgagttggccttcatttggtcacccggtcacccactatggaactcagggttggcgttacggcgcgataaccgtagttatcacacttacaatgaaggacggtaaaagaaaaatcacggtaacctatttaaatttaagtaaatttaaaaaataatttaaaattttgatcaattttacacggtttcgtatagtttgtcatagttaccacggttaccttgcttaccgccgaggtgcggtaacctggtcctgacggtttgggaaaccctgtagtatggattcatctgttagagttagttcttttttcgtgagtttctttcactgtagatgactgaaactttacacggttcagtgttggggcctgaataaaactctgtcaggtgagtaggaaaagttagcgagaggatgctaaaagctcttttgtcaagggcgaccatactgtcaagttggaggaaaagttccttccctttcacgctttcggacgatagactgtgcagcatcgtgcatgagagtggcgttcggtttccattagcagttaacgcggttggagagagctagtgtagggtagtggagagacatatttggcgtagctaagcttagctaggacacctctcggtctcagttgtcacggtcgttcgtatctctctctctccctctcggttctttttcatggtcatatatgtacaagcgaggattgatcgatcggagcaaaagttatttcactttgggtactgttcggtagcgtcaattcaacaccgcgaaaaggagcgcggaagcattccatatatatgctcgcgttttccttcgtccggcatccatccgtcaggttactcgtgcgtatgtactgcggcacatactactcctacatatacagggtcaacacgagagagcagcgcgtaggtgccccctaccgccctacccagcgaccagcgtgacgccagttgcgttcgaattgagatgcatgcatatcgcggtggtcctgtgtattgaccctatctcaacttcatggagccacaccagaagagagaaaattacggtacatgtaccattcaagccgtggagaaaccacgccccggtcggggcagccagccatcgccatgcacgtcggtctcgacgacatcacgctccgcgtagttttccgcgcgggtgggcgcggtggatgcgcgagacccggacgggcgagatatttttcgccggcgtcgcgctcgcagccacgcaccaacgaacacagtaccagcgcgcgcgcgcggctgggttgggtagctaggttggaccggggagcgggtgcgtgcgtggcggcagcaagcgaacgagcgagcgacgtcgcgttccgtggagaaagcgaaggacgggcgggtcgccgacgcggacggacgcaggggcgggaccgcgcggtttggctgctgctgcgcgcgtctgcttttgagttggttatgatcaggtggtccaagagcagaggggggaggggctgggaccatgcggctcggctccgctttcgtctcgaacagtgcgagcgtatcgtacatgtgatgtgcgtggtggtgtgcatgcatcagcagcattcagcgccgacggagagacgtacgtgccggggtcactgatatggctttttccgattaactgtgctgaggtggaataggtttttgtttcgaccccaaagcaagcaatggcgttattttcatttattttgggagctgcggcgcgacatattttctcggcccaacaacggtagtttgcatgagggcctattttgagttgggttggttctaggcccaaaaacattacaaatggagtagggcacgagtaggaactggagttggattggattatggcaaccgtgctcctataatccggcttctcgcctacgaccatcaccggctcaaaccattcggtgtgtcgtgtctgcagtgtccaaatcctgctggatccctcgtagcagctatcgtacagtgtccaaaaccttcgatcgtctcctccatttgtcattgccatccgaccatccctatcacttactttgacatgaatccatggcataccggaaatcgcatacacaagctgcggccgtctcctcagataggcgtgtccccatgttgttctcaggagcaccctttcctcgatgaaacacccgctccttgcactaagaccattcacaccattcgcggtgcaagaccctcctacaaggggtcctatatgccacgtacgtagattgagaccacacctcttcaaatttcttctcccacaatgcatttgagcctagttggaccgccgggggaatcactttggacatgatctgaagtgtacgtactgtagactaactgactaagcaagttcaatcgttgcaaaggaaagacacagaacggttataacagaattctttaaaagaaggcatagctaagaatttcgcattgaggtaatcagattgacctgattttccattactctcttagttccctaatttacatttactatacagctgagctaaccgagcggccgagctgatcattttgaaggaacaaagttattctgttattgaactctcatcgacaggccacaaaagaaacatcccttccgaattcagtgagctccaatggaaaactttggtcaatttacaggcagccgctatcaatagagccccaaaagtttccaccagaaggttccaacaacaccccagatcagaatattgatcaaggctgttacgaaacccatcctgaatacatctggaagctcaagataccccgctgcagatagaaagcaacaaattacagagtagtgagaatatgaatttggaaagactaattatggaaccaaatataaaaggaacaacagcatagaaggaaataacaggttttctcattctatatctatatgccttatctgttatagcatgttgtttttgcttcctctgctctttttttttagggtaacccgtttgtaaatgaaaataatgaaatgaaatccagaaaagtagaacatgaatttacctccaaagtacactgcagcctgtccgctactataatgagttagtgcaccaaacagatttgtgttgaatgccaaagcaagagctgacagcactcgaggaacaccagctgctacatgcatggccagaaatgccgagtataaagctccaacatgtccggtttggcttgcaaatagatagtgaatcaggaagtaggaagcctcaagaacacaaaaggctgcaggccagctcagcgagaaggattcaagcagcttggcaacacagcttgacatccatgacacaattcccaggttagtgagctgtcctgccattccaactagaactgcaaaccatgccaatgtatcccatgcagatttctcatttaagcaatcatcccagtctagcacacctagcaagagaagaatagagagtccaagcatcgcggcaacaacactagatacaccgatagcatccctacacagaagtcattttacatgatatttagggaatagttgaataaatatgcaaaaaaacaagagcatgatagtaagggcatattatctatgtacggtattctgaaacaactgcctgattcataatgctattgtcttcactatattaccctttagcatactaaaagtacaggaacacaggtgatctggatgcaaactaggattggtactaggaattggtcggagttagcttttcttctttttattttattttattttttaaaaaaaactacaagctgcaagacagttgcagctacagattaaagcaaatggtatcatcaaaagaaaaaacactcattttctatttgttatcaagatcatatgttagttatatgaaaaatcctactaataattaaggaacatttaaaaatctgacagactcttgtaaaaaatggtgaaccatatcagaatcaaaagttgaaatgaaatgtgattaatacaggaatacttgacctggtgtctacagggaaaggaaagctaactggaacaagctgctccctactcaaatatgaatgaaaaatcacacaagtattttaacgatgcaactattaagtatcttgctagcaggaggcaattagctgcattccatggaaagttttagtcaaccaaaaagcaacaaagaaaattatgtcacaaactgcaacattgtattgatatcaaagtcaacattatacgtgggagcacttgtactaaaggaggagcttgcccaaaaactcttcatgggactgcaaggatcactaaggcagcctaaggatgctactattaagtactctactatggtatatcaatataatcaaataaagggaaacatttaaatgctgcaagattggattaatgtgacaacgtaatattaagattgaggatgatgtgtagtggagaagcttacccaaatacccataatgaaactgcaaggagcattgtaccaatcataacccattcattcttagtcactggacccatgcgctcaagcttctctgcagctaatgctggggcatcaggagtatcctttgtttcagggggaaatattttgtatagcaagtatggtgttgctagtagagaagcaatggctggcaaactagcagctttgaaccatgctacccatggatttgcaacgataataccaagctcctctgctagcttcaagcacaacaaattttgtgctgcagcagttaggaagagcgcacttgagttaccagctgcctgttaaaaaataggagaagaaaactagatactctgtaaaaacatttctgaagatgatgcgtatacaatgaataacagaagtataggatgcacagaaacatcatgcatgacacaccacatgacattaaacacggcaatggtactaaacccaagagaattataaccggcattctgcattcttactgtttaatggaaacggtaagaaagcaaaatgcacaaagtcattctgcattcttactgttcgattagagagggactataaaatatcgttgtcttatgaccagatgaatcctctcttttccaaaaccttcacccttctgctagattgatgatgaactcagtcacataatattacgaccattcatgcatcaatggtggcattatgattaaaaaatacatcaaattgtaatttaccctgtaagcaggctaacaaaacactaggttgatctgacaatggcctagctggttgcctgatttcaacccaaaattactaggtaaggatgttctgcttgattgtaccaatgtgccacccagttctcactcccactccacttgtgcagagcccaacggcaggacacagtaatagtcaatgcaagtagcaatcgtcccttgctaaaaccaaaatttggttgctatgatcagaaaatcctggttgcaatcgatctatatgaacagatcccatgcgagtatgagaaattttatcacttaattacctggaattgcgacatcacaagataggatccaagcttccgcgacgacgggtggttcggcttgctccctgccgagagcgagagcgacttgatgatgggcaggaacacgcctccggccctcgcggtggtgctgggcatggccggcgagatgaacgcctcgctgatggtgagcccataggacagccccagcgtgctgcccccgagccacttgacgaagtaggtggcgatacggtcgccgagaccggtcttgacgaaccccctcgcgaagaagaaggagatgacgatgagccagatgacctcgttggtgaaggcggagaaggcggcggcgaaggggagcgtgtgggtggcgacggcggcggtgagccccaggaaagcccaggcgccgacggggagcgggcccagcactagccccgcgatggtggagaggaagatggagaggagctgccacgcctgggggctcacctcgggtgggcgcggcgcgaggaaacgcacggcgaggccgaccgcgagggacacgaggagcggggcgagcttcgtgccggcgggggccgggctgtccgcctccgggttgggtgtttgcgaggcgaggagaggtgggatgcggcggcggagaggcgttggggcgaggcgatgatgatgatgatgatgcgaggagagggagagcgaggtgtgtgggagggagagggaaacggcggcgatgtggcggcgccggagctggtgcggggatgggaggagcagaggcgggcggtgggaggcggcgatccggaggctctccatcggcgtcgacggcgacggcgaggggagtgtggggcggcggagtggtcgaggtcctcgtggaggcggtctcaggagaacgacttgtagtgcggcatttttgaaggaaaaaaaaaatcatagatactaacggctggttttatatttctatcgatacgaacgtggtgcgaacccgacccactgacatgggaggccacgtctcacgtgtcctacaggggcccacctgtcagtgtgttggggtgtgcaatgcccaggttgtgattgctcagttccaatgggatactcgggatcggagtgggccccagcggcagccggaggaatcgcggcacctatggctacctgaggctgaaccgagcgccggcgatggacccagcgagggcgtcgcggttgcgccgaacgcgtcggcggcagccaatggcagggcgacgcgtgtagcccctagatatacatgctcgcgagtcccctgccgtacgatgaagctctgacgatctggatggttctcacacgtcccgttcgcgatttggactcgctgcattctgccgatcgccacaattctcacgtggccccttgctccagcgctcgtgggatagtcacaggaggcctgctccatctcaaaatataagaaatttagataaatatgacacataaaggagtcctaaaaatattttaatataacacataaaggagtcccaaaaatatcttaaaatataagaaattttaggtggatatgacacacacagaagtcccaaaatataaggacacatacagcagtcccaaaaatatcccaaaatataaggaattttgacggagatgacacatagagtcccaaaatataagaaattttaggtggatatgacacaaagatttttgggtggatctgatacatcctagtatagagattttgtgtggatagaacacatcctagtacaacaagtctatatgtctcatccacccaaaatcccttatgagatggagggagtaatgtggtaaaccagcaggagtggacccgtttgtcagtgacaagactaatactccgtcaccatattcctcaaaaaaatagacatcatattcaggcctactaacaagaaaaactagtggatgccccgcgcgttgcagcgggatttgagaattcttaccgagaaacattgttgatcaatcttcacgtgtttcctttttttactcattggttgcgtgtttttttttccgacaaaataatgtggagtactccctccatcctaaaaaaaactctaccttaggaggggatgtgaccagggaggatgtgacccctactagtacaacgaatctaaatgaatctagacagttcttagttctttgtccagattcgttgtacttaggttaagtattttttggggacgaaggaagtacttgtacttaggttaagtattttttggggacgaaggaagtacgtgtttatcaagtgggccgctttcgtccactggctgctaagaaagaacgaaaatattttcttctgttacttgctaggccaacagcccactgggcggagaggttcgttccggttttttttttttttttttttttttttttttttgccaacagcaaactgaatacatgcaatgtttgaaggccattcgatcaagatctgactgttaatatgcgttaatgacgtggcgagctgtgggtactaactatataggaagaagagatgccatcttgtatggaatagaatgttcttcgttaacaaaatgagtagataatgcttctacattaaaaccagtagaaatcattttgcaacagcttacactacagacgacatgatgcatattctgatattcatgcattaatccgcataataaccctatggttccaaaagataggagtccaaaaacctttgtgattattaaaagttcaaaatccaatcagctatattcagcatatactgtggggaaaattatatgctgatgaagcagtgaggcctacacctatgatgagttgatgaccaataagattcttgtgaaaacttgactttgttaaagaagtgggatcaccttcatgcgacagcactccaatcgcgcgtgtcgtggtaaacagttataaggttagtcccttaattcttggttctctgcctcaggagcacttggtaggaggcaagagctcaggtatgtcagtacccggagcatccattgcatcacgaggatacttcgcgggggtgcagcactccgatatgtcaatgccagcaacaaccattgcgttgcgaacccacttcggaacatcgccctttgggaactgtcaccaattggtttgagaaacgaccagccagtaagataatcatcaaggaaatagcaaaacagattgtaattttggttttgtagatggaatgggtagcacatattatcaaggaggcagcttagacatctcagagtcaggaatgacagaatttacttgtggtgctgatagtttatatataatattagggaacaagatatacctgcatcctcaagaatcctcgcacgaatctacaatatggcatggaaactttcttattcaccaacacagtgagaaaactgacaaatgacacaaaatttagctggatgataacatactctgggaatcgtccttccagaattgacatgtggaggtctctacttaactgaaataaaagtggatgatcaagcggtgacacttaaaaagaaaagttatgtggaaatattcattaatatacccgcatcataaatgatagattgtgatacgacagcagttgggaacccatagcatcttttgtgacaagacaatgcaagtaagcacgtgtatagtttttgcagacctgaaaagatagtcaagttatagaacacgaaatagaaacagaaaaagaaaaagaaaatttcgaagcagtttaacactttgttcccagtagaacgaagccttaccatacatggacaggtcggatctatcggtcgttcatcagttgccattgcgttttgtttcaacttcagaacaccctaggagatatcacaataaggttgcaaatgctaagattagaatcaaactcagaggaaaagagaaacaaaattattgtgagcttgcttccatatgttaatactctcatagattatgctaactggaataaattgttcaatatcactaagaccatcaaatcattccatgtaaaatattagtggcactagttatcagtgcgaaaagaagatcaaacataaatattttctctagcttgaattgtatagttgactttgatggatagataagttccatacctcaggaacaagtgcagtcccaaagcgagcagtacgagttggataaacacagtcatacatgtctgcacccaaagcactacatactacaatatcaagtggatagccaacaccctgcaaattagcataacagcaaggtcagccaaacaacccaaggaagctacatggttcaaattgttgtgaatcatagaagacaatatcacttttggctttatgagtactttgagaaatttgaaactataccataacatatcgtggtttatcttcaggcagtccagcagtgcactgggcaacaacacgccagaacgagtctttatcttcaccacctgcaagaccaccaatggcatatctggcaacaaaatatcacggtaagtggtatcagccattgaattgtagatcagatatgagataatatagcgtgcatccaccgacaaataaataaagagtgcatataaagcaggcacaacatctgaagatcatgcatcaatcacagaaaagacaaacaatttgtttttggctgcatgtaaaaaacttgcctacatatttgctacccatggaaagaaatcctgagagaaatattagactatgacataccctggaaggttccgctcaaccaagcccttcacgcagatatctctggaattacaaaaaaaaaaacactattgattatttcaattatgccttaaaggattgatatattacatgattagatggatgaactcacctaagaactggatctaatcctccttgtacaatcccaaataagttctggacatcaggtttcttatgagctatatgtattgacaaaagaaaacaccagaccttagctaaacatgcttagcattattgtaaatgttcttttcttaacgccagtaaaatacatagcagaattagagtcataatcaaaatgatgctaagctctaacttaacgacaaaaatagtgaaattaaacgccagaaaagtatgaaatacgggcagtggcaagtcatattgataaccataccagcaatgcacctatcaatccaacgaagggtacgatacatagcttcctctatccttgggccagtaattgtggtcttcacaacatcatcaagagccattattatatcagctccaatgttgttctgcattcatgttcaatggataagcatacacatgataagatgtaaaactaccaaatctattggcgcaaaactctaacttttacaagtacaaatcttgtctagaaaaggatgcacctgaatatggatagattcctcaggtgtcaagagcatgggcttcccatcaacaggtgactgaagattggtcaagagaaaaaaaatatataaaagatacagagagggaggcattttcagcagttgtaaaattccaaggaagaaagtacaggatgcctcacacacataattaagcaaaagaaccaccaagaaaaaaaattggcttctattactaacatcatagatatgatatgataccatgccacaacacttgactatgcaacatctgctagatcaaacggcaatatatatctgttcattcaagaaatatttatatgtttgtcgaaaaccatcagctaaccgtgtggttctcattagtctcacaagttcacttaagaatttttggttcatcattgtaataaatagcagtttacagggaaataacaagactacaggggatgcccagtacaatcagaaatattatccttgctcagtatattttccattagttttgaacagtctcaattcagctttaagaagattaaaaaaatcttataaacctccacagtaatacaagcatgcctcctgattattatatgataacacatggacagctggacattgttatcaataaataattataaactgtggcacatttgaataatttgatttggaagtatgataaacatcagtgcacaagaagttgacatctgtaaaagaaagaagcatcacaaagtagcctgcacaaatctacctgaaatgtaactccttcctcagtaatgtcagccaaatgtagcaaagaaacctaaaaagcatgtttccgatcagtaaaatttcagcagggaatatatattaacattggaaaggagtaagcactttggaaacaagtatgtgctcatgttgatagagatcttgaacaattactgtcttctttcaaataaaacagaaatttgattaaatctgctgttaagaaaaaataccagtgatatttaagatattgtcatctcattttttttcctttaaagccagcatcaataggtttctcgtcttttaaaaatcagcattgtattttacatcaagtgatcaaattaagtgcaattcagatttcatgtgtggagcaactggttgttgggatcactataacaaaatggtactcatgggaaaacattatcaaagcaacaagacttgacaattaccagtgatgtatttaaactaatacagcagaaggtatttacatacaatggcaaaacattaaagttgatgacttagttatttatgttataacgatccacatagatattcaatgtcttaaaaaaatgaagatttggagcaaccatttggaaaccaccagagtcagtcagcaacgcccttttccaattcataaatttgtgaaggccacccaagtcgtcaataagttgagaacctggacgaagttcaaggtggtaggtgtttccaagtataatctggcaacctatttcctctaactggtcagtagtcaggccttttattgtacctgagtagagagaacagaaattaaaatgctatgagatacaataattcagagaacaagaaacattttgagaaatttatcatgaacttctgtgaactaaacaacatgaaaactctgcttctttttttttttacacaagaaaaactctgcttcagactgaacaagtgttaaagcaacagacacaataccttgagttccaacaggcataaacagtggtgtctgacaagtaaagtggggtagtgttaatcgagctgcacgagcacgattgaatcttcctaatacctgcaagcaagaataatttttacttcaggtttcgtcattatgctcaatgcctcatataagatctaccgctatgtcagccagccaccttccatcagttggacaataccgacgatgaggctggacagaaagaccatgatgagctgacagagtgacagtgctagaggtactaggccactctaacaggacgtgccacgtggcaattacatatgcccacattcatgcttttctattattttcctattacatggaccactaataggactataggtatattagcttaaccttagtgaagggtaataaacaaagaaaactcaagagatttaatcaaacaaagtacaggattaacaggaatacagtatgtagcaccaactgtagagtgtagagctaggcaatgacaaattacaacactgagaaggcacgtgcctatggcagcattggtcaactaccttctttaactaaatagttactaatccagagtactaaacgcaatcttaaaataaaacagtatcagcttaattgggaatctgtactcccagaagatcgtatgagacaaaaatgattagagtgaaaatcacatgtaatggcttgtcgactaaaactacagacagaagtacaaatcttatccacttaatcaccacaaacttcagccggacgcctagtttgcgtatgcgcaaaccagagaaaccgttgagtttgcttcgcatctcagcaatcaaacgcacaagcaaactagggaaaaatcatctagaatcgaagaaagaacatgcacccatttggaacttcaacaaacctcgaaccgaagcgccatggagaacaaataaaaattaaactccagccaccgagctggaacctgcgcgtccgtattaacaaaatcagctcagagattagctcgaagcaacggaaagaacagccgagacgcgcttcccgtttggcgccaaatacgatattgaacgcgatacggaaggggaatctggcgcgaccaaccaacctgcggtgcggcgctaaggctcgtagaaggggatgaacaaggccgcggggagatgagacgaagaggaggcggctccgaggggagtcaaagcccactctcgccggcggcgggggaggaagccctaacgcggttcttcttcggcgtgactttggtggcggcggccggcggaagcccagcaccgatttaaaaaggggaatgggaattttgcatggaacaccctcatctatgacatatttcattcgatgccttccattttgcatcctcctgcttctgggcaggctaatgaaccatgaggaaataaacatagcaagaaaaaaacatctatgggtaatatatttatattattattgttttaaaaccacaactgaaaaacagaccgatgaaaaaaatccaaagtcaaaatcacatgttggctattgctaataagttaacaagcaccaaattttctcatatggtatgtgtcttgtgtttggttaaatgtcatattctctttattataagcattttaaggttttcaaatcctattcaatcgtgtgaggtgtgaatgggattttttcttataggtgtgggaataatattggaaatttagattgtagaaagcctcctgtcatgtgctaactaagaaatacggagaattggaataattggatcatgactcccgtgtcgcctctctggtgacccgggaggcgaaaggccgacgcccagctccaaccccgccacgccccgtctgcctcaccgccgccggcaacgccaccgtctgcggtggtggccggcgacggcagggccgccctcctccctctcccctctttctccctgtctctttcttcctttctccttcctccctcccttcttctctaggtttgaggcttcccggaggcgtcggccccgggcttggttcctcctcctccacgtctcacgccggcgaccaccaacatctcctgggcaggtggtgagggggacggccagatctgacctcccaaggtccaaatctgacgcgactctggtgtgatccggactttgaggggcctagcgacgactgtgagggctacacgtgggcgagctccgcagtttcccgcgtgtcctagcgtgagagactggctggtggcagcgctgcaagatggggaacggctagatctggccctctaggtccagatctgacgtgtccaagctggggttgggcgaggaccggacctcaatggcggtggtgacgacgggtgggcctgtgtggcgccgatggtccggtggtgccgacgagctctgcagtttagtggtgctccatcagtccggcgaggtggctgagcaggtcatcaatgacgtttgtccggccattgtgcaggtggttgtgtgcatagtacaggtaccccgtgtgcaggtggcatttggtggcttccgacgcagacgctatatttggatgggactctgaggtgaaagccttgctcggcttgccgatgctaccaacgacgactcccttgggtgacgtttacctttttgaaggcgttgctattggagccctcgttcaaactccacatcaagggatttctccgggtgaaaaccttagattcgttaggatcgaacgatgtcgtcgttctgtcggcgtgtccttcttgaaggcttcgttttaggagttttatcccttgctggactgttgttcttagttttaggttcagtatatcaatgctggggttttcgccggttttccataaattaaccatgccgttgtaaggtttttgggtccggttttccttataaactggatcaactctcttcttctatagtaaattgtactaactccctgcttgtccccttagaaaaaaagaattggaatatgatatagaggagaaaataaggctttgtttgacacaactctagatctcaaatggatttgaagtttttatgttaaattgtaattgtttaaaatttaaaattatattaaaaatgatataaaataacttatcaaaatattatcaacgtaatcgtagatataaatttatgaatttatatagagctacggacatccggctctaaaaattcttacatcaggagctatgaaaatagaggaccaaaaaagagtacaagaagtagacttttgaagcccatggtactactatggttgtgtacgtataaaccattgctccccaccggaaaaaaaaagcccgtggttggcgcggccgcggagcaacaccacgtcagtggggtggaaattttgccaaaaatacgattcatagggcttgtttagttcacgaaatgaaaatttttggatgtcacattagacgtttaactggatgtcgggaggggtttacggacacgcatgaaaaaactaattttataacttacctggaaaccgcgagacgaatcttttaagcataattaatccgtcattagtacatgtgggttactgtaacacttatagctaatcatggactaattaggctcaaaagattcatctcacgatttttcccctaactgtgcaattagtttttcttttaatctacatttaatgctctatacaggtgtccaaaattttgatgggatgttttttggaactaaacggggccatagtctcaaaaacaaggttgacgttggctaagaaatgaaagttcatgagtaaaagaaaaaacactcacaaaacaaggtgcccattccggtccaagaccaggtacaatagcatactataaaccagttataaacacgtatcgagaagataaaagataaaagagaagagcaatggactatcacatctcatttcatagataacatataccattaaattaagaggtaacatatacaatatgttatatttatcatacaatccccaatatttttaacactctcacatgcttattgaagtttgtgtaagggttacctcttacatgagaggtgattatttctctctcatctttcttctctcccccacctcatcgtgtagtcctacgcagtatcttggagtttgtgcttggataaacatagtatattcccttatagtacggactttaagacacaatgtgtgtatgataggtaagacaaagtattaatagtgtaatatatatttataggtaaatattgtataaattggatattaattgactatggataatttgaaacttgtaatttgctatgtactaaactgcggttgagttcggttattaactttcccaactcacatatctcattttccgagtgcacgtttttttttcatcttttgcaaataattttatatatgaaagttgatttaaaatcatattattctattttttttaaaataactaatactactaaattaatcatatgctaataaattactccgttttacatgtgggagagtgagttctcaaccgagagaaccgaacacaacaactctggggtctgttcggatgccccttttcctaacccatctcgctcattttccacgcgcacacttttcaaactgctaaacggtacgtttttttgcaaaaagtttctatatgaaagttgcttaaaaaattaaattaatctttttttaaaaaaggtaacaccaccaccgaacacgcctgagacaattaccaacgcatgcaccgaccatctcgggagtagttcggaaaaaaatatagaaaaatacagccgactcgattgccgtgcattcaactctttgatcgagccatatcttcgtgtcctgttgcattcactcccctcggcctttttcgcacagaccaaatacgaccacctaaaaatggttgggaatcatagtaaaaagaacactactactgattgcaaaatgaaattaacataggtttattcctagtgcaggattcatttgaccttatttgacagagatccagttatcaaatccacggtatatttgatgtttgtatattcatagtggtttaaaatttaaagtttcatctagaataagaacaaatttatttatccaattgctatgcatgtaatagtacatcggagggtgaactcctcaagtgggggacagtgaggccccccttgttagttcggctggggcagcgggtgaaaatcgagaactcggtgagatgtgtggtgtagagggcctcgggcccctcgagagcgatgagacaaaaacggtttatacaagtttggaccgctaagaagtgtaatgccctactcctgtgcttgattgatcgactaagaaattcaggctttgagccaatgagaaccaaacgtgagttagccaaagaaccaatctctcttcccccactaggcttggacctccttttatatcttaaggggctgctacatgggcctataaatttgcctaggggaaagggaggataatcacgttaaatgcacgtcttgttgcttgcctcagaagccattcgcacgtccgccacggcatggggcccgtcaattctatttggctgacatggggggacacgcatgtcattcaccatttaatgggggaagacttttgggtccttacttgcaccgggaaacgaaaatcctgctctggctgggttagatgaatcaactctggctgtaatgagaggcaaagcaacctctcatcatcatgatgtgacaggagatgtcaggcggcggcgtgccacctgacatgcaaccagtgcgcaggcgcactaccctagtcgtatcggtcattcgactcgtcacagaccagtcatagatcgatcaggtgcactacacgttgtatttgatgcggcgtagcatgcccgctcacaccaccttaaatgtggtcaggtaagcattggggtcgtccgcctaaccctgcacatgcggcgtcatgcgacccttggcatggagggggcggccgccgtcctacctcgggggagtgccacgtgggtaccagggggagccttctctctctgagcttgatacccccggttccgtatcactgacatagtagattcagatataaggatttgtggaactagaaatacctagctttataaaatcttggatctagaattatgccaagagtttcaatctcattaaatgaggaatcctgctatatgtacgatggtgccatctgattactatctggccgtgttacggcataaacacagctaacaagcgtatacgaagatttatcatggcgtgaatcatctaccgtgtgaggctttctttgttgctttggtcaacggcaacgtcatatgtatatcattttcattaatgtcacatatgttaaagtgacaacgtgtcatgaaatttactaaggccccctttaattcaaaggaaatttataggaaatttagaggaaatttatagaaattttagagaattttatttctataggattttttcctacaaagccctttgaatcaaaggaatgaatcctatgaaatcctataaaattcctatggaatgtctcttctcatacaagttttggaggaattttaacaagagattctacctcatggaagaaatcctttgagtctttatctctcctcaaattcctgtgtttttcaacagtcattcatatgtttttcctgtgtttcgaaatcctctgttttacacttatatttatgtcagaatcctatattttttctattcctccttttttcattcatgtgatttaaaggtgccttaagagagagaagggaaaagttttatgtaaataaatttggtttactaacatgacttaaattttctagacactatttataatgtcatcatcggcgtgaaaattcataccccatcagcccaccattttgtcgagttggggagtttgaggattgggcctgtgtacaagaggcagcgcaaccatgggcacggcccatttatcgcacctccagtacatgggccgcctccgtgggaaaggtgacgtcccagctcacacgtaaagcagcaaccgcgtgtcacgcgacggggaggggcagtcgagaagcgcatgacgagatgacacattgaaaccgtctcgcggtcatctcgtccatggggatggccgcgaccgagagagaaaccgtctcgtccgtccacttctctatccaccactgtccaccgtggccgctccgctccaccgcgtgtcccactcccaccacccccgctctcccgtccgtccgcgcgcttccccccatgcgagatcaccgtctcctccgcctcctcctcgttggctcgtcctcttcccccatccgcctctctctctctctctctttctctctctctccagtctcctccactctcctctcttcgagagccgctcgcgacgcgagcctcttggagcgcgcgccctataactaggcacccgtgtccccgtcccggatctcccccccacccgtcgctccgccccgtccccattttggatggattccattggtataaatcgcgccccgctgggttcctcctcctccgccgccgccgtgacagctcgtcgaggcatcgcgctccgcccggctcgccgctccgtcgcgagtacgaaccggtgagcgtgtgtttctccctcgcctccgcatttttccctcggtttttgaggcggcggcattctgattctgcgcatggtgatcctgagtgcagtgtgggtgtggcgacgatcggcttcggggacgcgtctgggctcagagcgtgttctgagaaggcaggtgtctctatctctgttgcgtcgatgcctcgtttccatgttgatttgggtgtaatgatccgagcgtaattggtggctggtgtaggttaggcgatttgattctgtacgaagcaccacggcgagagctcagaacgggaacgctgggagaagcatgaccgaggtatctcaccaagcttgcagttgctggcctttatattatgatttgatccatatgtacgtttttagggatcgcaatgcttgacacaatcatggtatgtttgtatgttcccagctccatgcaaacatgttctgtatctataaactggatcatgccacattttgccatctcttttaattttgcttctgattctaggatgtgccattttgtcttgtttttctaactttgtgttcaccttctcctttccttatttttaattatgtaaccacaggaaagaggatgtacaatgtctgatactgaaatgccatttaaatattcctctggtaaagccttcccattaggagtgtctcaagttgaaggcgggctgaacttcgcacttttctctcagcatgcttcttctgtcattctctgcttaaagcttcctgggaggtatagctttaccttttcctaaaactgttgtgaccttactggtttttctttttctgattatatgtgtacctgtgggttctggtctcttaaagtctcaactatggcaactggcagttttgttgcatgtcatctatctccttgctgtcatctttttatgaacttgctcaacatactttaggtctcatactcttacgagatatggcaaacttgtttttcatgaccttactacacgatattaagcagttgttatgcctttgacatagagtctatgaaattttgaattcatttttcaaatttgacgctcgaaaggaaaactacttttctgtttttcagactaccatatcgtgagttgatttggagtgtaagcctggttgaaaacttgaaataatctcttacagattaacctgtaattttagcttgtcctttccacggtaacatgttacattct

SEQ ID NO: 67154 - DNA, 39999 bp, Oryza sativa
  unsure (1)..(39999): unsure at all n locations
attccggggtgccagattgagaagcgccaaaaagtctgtgaaggtcattggggagtccatgctctgggttgtaaagagggtgattttgatccaggtatggtgcactgtggtaagttgtgttttgcaaggggtactgtcacagttcctttccgaggtaccatgaaggtattaaggcgcccggtgacgtgttgtgaagttgtgtcttttgggtacagtagtacatctctggccagagtataactattcgaatagtcgtgcccgcggttatgggcgggtctaacaatgttttttcgtgattagtctcacattactcattattggtgataacctgtgataattaaattgactcctggtttggaatggtatattcctggtacggaggtttggtttgtacaaccggggttggttgttcagatgaggttgcacctatgcaacacgggtgtgttgtatagtgtttatttaatattgcttaattacttaactgttttactattctctcaaatgtttattaaatgttgtttatgcaaatgagctttattatgccatcgtttgctatcctgtgcacttgcgtatttgctgtgtggcttgttgagtatgtcatatactcattcttgcaatattcattcatcagaggaggagtacttcagtgaaggtgatgatcaggaggattaggctttgttcgggtcaagttgcttgtggagtggagtcgccatagctatttagtcttttgtttatttttccactacgtagaattttattcttttgagaggaactatccacccctgtaataatttaatattttgcgaatattaatcagtagtttgatagtactcttttatcaatttgttattgtgtgcctcggctgattcctggatgaggatttaacgcacatgtaagcgtttggaattgtggatagaaattcctagcgtgacagtgataaagtcgaagcagaatccgagatggagatcggctgcgaccaggatcggcggagtctgagttggacaaggttagccgattgagccgaatccgacaatatgacatagcatacgttgtcaggttgagttaatgtgcttcatgaggattgccacgcacggatagagtcctaagaaggcaattgtatctattaattaggatatttcatgtaattttcttagagatatgtttgggcaagagtctgctgtagagacttatggtatcttagagtttgttagagataaaagtcgtgtccgacatggacatattttctaaatctcgggtataaatagaccccgagcctcatgtaatcaatctaacatacgttcaatacaatcttggcgcatcgccacccttttactttcgttttgttttgacgagttcttgctttcgggttgagctgcatcggttttgatcttcaactagaggtaaaacttgttatggcggcttgcgttctcgggattagtgcttccatctttatgatactctaatcttgattatgtaattcatcgagttatcatatattctgtataatctacgacaatatcgttatctaaccttcaatcggctaagatctatcattagaaggcagccgattaggttaaatatctatgttggcttagattgtataggatatccaccactctatgaaacatccaacggcttgattgtctagattttgttcttcttttcatacttatacttatagctgcatcagttgagtttgaccttataggtcgtgattagaatttcaatctccagcctgcttttggttgtcgattagggtagtatcggggttttagccgatcttacctgatttagccttattatctcatgcgcttaattgacatgctagatctgccctttatattaagatcttattacaacaaattatattaggcttctgtttgatatattttacttgctttaatatcttaatatagagtggtatcggagtattagccgatacgtgctagatctatctgatcggcaatgctatgaacatctataatcttgttgttaatatatacttcgatctaagtgatttatgctgtctcggcatggcatccgatctatcccaatcacttgatttaagtatatattgtcacgcccggaatttctatccaaaattccaaatgcttacatgtgtgtgaaccctcgtccaggaatcatccgaggcacacaataacaagttgataatagagtacaattattactctaataaataagcgaataaaatgtcattacagaggtagatagttcctctcaatcaataaagatctaagcagcggaaaaaaataagataaacggcgcagacgactccactccacaggcagcttgaccagggctacacctaatactccacaccatcagcatcactgtagaactcttcctctgatgaatgattgcaaggtgagtatataacatactcagcaagccacgcagcaaatatgcaagtgcacaaggataccaaagaatggcataatatagggctcatttgcaaaagcagcatttagcaaacatttgagaattataaaacagtagagtaattaatcatcaattttaatcaacactaaacagcacacccatgctgctcaggcccaaccatctcgaacaaccatacccggctgtacagatctatctccaaaccaggaatataccattccaaaccagtagctaatcaaattattaccagttatatcatcttttattatgatgagaagtgtgaaactaatcacgaaagacattgttagacctgcccataaccgcgggcacggctattcgaatagttttactctggccagaggtataccactgtacccacaagacacagccccacaacatgtcaccatgtgcctcaataccaccacggtacctcggaaaggagctgtgacagtacccctcgcacaacacaatccatcacagcgcacctttcctggataataatcacccccttataaacaaggcatggactccccagcaacccccgtgggcttatctccgccacttctcagtctggtgctccgcaatgaaccatgctatacaaaaggtaaagccgttgcccacgctggattgtggttggcacggttaatgtttcacaaccgaaactcgtgaaccggtccttaattttcatgagcacgactctcaaaaccatgtgctcacaacccaccattatcaagttttagttggcaagtaattaattaaccaatcacgattgaccatcgtgaactatcattaagccaacattaaataatagtgagtcataagttatcccaataatgtgctaatgtttctaagcatggctaagcaatcatatctaatatctagctgaaccaatatatatagtccaactagtcaagttataataacccaaggtatcaaggaataaagtaatcaagaacaaaagggctataacaaacaataggttaattccacccaatgacattcgaaaataaatgcaatagttgaatagaaacaatagctttaaacaggatcaacatgctcaaagggttgtttgggatctgtgtgacttgccttgctggccttggaactcttcaaattcttctcctgtaaaaacggactctccggaaacgtcggaatctaaacagaaaggtgcaaaatcaccaaaacagcacataaaaaagcatgaacagtacatgtggatatttttaacatgtagatctcaattttagaaaaatttagagacttgaaccaactaaatccgagctaagatgaattagttatgaattttcaaagattaaatgggattaaatcatttatttagattttaattgaattatgacgcaataatgaattatttttgaaaaggaaaagggaattattgtgtcagcggctagggttcgcggtgaaccgggtgcacggcggcggctcacgaaaactaacgaccgagatctttccattcaaaacgaatggccgagatcgaccggtccacggccggaccacgggagacgacgacgatgacgtcagcggtgacgtcaccaccggcggcggctcgggcgtgcatgctcgacagcgcgaacggagagcacctacgggtagcggacggcacggcgaactcaccggtgaccaaagcggcggcggaagatcaacggacggcgacagcgatgaggaagaagcggcggcaaccttcagcttgacgacgacggcggtgctccggcggtctacagcagcgatggaggggcggacgaggacggcgacgcgacggcgaccacgacggtgactttcccgagcgacgacaaacaatttatatatttaggatttttagggtgtgacaaacctaccccccttaaacagaatctcgtcctcgagatttggaagaactggcgaacagatgcggatgagctgacttcaattcatcttctcgttcccaagttgattcttcttccgagtgattactccattgaactttacaaaaacggataactcaatttctggttcttctctcatctatttccaagatacggattggtttctcaacataggtcagatcctcttggacttctatctgttcaagattagcttcttcggtaggtacccttaaacactttttcaattgcgacacatggaacacattatggactcctgccaaagattgaggtaactccaactgataagcaacctctcctcttctactgacaatcttataaggtcccacaaaacgtggtgccaattttcctttggtgtgaaaacgatgaactcctcgaagaggcgtgccacgaaagtacacataatctccttcgtcaaaacttagatctctacgacgattgtcggcataactcttatgacgagactgggccacgcacaatctttcttgaatgattttcaccttttcttctgcttcccttaggatatccgtcccgaaaacctgacgttctcccgtttgatcccacaaaagcagagtgcggcacttccgaccatacagtgcttcgtaaggagccatctgaagactagcttgataactgttgttgtacgagaattcggcgtaaggcaaattcttatcccaacttccaccgaagtctaaagcacaagctctcaacatgtcttccaaaatctggtttaccctttcggtttgtccgtctgtctgcggatgataagcagtactaaagttcagcttagaacccatctcttcctgaagcttcttccaaaactttgaagtaaactgactgcctcgatcagacactattttcttagggacgcggtgcaaacacacaatccttgccatatacaattccgccaaccgacttccggaataggttgtctttactgggatgaaatgagccactttggtaagtctgtcgtctatcacccaaatagagtcatggcctaatgacgttctaggtagaccagtgattaaatccataccgatttcctcccacttccattcaggaatcttcaaaggctgcaacaaacctgcgggtttctgatgttctgccttgactcgctgacaaacatcacatactgctatgtattctgcgatttcacgcttcatacttgcccaccaaaatctttccttgagatcctggtacatcttggtactaccagggtgaatggagtataaagtatcatgagcttctttcagaattgcatcttttaaatctttgttgtcggggacgcagattctcttgcccaaccatacagttccttgctcatcttccaagaaaccgatagcttttcctcttctcatattcttcttgatttcatgaatatcaggatcattaatttgggcttctctaacttgatcaattagagtgggctttgcttctaaggctacaacgaaacctctactgacaattcccaaatttaatctttcaaattccttgcataactccaatggcagctgtcgtccttccgtagcattgcaatagcctttcctgctaagagcatctgctacaacattagcctttcccgggtgataatgaattcccacgtcataatccttaattaattccaaccatctccgttgtctcatgttcagatctggctgagtaaagatgtactttaaactcttgtgatcagtgtatacctttgtacgagtaccgaaaagataatgacgccaaatcttcaacgcatgaaccactgcagctaactcaagatcatgagtagggtagttcttctcatgcggacgtaactgacgagatgcataggcaaccaccttcccatcttgcatcagaacacaacctaacccaagcttggatgcatcacaatacacttgaaaacccttctttggataaggcaaaatcaaaataggagctgatattaagcgattcttcaactcttgaaaactctgctcacattcttctgaccacttgtactttacatccttttgaagtaatcgtgtcatgggcttagcaatcttggaaaaattctctataaacctccgataatatcctgcgaggcctaggaaactgtgaacctctgaaactgtctttggttgtttccagttgattacggattccacattactaggatcaacggcaactcctccggctgagatgacatgaccaaggaacttcacttcagacaaccaaaattcacatttgctaaacttggcatacagttgatgttctcgtagcttctctagtgcaaggtgaagatgttcttcatgctcttcttttgttcgagagtagataagaatgtcatcaataaagaccaccacgaacttgtctagatattccataaacaccttattcatcaagttcatgaagaaagcggggtaattggtaagtccaaaagacataacagtacattcaaacaacccatacctagtggtaaaagctgtcttaggtatatcttcctctttgattcttaactggtgataccctgatcgaagatctatcttggagaaaacagtggcacctttaagctgatcaaacaaatcatcaattctgggcagcgggtacttattcttgatagtcacatcatttagtgcacgatagtccacacacatcctctgggtatgatctttcttttccacaaaaataaccggagctccccatggagatgaactcggtctgatgtatcctttctgaagcaaatcatctacttgtctcttgactactgctaattcattggccgccattatataaggtctcttatggatcggagttgttcctggtaccaaatctattctgaactctatatcccttttaggcggcataccaggtaaattgtctgggaacacatcgggatactcccggactataggaatctcttccaaagtcatttggttcagtcttgaccttaaagactcagaagacaatgcatgaacagttacaactcgaccatcattgctggtgagagttacttttctgttggcacagtctatcacacctttatatctggctaaccagtccatccctaggatgacatcaaggtctttggattctaacaggataagattggctagaaatggtacttcttgaatttctattctgacagaggggctacgttgcaaagagagtgcttgattacttggggtactaaccatcaaaggacgtctaagatcttctacttccatcccatgatttcccgcaaaactcatagataaaaatgaatgtgtagcaccagaatcgaaaagcactgttgcaggaactgagttgacaaggaacgtacccaaaatcacatctggagcaccttgagcttctgcagcagcaacatgattgacacgggcctttgatgctggtgtggtagagttgctctgggcagggacaaccttcacgcgtcggggcttcggacacttgtcagagtaatgtcctgggtctccacagttgaagcacaccccgggcttgctaccttgctccctcttggcaggctgttgctgtgttggagctgcaacagggcgtggagcttgattgcggatgttgttgccagcattgttgttgaagaactgacgctgcggacgaacaacagacgaagaacctccctgtggcatggactggggtcctaaagtaagacgcggcctctgactattcccctgttgtgccttgaagtgagcaatccggcgtttcttctactccatgcggttgtacttgtcctcctggcgaatagccttatccactaacttctggaaatcatgataatccctagtcatgagtgggtaagaaagctcatcattaagtccttccaagaacctctcctggcgctcttcatcagtgcgcacatctttcggagcataacaagccagacggttgaactcgtgcagatactcggtgaccgtgcaagatccctaggtgagcgacctgaattcctactttttgagagacaccactcccgatggtatatgcgtcttccggaaagcagcggtgaattcaagccaagtgataggttcagcagaagttctgttaaggcggaagtgatcccaccactcagaggcagggccatgcagctgatgtgatgcaaatgagaccttctcctgatcagtgcactgaagcaaatccaacttcttctctatggcatgcagccaatcgctagcttcaacaggattagtggttctagagaaagtgggcggcctcacacgaagaaattctgctaacttgttctggggaggtgcatggttatttccctggttctgttggttctggagttgctgcatcatcatgttcataagctgtgcctgttgagccaggacttgggcaagtgtgggattctctccattgttgttgttgttattgttgttgttggggccattcccgttgctgcgagtgtgcaccatctggcatgggcaggatcacaagaagagaaaccggggaaaactacttaggacagagaattaatttttctactaacttaacttttactgatcttaactgagtttcattattacaaaactgaagactctcacaccactaaactcaccaacttcctaacactcaaaagcaaacaaacgcatgcacttacatcccaccactgatgtaaatcacatgtgagacacacacaaccaaacttaaacgaacaaactaacacaacgatctaatacaacggcttaacaaggcactctaggtcttccgggcatcgaagttgattgaaggctcgttcggctcgtctccatcatcttgagtagctccccactcgacctttgaatgggtgtgcttcgattcttctccttcatcatcacttacattgacgaccggaggatccgctagggctggggtaacttctttctccaccacacggacctttggcgccaattggtagcgagggacaaatagagctctcttccttgcggtaagacgaatcctggccttctgcggtggttcttctcccttcaacgcggctagttccttctccaaacgatccaccttgtcctctagcctgcaaatcttaccacgattccagtcttcacgatcttgagctgctagcacaacctccgcacgggtttcatccatagcccacagcatctcaaccaaatgccttgtggtagcatcattctcaatcccctcagtctcaaggtagctgccatggttacttccctggggttggcgaggatggtagcgatactcagtgtcggccaactgatcactgtagcgatcgcggagctctcctatggcgatccttgccacctcctgacatgcatggatgtagtttccttctccagcttcgaacatcactgatgggatatcttcactattactgttcaaggtgactttgactcggcacttctcttcgtgacgatcatgaggaatctgggcatacaaaggggcagtcccaaatcctatggcaaaggacatcgtacgcaactcctggacaaatccctcaacaccaaacaagtatttaggcttgtagcgcggcatctaaagacaagtgaaaggagggagttaagacatttatccaattaatagcacaagtttttggattaatttgaataaagttagaaaatcaaagtaaaaggtaagcaaataaagtaaaccaagcttgcaagataagttgaaacagttggaaacaaggtcacaaattttgtacttttgaacaacaggttccaaaagaaataaaagaaagttataaaatcaacatgctaaatttatttcattgcagcaaaataaaacaatgttgtaaaacatttgctggtaaatgagccattagtacagtattagatgtacagtactaacaacactggaataaattttgaatgagaaccactaaaagagattatgaagtgcatgtgctattagtttggtttaattaaaagagaaagggaggagaacagttctacttttccaatatttttagagggcttctatgggtaaccatttggcataacctagggtcaaggaggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaaataagataaatggcgcagacgactccactccataggcagcttgaccagggctacacctaatcctccacaccatcagcatcactgtagaactcttcctctgatgaatgattgcaaggtgagtatatgacatactcagcaagccacgcagcaaatatgcaagtgcacaaggatatcaaagaatggcataatatagggctcatttgcaaaagcagcatttagcaaacatttgaggattataaaacattagagtaattaatcatcaattttaatcaacactaaacagcacacccatgctgctcaggcccaaccatcccgaacaaccatacccggctgtacggatctatctccaaaccaggaatataccattccaaaccaggagctaatcaaattattaccagttataacatcttttattatgatgagaagtgtgaaactaatcacgaaagacattgttagacccgcccataaccacgggcatggctattcgaatagttttactctggccagaggtgtaccactgtacccacaagacacagccccacaacatgtcgacatgtgcctcaataccaccacggtacctcggaaaggagctgtgacagtacccctcgcacaacacaatccaccacagcgcacctttcctggatcataatcacccccttataaacaaggcatggactccccagtgacccccgtgggcttatctccgccacttctcagtctggtgctccgtaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgatggaccatcgtgaactatcattaagccaacattaaataatagtaagtcataagttatcccaataatgtgctaatgtttctaagcatggctaagcaatcatatctaatatctagctgaaccaatataaatagcccaactagtcaagttataataacccaaggtatcaaggaataaagtaatcaagaacaaaagggctataacaaacaataggttaattcgacccaatgacattcgaaaataaatgcaatagttgaatagaaacaatagctttaaatgggatcaatatgctcaaagggttgtttgggatctgtgtgacttgccttgctggccttggaactcttcaaattcttctcctgtaaaaacggactctccggaaacgtcggaatctaaatagaaaggagcaaaatcaccaaaacagcacataaacaagcatgaacagtacatgtggatatttttaacatgtagatctcaattttagaaaaatttagagacttgaaccaactaaatctgagctaagatgaattagttatgaattttcaaagattaaatcggattaaatcatttatttagattttaattgaattatgacgcaataatgaattatttttgaaaaggaaaaggtaattattgcgtcagcggctagggttcgcggtgaaccgggtgcacggcggcggctcacgaaaacgaacgaccgagatctttccatccaaaacgaacggccgagatcgaccggtccacggccggaccacgggagacgatgacgatgacgtcagcggtgacgtcaccaccggcgggggctcgggcgtgcatgctcgccggcgaacgacggcacgacagcgcgaacggagagcacctacgggtagcggacggcacggcaaactcaccggtgaccaaagcggcggcgaaagatcaccggacggcgacagcgatgaggaaagaagcggcggcaaccttcggcttgacgacgacggcggtgctccgatggtctacagcagcgatggaggggcgtacgaggacggcgacgcgacggcgaccacgacggtgactttcccgagcgacgacgacaacgggatcgccgccggcgcatggctggacgaacggcgacgacggcggcgctaggctacacggggctagggcgctacgggcggcgagaggcgaaggcgggggtgtcggcaggtaccggcgggcttgggggtccttttataggggcaaggaggcggcggcgaaggcccccggcgacctgcgacgcgaaggaatgtttagggttcggaggagagagatcgatccgaatcgaactcgaatccacggatttccaaacgatttagccgacgattccaaaagagaaaaggtagaggagatctcgggaaacatttcccctcaattgattacaccggagaaggaaaggcgcgagcgaatttggaaggagacggcggcgcggctcggctagggttccggccgggcgacggcgcgaggaggacgacgagtccgacaggtgggacccacctgtcagcggccgagggcgctcgcacgggcagctgcgggctgactgggccgactgggccgacggagagagagagagaaggttttgggccgactttcggcccaaagccaaaagaggattttaaaaacctttttcaatttaaattattcaggaaatgcaattccatttattaaaaatacttccttagctcaaataaatcccagaaaaatctaggaattatagaattaagcaaagtatttaatgaaattttatctggccccattttatattggaatttattatttaaaattagatcttcttttctagacttttaaaataaattctaataattccaattaaacaacaatttatatatttaggatttttagggtgtgacatatatcgacatagagattatatattatcaatatctacagccgattgagtagatttagtcccttcttacttatttatatatgccaatcgattcaaacatgacatcggctaaaagataaatgatatgtcatcggcaactagccgatcggctatcatttatggatttaacaatggtttcgttgtctttatttcttgttgattgcaggatcaaatcaactggcactcttacgaacctaaaggcaagcttttggacctgcactggagctaagcagatctcccagccctcgtgtttttacatcaacactcttttggcatgcccagtgggaccgagttgcaacaacgttctctcacggaggtccctcccaagactaatagcccaaagcctagtgggtttgaagttcatgagggaaacattgttcccgtcactacagacaaattaacaccggaacaaaagaaggagctcgatctgatgatgcagcaaacacaacaccagttcttgaattctttcatggagacccgtaagggaacagttgttcagaagtataaggtaaaattagttgctgatgttcctggaacaggttcttctaaggatcgatggagaattacaacaagttccggctgctacagctgaatcaggtagtaaaggcattctagagggctcgggagataaaggtgacagttttcagggggtacaagttgaagatcttggaccagatggcaatgtagtacaaccacagtttaacaacttccaagatcggattgactacgccgtgcaacatactttgattaatcaatctggagtgctagtcaataccttgtcaaacatggtgaattcattgtgtagtagtagtactaataataataataataataattattattattattattattattattattattattttgtgaacttaaaagtgtgagaaagatagagatagaaagagagtggggagggttgtatattttaatgatcaaaggggataggataaacatgtaccagtggataggatcgtagggaccagttaaaaaaaatgagcagataaatgtctaggagatgaaagctatccatcactctcctatctgggtaggtgtctccttagacttgaaggaagctgctgctataaaagcctcccaaagcctaggaatactacttgcaccatagaagccagcgtgagcacagggctgcacagagcaagcaggtaagtgtatggttacattttaatagttttcagacctagcaagaagtaagctagctatattagcaaaattttcttgtggtactagtaggctgctacacttaccatatttttagggtgcttttcatgatcctgtgtactaaacaggggcagaaccacccattaggcggggttgggcgaccggcccagtaatggcccacgtcgccccacccccccttgggcctccagatacccaaaaaccgatcaggcgcaggtgcaccgaagaaatcaaccaatcacggaaatagcgatgcatcgtattccaatcggcgacctgttcatcttcattctttctttgctagttcatgccgcatcgccacaaagtcgtcatcgtcccgtgcgtgccgccgccgccctgtttgccttagcccaccagccgcgcttcccatccggccaggccagcccattgtggcggcgtgcctccagccagcctggagccggagggaaccggctggcgggcagcatggagcctctgctagccaccacgctgcacgctgcaaccaccaacaaaggaggaggaagaactgttccccgcttgctgttgctgctacgttgcttggcgtcttggccgctaatgcacgtctgtttctgatctgtagcaaggaagacaagaggagaatagaagacaactgtcaggacattttttatcggttccaaagaagagtagggaagaaaaggtggaaattcgtctcgaattgatgttccttgttgcaagggtaattcaaaagtagtccctaattaaattgttctcaaaaacacaaaagttgtagataattttctgtagatatataatatattcttttatttctatttttattcaatgttttaaatattatagttgcaactgtgaggacagtttttatctagcttacaaaatatcaagatttggaattctggaataaatattgagcaactagcattggtacccatatctagccacacggttgtttgtaattagattttgagggttatcttactcttaggtctagagggttatgggcaccactaatgtgacactagtttaacgacgatgctaaaacaaccacatgacaaactcgcttaattgatgcgtggtcactactcatgtcatttatgccttacttgttaattgtagaattatattattttttttacaattgcatcataatatagtatgtgttgcgttcatatgtctttatcgtgttagtatttttcgccccatctgtattttagtcctggttccgccagtactactaaatggagcaggaggtagatatattagtgtgaaaggttaatacttgttgtggctagtacagagactagaagttactagcaagcagctgtactatatgctatatgcgtgcatgcatgcagtactgcccactcgaatagatgcatgcaagcacctacacactactccatgttggttttctttctctagtatagtcacatcaaccagctatctatggtgctagtagctgatgtcagtagctaatgtcctgcatgacaaatatagatataaattaataccgaagacctgtatatttgattaggtgggacgcagaggaagaacaacagaagacaaggcaagactacgcccgtcaactattttacttaatcacctctaactgaatttgtttacctacattatattgagatggtgtactaataatctaacaataaacattattaacactcgaataatggattgatgattttatcagtgagaataataacgtgattatgatacttagcctgagacggccgatacctgaaatccgatacctgaaataacgatatcgggtcagctgatatcagtgtgagatgatgaatgcctcacacaagtagggaatccggcggcgtgattctcagatgagggtatcactaattggggaaaaaatggattgaaggaacgagattatgacgattattttaatacctctccagtgtattcttaactcatttactatgtttaatgtcctttattatttattggctgttaatatctatgggtagtagtatttttcttctgtctttaaaaacatatatatattgctatatgtactaatcttgctgagtatgtataacatactcatatattattattactatttgatgtgcgcagaaactagtcaagatgagatgtcagaggggaatgatgacatgcagaactagtggggagtgtggtctacttagtctttagagatatccagaggacatacttgcatgctaggtatagggtttcgtcctggtgacaataagttggtcagtgaaccaaccgatgtaatatgcagtaaagctggtggaaaaaaagtaataataataaacggaaccactgttgtagatgtccaagcttcagttgtgatggttagacattgcatcttgccttgcatccttatggacatatataaatattagtatatatgcgtataaggatatgacagactgtcacggaatatatatatatatatatatatatatatatatatatatatatttatttatttatttggggtcgtgacacattggttgatggttcaatggctgagtatcaggttacaggaccagtatatttaccaaggggtgttttcccaaattatcggcccctgatcacaaataatcagccgaatgtttccagtgtaccaccagcttagccgacagcaccagtatcagctcctgcacctgctgcaccatcatcggcatcaaggcaactgaccaatcctcgcttgttgactagagagcaaccacaacatgctggacaaaatgtcaatgatgactcaggaacaggttgctatgatgatgatgatgactccgaagtagcagcagccgaatgggttaggagcaaaaaggttgtgccatgcccatgggtgaagagttctggaaaaaaagaaaggtttgattttgatatcaccaaagctgacaagatcttcgatttgttacttcgggagaagcaaattcaacttcctgctggtcatattataccatcggctgaggaactaggcaaaaggaggtattgcaaatggcataactctggttctcattctactaatgactgcaaagtttttagacagcaaatccaggtggccattgaaggtggaaagattaaatttgatgactcaaagaagccgatgaaggtcgatggtaaccctttcctggtcaatatggtacatacagcaggtagaacagccgatggaagcaggactaaaagtttttagatgaattcggctagaattattaacaagtattagaggaaatatgacaagcagcaacaagggaggtattatgaagaagatgatggaggttttgatcctcattaggactgtgagtttttcagattttgctggaaagaaggtatgaggctgccatctatcgaagattgtcctgaatgcagtgacattgcagaatgttcaagccgatctcacaatagaagcaatcggttgaggcagacaagagttcctattcatcaaagattggacccagtaaatcaagatcatgatcaagatgttgaggagggcagaaaaactcaatggtgtccttctggtatttttacaaagaatcagaagagaatggttcaaagattgaggaacagagaacgttttcgtgaagtggagcaagagattaatcatcggctgaagaagacaaagccgaggcaagagtggcgtgtcaattaccaagctgctatagccgatgatgccaaagccgatgaagcaaaaaatgttggctaaggggaagagtgttgtgaccgcattggttaacatggttttcatgttgcctgcggaattcagagctaaacaagctgatgttgatgaagttgaggaagcttcggctaggttggttttgtcaccagagcaagcggtttttgagaagctagaagggacagagaatcggcatcttaagccattgtacattaacggctatgtcaatgggaagccgatgtccaagatgatggttgatggtggggctgccgtgaatttgatgccatatgctatattcagaaagctgggtagaaatactgaagatctcatcaagacaaacatggttctcaaagattttggtggcaattcatcggaaacaaaaggagttttaaatgtggagctgacagtcggtagtaaaaccgtccctacaacattctttctcatcggtggaaagggttcctatagcttgttgcttggaagagattgatttcatgccaactgttgtattccgctgaccatgcatcaatgcttgattcaatggcaaggcgacaagattgaaattgtgccagccgacaggtcagataacgttgccagtgccgatttagctctttgggagatggacagtattgattgcttgtctggaaaagtttgggatggagattttctaaaagtgttcgattatgatatacagccgattgaagatggagagccaaattattattttgagggcgtcgtggagggttcaaacatttacaccaacaacacagtagatgatctcgatgacaagcagggacaggggttcatgtcggccgatgatttggaggaagttgatataggtccgagtgatagaccaaggccgacatttatcagtaagaatttatctccagaatttagaaccaagttgatagagcttttaaaagaatatagagattgctttccttgggagtattatgagatgccaggactcagccgatcgattgttgaacatcggctacctatcaaaccgggggttagaccataccagcagccgccgagaagatgcaaagccgatatgatcgaacccgttaaggctgaggttaaacatttgtatgatgctggttttattcgtccttgccgatatgctgagtgggtttccaacatagttccaattatcaagaaaaatggcaaagttagggtgtgcattgattttcgagacttaaacaaggctacaccaaaggatgagtacccaatgccagttgccgatcaattggttgatgctgcttcagggcataagatattgagttttgtggatggtaatgctggttctaatcagatctttatgacagaagaagacattcataagaccgcttttagatgtcttggtgcaatcagcttgtttgagtgggttgtgatgactttcagcttgaaaagcgctggagctacatatcaacgggctatgaactacatatatcatgatctaatcggctggctggttgaagtctatattgatgatgtagttgttaagtcaaaggaaatagaggaccacatagccaatttgaggaaggtttttgagagaactaggaagtatggcctgaagatgaatccgacaaagtgtgcttttggcgtatcggctagccaatttttaggatttcttgttcatgaaagggggattgagataactcagaggagtgttaatgcgatcagaaagattcaacctccggaggacaagacagaattgcaggagatgatcggcaagataaattttgttagagggtttatctctaatttgtctggaggattagaacctttttcaccgctgttgagattgaaagccgatcagaaatttacttggggggcagaatagcagaaggccttggataatattaaagaatatcttagctctcctccagttttgattcctccacaaaaagggataccttttaggttatatctattggccggtgagaagtcaatcggcttggtcttgattcagaagctcgagggaaaagaaagagttgtgttctatttgagtcgtcggcttttggatgcagagacaaggtattctcctgaggaaaagttgtgtttgtgcttttatttttcttgtacaaggttaaggcattatctattatccaatgaatgcactgtaatatgcaaagccgatgtggtcaagtacatgttatcagctccgattttgaaaggaaagaatggaaagtggatatttactttgacagaatttgatcttcggtatgagtcaccgaaggcgattaaggggcaagctatagccgattttattgttgatcatcgtgatgactcaatcggctcgtttgagattgtgccctggactttgttttttgatgggtcagtatgcactcatggttgtggtatcggcctggttataatttctcctcgggggacaagttttgagtttgcatatactatcaagccctatgcaactaataatcaggctgagtatgaagcggttctcaaagggttgcaattacttaaggaagttgaagccgatgttgttgggattatgggtgattcattgccggtgattagtcaattggcaggggaatatgagtgcaagaatgatacattgatggtttataattagaagtgccgggagttgatgaaaagattttggttggtaacttttaagcatgtatctcgagagcaaaatattgatgctaatgacttggctcaaggggcatcgggttacaagccgctgatgaaggatgtcacaatagaaattgccacgataacagtcgatgattggaggtgcgatgtgcatcattatttgcagaatccaactcaattggcttctcggaagttgcgctataaggctttgaagtataccttgttggatgatgagctatattatcggaaaattgatggggtgttgcttaaatgtttaagtgttgatcaagctaaggttgcaataggcgaggtacatgaaggaatttgtggaactcaccaatcggctcataagatgaagtggttgcttcggcgggcaggatatttttggccgacaatgttggaagattgtttcaaatattacaaaggatgtcaatattgtcaaaagtttggagcaattcaaagagcacccgcatcggctatgaatcctatcatcaagtcgaggtcatttagaggttggggaattgatatgatcggtatgattaatccaccatcgacaaaaggacataagtttatattggtgacaaccgattattttaccaagtgggtagaagcgattcctttgaagaaagttgattctgtgcatgctattcgatttgttcaagagcatattatttatcgctttggtattcctcaaaccattacaaccgatcaaggctcgatctttgtgttcgatgagtttgttcagtttgccgatagcatgggtatcaaattgttgaattcttcaccatattatgcacaagctaatgggcaagccgaggcgtctaacaagagtttgatcaaatttattaagagaaagatttctgattatcctcggcaatggcatactagattggtcgaagcattgtggtcctatcagatggcttgtcatggttcgattcaagttcctccttataaacttgtttatggacatgaggcagttttaccatgggaagttcaaattggctcaaggaggatagagttacaaaatgagttaacagccgatgaatattacaatctcatggtcgatgagagggaagacttggttcaatcgagattgagagcccttgcaaaagtcaccaaagataaggagagaattactcggcattacaacgaaaaggtggtaccaaagtccttttcggaaggtgaccttgtgtggaaattgattttgccgacagggactcaagataacaaattttgcaagtggtcgccgaattgggaaggaccgtttcaaatctataagtttgtatccaaaggggcttatatgttgcaaggacttgatggtgaagtttatggacgagcactcaatggcaaatacttgaagaaatattacccaagtgtttggattaatagatgatcagctggtgttgccgatacatgatagccgatatgtttacatcgccttgagatggccgatatggttatatcgcccttagttgtttttttattataatcggttgcgttttgccgatatacaatggccaatatggttatatcacccttagttgtttttatattgtaatcggttgtgttttgccgatatacaatggccgatatggttatatcgcccttagttcaatttataattttattaatgccttcgtcattgtaaaattaggggggcacatatatgtaaaagttgcaaagcaaaagttgcaaatttttttagcaaaaacgagaggttatattaatcggcacatcagttcagcaacaaaagcaacaaatgaagtaccataatttcttagccgaatacaaatttttttctaaatcctattacatagtcactgagataagtatcgctggatagccgatacagcctgttgtctgatttgttctatttcttcaattgcttgggcatcttgtgcatcggttccaggggcgacttttaaggacttagtcatatcggcaacattcctaatggccgatttcagcctagacttttgttcttcaatagcacttggaagatcgggtagcttctgcttttcaagatccaattcggcattgcattctttgagttgagctatgagatcaattttgcgggcttcaagccgatctatgttcgactgaatcggcccaatagagagttgatcgagcttggctttctcttcatgcacgagttgccgattggcttggatggtagcttcaatgactttccgctcccgccgatcggctatccgttgctgagccttctctagcttgaattgatgttgctcgaggtatatagctggagtaatgatgttcgctagatcttccgggattaaggcttggatttcagcaaatcgtgcccagattgaaccacaatccgccactaagctgtctaatgatgaccctagccgaaggtatatgtcttcaagtgttttcttaacagtttcatccaggggggctagggccgtgcttgtggtttcttcttctgcttccttatcaaagtaatccttgatgtcaaaagagaacaaatcagctaaggcttgtaagaagaaatttgaagacaattgattatcaagatgagttattcagccgatttgagatttttatagacaagacttactgggatggcaggagcggctggttgttcctcttcctcgatattatggcttcctgcagccgatggagttcggtcacttgacatttgctgcacaggagatgaaggaggaggaggatgctgaaaattcaaatgttagtccgcatgggttatgattaaaaatcctgttataaaagaaatattaccggtggagctggtttagatgctgctgctgccaatttcttcttcacgacagttttctttttctgcaaagtacaagatttataaatgatcggctatgagtaaaataattgcaaaagagaatcaaggagagatgtttacgcttgagaagtggtgcagaaggagttggaggagttcgtttgggtgaagccgatggagtttttcttgtatcacttgcttcggctgcggcctggtcaacatcctcttcagtctcttcttcatccaaagcttgctcgatggatggatctaaggcaggcaagtcatcggctggcttaggcttattcttcttggtcttcttcttgggagccagagctgatggatcgagtgctagttccttggtctttctcttcctgccaacatcggccggttctctcatctgcccttgaagcagacttgaggtcttgagggcatggtagccgatgataggaggagttaatccgccaccgtttggcaaaaggcccggagcatattctatgtctttgccactgttgctcttgtatggaggagaggattatgttgtctgcaaggtaaagagaaaagttagtcacgattcaaatcggctaactgaattgataagagtgaagatgtacctgaggaatgacatctgggaataagtctgtcatatacatagaagccgattgatggaatatatgttgcttccattctccccaccatcggtcaatgtttctgctcctgaattttgccaactctatgttttcgatactgcgcaaaggaggtcatgggatgctgagtagccgatccatcatcagggttaatgaaacctctcctcggcattggattttatcggcaaagaacaagccgattggtagttgtcccattccaaattgcctggctgagctcatcggatcgtagaattcataggacacttgtatatttcttccttggtggatgccactaggaaggatgcatgggctaatggccgctgagaagacttctcttgatttttgatacttttcagagttgaggtcttcaaatctaaagtctcctgggagatcgaagtttattgagtcctcgtatgggaacagactcgagcatctctttggaaaccctcatagaaacggcagaaccagtctttgagtagttcggccgataactttgctccagcatcggctagtgtagaggcatactccccataggacatacatctgcgatgggtgcgctcttctccatcatcatctgtgatcggctctaatctcggaaattcagcttctgttacggctggccgattgacagctttcatggctaccaagtttagccaagtttgcagcaaccaccatggcctgcctgcgctaacgactaagccgacagcaatcttagtcgatgcgttgtttaacatttggtacaaatagtcgagaaggattttgcccaaagggaattgcctctttgtctcaagggctttggctaagaactgccagttggtggtagggccacaacttgatccacaaaaaaggaatttctcaagccacattagcaggaaggccacatgttctcgggaagtgacaggtcctttgcccatatatgctgccacataaccagaccagccacctatgctcttagttctgaagtcaaactggtttttggtgttcaaactcatggggttagctgaagaggtcacatccaaaccggtgatcatggtaatgtcaagcaaggtgggggtcatcggcctttggttgaataggaaggcattgatggtgttggaccagaaataggtggcagctgccatcaagggttcatctttagccgaatttgctatggtgaggtcgagcgcctggctaattccgagttcatcgcagtgaacttgcttgctagccgatacacgcttataccacacggcccagcttttctcaggggtggttttctcaagagatggccaagacgtgaaggtgtttttccagtggcttagattagggttggctaatctaaagtggattctattggtttcgacgatgatgaattcagtaggatcaagattgccgattggaccaagaaaatagtgattctcaggcgacaaacttggaattgctaccagattggacaagtgttacagatataaacaagaacagagaagaagaaaacaagatgaggcaagagaaaaccaatatgctgcgaaagaagaggatctagccgatgggtacttacctctgcgtattcggccgatggcacgacgaatggcctagcggagggcgacatctctgcgggcagaagatttggccggaggggaagtcgccctgaaatcgccttgcaccgaggggatcgccggagagagagagagagaggacagagttggcttaagcggtgaaaacggaactaacagtgtgaaatttctcggggatgacagttagtatttaaagcgtggcggtaatggtcggaaaaatggcaagtgtgatattctctcggagacatagataaagcaaattcgaaacattatcaaatattctggacttggggggcatgtgttaacaaccaaatttggtaatctgagtatcggagatggtgataaagtcgaagcggaatccgagatggagatcgttccgcaaacagagcaagaatcggctaaagtccgactagtctacgaccaggatcggcggagtctgagtttgacaaggttagccgattgagccgaatccgacaatatgacatagcatatgttgtcgggttgagttaatgtgcttcatgaggattgccatgcacgaatagagtcctgagaaggcaattgtatctattaattaggatatttcatgtaatttccttagagatatgtttgggcaagagtctgccgcaaagacttgtggtatcttagagtttgttagagataagagtcatgtccaacacggacatattttgttaatttcgggtataaatagaccccgagcctcatgtaatcaatctaacacacgttcaatacaatcttggagcatcgccatccttttactttcgttttgtttcgatgagttcttgcattcgggttgagctgcatcggtttcgatcttcaactagaggtaaaacttgttatggcggcttgcgttcttgggattagtgcttccatctttatgatactctaatcttgtttatgtaattcgtagagttatcatatattctgtataatcttcgacaatgtcgttatctaaccttcaatcggctaacatctatcattggaaggcagccgattaggttaaatatctatgttggcttagattgtataggatatccaccactctatgaaacatccaacggcttgattgtctagattttgttcttcttttcatacttatagctgcatcagttgagtttgaccttataagtcgtgattagaatttcaatctctagcctgcttttggttgtcgattagggtagtatcggggtttcagccgatcttacctaatttagccctattatctcatgcgcttaattgacatgctagatctaccctttatattaagatcttattacaacaaagtatattaggcttctgtttgatatattttacttgctttaatatcttaatatagagtggtatcggagtattagtcgatacgtgctagatctatctgataggcaatgctataaacatctataatcttgttgtgaatatatacttcgatctaagtgatttatattgtctcggcatggcgtccgatctatcccaatcacttgacttaagtatataccgacatagagataatatattgtcaatatctatagccgatcgagtagatttagtctcttcttacttgtttatatctaccgatcgattcaaacatgacatcggctcagagataaatgatgtcatcggtaactagccgatcggctatcctttatggatttaaccacggtttctttgtctttatttcttggtgattgcaggatcaaatcaactggcatgctcacgaacctaaaggaaagcatttggacctgcactggagttaagcaaatctctcaggcctcgggtttttacatcaacaaccacccataccgaccaagaaactagagcagccagctcagaagaagccgtggagggagaaaccaaagaggcccgctccatcacctccggagacgggtagaaaatccgcaaattgaactggatggaggtacaatcttgcacgtcggactttaaatgacgcgaccttcggcaacagaaaaattggtatgtatccgcatatttgctttcaacaatttgaatttttgcatcatcacatgtttgaatttcaaagttgcatttaggatttttgaattttgaggaaattcttcaattgaatttttttagagcaaaccaaaataaaaatttcaacgaaaattcgctatgccacgaccacattgactgttggaacccaacggccgaaagtggggccgactgggcccaccatgggtttggccgaaccggccaggcaatggttccctgccacttttggcagggtaacggctagtgcgtcccacatgtcatttctgaccattgtgggtaccctataaaagacagccggccgagagagggaattccaccccatttcaacacattttcattccctctccaaagtttgctctcaagttcattcaagctttgatagtttccctgaaattcaaaacacttagttgcatatatacaagttgctttggtgaaactaaccggcgggttaaattcttgtcattgctaactcctgccgagttagtccgatcttgctccattgtgcagaatgaggaggcgactgtctcgtctgttcaaggggtccggctcttcatcaagtcatcatgacgagtctagtactcattcatcagcagatgtcttgatggaagacgccgaagctccgcgacgacttctgaacgacaccgaactcaaccttgtcagtgatcgggagagacaagcctactacatgctgagcgaccgggagtatgctcacacgcgagaatactctccggagaatgctcacacgtgacaagtacacttcttggttttcacgattcctgtaaaatcgatctctagaaaggaatttctgggttcgagaaaaataggttttgggaagacatttttggtgctccaatttgcaagaaacctataacgaatgatatccataatcctacacttaggctcatgcacaaatgaattgctatgactatgtttcctagaggtgatctgaggcccattaggggagatgaattgattatgaattttgccatggttagaaagtataagttctctgctcctattgagtgcacttctctgattactcggatagcaaaagggctaggggtcgttagcgaccaaattgcttttatctcagccgctcgtccgtgtattgatgaggcttatctagtgcaagggcatattctgaaacatggagtagacagatctttgatttactttttccccggttgtacaaatgaaatcctattgccaaatgcggggtatcatttgtacaactgtcgtgaactaaccattcccctgcagaccatagaagaatctcgtacaggtggagcatacagggaaacgcgcaacatgacaagaaatgaacgagaaagttcatcatcctcaacacccgtgcagctgtatgaggcaggttgggagccaactggggacgcacccggatggacccaagctccacaccacaacatcgtagtctcaacccgggcgagtgccagtgaggatcggtggcgtgcgcctcatgacatccaatggggggacaaccaaccttccagatcaagtggtgtgcctccatctccaagtgaatggcgctcaagttcctctcattgggacttgggtgaaatcactaggagaatggacacccctgatattcagacgggagagatccagtacaacctcacggaacacatatttaaacgcaagaatggcaacaatctgctgatgcgcagttcaccaacctcaacaacatgatgcagcaatagcacgatgaccttcaagcgtacttccgttttcaggggttcaatccttatcaaggaccctgagcgaaagcctagcttgggggagagatgagatatctctccccccccccattgagataacttgtatcacattgcatatttcccttttcaattgcatatttgctttctaattgcatcttataaaaatgaagacaacataaaaatttgcaaaatagaaaataccaaaaagataggataggtttgagtcatgctaggtaagacaagctagttctctttgttgaaatgatgaatctctgttttatatctctgatatatgggtttttggtaagtgctctctcaaaggtcaaatataagtagccaacaattatctgtgaacctgaggtaaatgagctgcacctgctgatctaagtctaagttgttgcgagatatgtgatagtaaatatgagttgctatgatcctaatactagtttgacttgaattccggatgttttgtttttcaaaatgataaattgagagttcctcatttgaaataaattcctactagagctaaaaatgtgctatcatgattaaaccatataaactttggttacttgccattccattgaactctgtcaaactcatattttttgcaccatataccacacacattttttcgcacgatcttgatctggagtatgtttagttatctgctttagtctaagtttttgacttagtaataaatgtaaatgcaagtatgccatgtttgatccctatcgagctccacatatcaaaccttggagtaggaatcaaaaaggcaaattggtgaggaattcattttgatgcacttagagagactgagtgaatcatttgagaaacttggctttcttttacaaaatcatttgaaaacttctggaataagagttgaataaagattgggtgattggtgctctaattattgttctgtctttcaactgctcaaggcaaggaaaagcagtgtctcgtgggaatcaggggtaagggtaagccaccgtgccaaagattatttaagctaagagagagtacatataccttgcacctgtatctttgagatatgcagcatagtagcaactcctaatcaacaaccaagtccttgtttcctttcgtccttcagtcggggcgagcaaaggttcaagcttggggggttttgttgacggtcattatcgatcagtttcgaccgtcaatattaccaaaataaaagagaactagtgatgcttgcaatgcataaatatgttagaataataatattccactagtattaggtctactaaccttttgcagagaataacaataaagtggaggagaatcgacatcaactcagacgataaatcaatcggacgatgtcgagaaccagacttatgtatgaatgagccaagaactcagaattggcacgacaaactaggccaaaatttacaagtctgcggagaagaacaacagaggaggccgccagccataccatgggctggttgggccggctgttggtatttcttagcaacactactggaaatataattcccgacagtagcactagaaatattcctggtatattatggttacatatgtgatcctcaagcgcacggatataccattgtagcatttcactcgggagtattccaaggtatcggatttattttatcccaagggaagatatgataagagagtactatgctaatagtttatatattagttatatacatcaaagtctatgcaggggttaattcagttcaaagggtagggtgacacacagaagaaagaactaagaactactctttctaaaatatagtctaagctaagtggagaaagaataagaaaagtatcattcctgtacttctagtatacatacatctttagtctatacttgctagtatacagtcatgcaaccaataccccgtacccaatgtcctagtgtttcgagaagccacccctaactgccgagttccttacgacagcctgtcatgaccatacaattgttgctaaatatggaggaataccctccctagggaattaacttaggattatataccggcgcggaggaatacctgtactgagctgtcaccatcagcggcccacctctcatccgcaatatataaccccaattattggtatctaataatctaagcaccacgcttacattactaaatactactctacatccttgcaaccaacatagagcaaccgaataatcggacactaaacccacaccaatacacctatctggaaagctagttatgcgactatattgattcaagtataaagtaaagtcggtactcaagtaatatgaatggaataaaataccgaacttgtataaagaagaatattctattaattcattaagtcttacaaaagaagaaagcaaagctattaaagccatacccggaatctcctgaagactcgaggactatgaagactattctatttcctactccactagcactagaactactaaacaaaacttgtgtgtgggaatgaatgagaggaggggtatttatagccatgaggtgccttgggagtgtggagatgctccaagcatcctaggagcatctttgctctcctcttgacatgtggcatgatgaagcatcgaaagagcatatttcacctccttgtgccatgtgtccatgcttatgacggtttctaccggtagaattgctcccaaccgtcattgcatacctatagataactgccggtggaaaataggttggattgggccaactggtggttcggccgaaccctggccaggcccaatgagcccacaattcggcaggtggattcctcgtttgccccttaacttaggacaggaaattttgggcttatttgatcatgtcatatctgagttctcagcccatctatcgacaagtctgattctcgacagtgtcggtttgattgatcaattgttgtactgtcgattctcctccatttttatagcttatcctgcatggttagttttccaagcatatagtggaatagaatattttatttatgaaataatgcattgcaagcatagttagtcttcattaattgggtaatattgacggtcgaaactggtcaataacgactgtcaacaccggtcccaggttcggcagaatgtcatgcccggaaattcactagtaatttccggacttatttgtgcataaaaccctcgtccaggaatcagccgaggtacacaaactgacaatttaatatacaaatccgttataataataacgttacatacttgcaaaagaaaagaaaacagcagcggaattaacggtctagcgatggcttcagctccactcccacaggcagctcaactggggtataagccaaacgtcttatccttctagatcctttttcttcaactgaggttgattgattattgcaaagtgagtacatggaatactccgcaagccacacagcaaatatgcaagtgcacaaggataccaaaggatggcataatataggcttatttgcaaaagcagcatttagcaaacattaaatagtagtaaaacagtaaagtaattaatcatcaacactgcacagcacacccatgttgcacaggcccaaccatcctgaacaaccatacccggctgtacagatctaactccaaccaggatctaggcaaattattaccagttatagcattaataattattgtgagaggtgtgagactaatcacgaaaaacattgctcaacccgcccatgaccgcgggcacggctattcgaatagttttactctagccagaggtgtaccgttgtacccacaagacacagcctcaacatcatgtctaccatgcgtcacgatactggaaagtacccgaatagaggctgtgacaataccctctgcacaacacaactcaccacagtgcaccattcctggatcataatcaccccctctataaatataaccagaggcatggactccccagcgacccccacagacttctcgccgcttctcagtatggcaccccgtaatgaaccatgctatacaaaaggtaaagccgttgcccacgttggcttgtggttggcacggttaatgtctcacaacagtagctcgcgaaccagtccttaattgtcatgagcacgaccttcaaaaccatgtgctcacaacccaccattgacaagttttaattggcaaataattaattaaccaatcacgattggccatcgtcagctaccattaaatataatcataagtgatagtgtaacattagttatcgcaatcatgtgctattgtttctaagcatggctaagaagttatatatataaagcatttagctaaaccaaaccaatatataaagttcaagctaatcaattgattacccaaggtatcaaggaataaggtaatcaatgcaaattggccataacaaaggaataggttcacaccacccggtgacattcgaatataaatgcacagttgaaataaatagagaatttaaatataggatcaacatgctcaaaggattgtgtttgggatctgtgtgacttgccctgcaataatcagtcttcaattattcttctgaatcacttccaacgcagtcacgaaccttcgcaacaatggaaactacaagctaacacgcaaaacgaaaaaaaaagactaataaaaaccaaataaatagtacataaaagtaaacaaacatgtagatcatgattttagatgaattatgagacttgaacggcctcattctgatttcatatgaattagttatgaattttacaagattaattccaattaaacctattaaagaaaagactattccaaattaattaaacaatttacaaataatttatatctgagatataagactaaagcatccgccgaaattattggaatgaatttagtatacgacatatagtaaaaagaactaatataccattgaaaaggaataacaggatttatattgattttggacggctgagatcaactttgacctagttgaccaaaattggatggctcggattgatctgatctaaggttttagatggctgccatgtgggatctgagagacggcgtgacacttagatggcagggacgacagctgacaaggcaatgacatggcaaccacgcgggatcaacgccggcggctctgaatggctctaaactaaaggacaactcaacacggacgaacgaatgaagcacgggggacacctcgttcgaacgaacgagcgaacgactcaacaacgggtgcggctaaaccggtgagctcgacacgattcatagtaaagccccggtacggcaaacaataggccggtaggaacctaggattacacgaatccgacacggcacagcaacgacggcaaatggtggctgcggtagtgggacgacaatgacttggcactcacgagcagcagcagcacggctgtagcatggagcggcacaacgacggctaggcggctagcgcagcagtgatgctagggcagcagctaagcatggcacggcggcggctactcaatgacacaaacgagagattaaaacctaaaccgagggaacatagatagaagcctcaccgaaccaaagcgattgaagagggagagacgacgacaccgatacggcagcaacacacggagacgacgacgatgctagacaaacaacggattaggttagattggattaagaccctagggaaaaacctacaccggtgaatggcaggacgacagcagaaaccgatagcacgggaaggaagaggaggacgcgatgatccttaccaacacttacgcagtgatgaacaacaaaggagatggccggcgacgagatcgggagtggcgacggggtactgatcaacgacggcgacggctttccggcgatctttggtgaagaagaggtggtggacggtgttctccttacagctgcgaatccaatgaaggctacggcgaccgaaggcgatgacggacgacgacgaacggcacggctagagatcaaaccaaggcaacaaccaacgggttcacggtgacggcaaccttccggcgggatttggcgcaaaagaactggcggccatggtagagatcaaccttgcggagcggagggaggtggcgtcactgatcgagaacggccggcgtgacgggaaaaggcggctgaagatggcggccggagttggagagagaaaacggcgccggatcgggaagaacaggggctctggacggctggctggaggttgaagatgccactgtagcgagagggagaataacaaacttccggctgggcttcttcttccaaggcctgattgaaagagggacaaatagcagacttcgacaaagagagggagaggggctgcaggcccagagagagattgggcagagaaagagagaggacttttcctgtttcggcccgaaatgaaaaagaggatttaattacttttccaattaaattaatcactgaaatgatccttgaattgttaacaatacttctattgctcaaataatatcaagaaaaatcctgaaagtacttgaacactataaatatttaacaaaattataagtagaccatttattgattaatttaatatgtgaataattactgaaatgttgtttgtattattaaaattacaaattgagctccgaaaaatcaaagaaaattccagagggtataattaactatggcgaatttaataaaaattaaatccagccatactttatatttaggaaatttgatttcccacatttaacttcacttgtaaattaataaatatttaatataaattctaaaaataatttattaaatcctaaagcgaaaatcaggatgtgacaccgagcctccctcgcctccgttggatccatgtcttggctggatggttgagatgaagccccaatgacggttggagggtattaccgaccattccaacggtcacaaccatcatagttcagctataaaaggagttcctcttctcacttcactcacacacctcaagcaatagctctctcatttctctcaagtttagtttagtagtatctagctgatggaataggaataaagtagaaatcaggaatccggaagccttcggaagagatcgggtatgtctctggtagcttttctcttctcttttgtaagccttgtacttttattagaatactcttctaaatacatttatgtattgaaatactttccgattataggagtacatactttacattatattcatgttatactgaatatacggctagcttatctggaagatgctttggtgtgggtatagtgtttgcttatgcaattactctatgtcatgatgatgatattagagtagtatctggtagtttagacgtggtgtctagattacgggaaatcattatttggggttatatattgtggatgagaggtgggccgcttatagtgacagctcagtaagggtattcctccgcgccggtatataatcctaagttaatcccctagggagggtattcctccatatatagccccggttgtacggtcatgatgggttgtcataaggaactcgacagtcaggggtggcttcttgaagtaccaggagggcatcggatagagggtattatctagtatatcggttaactagaatgtatgtatactatgtatattagaagtataggaatagattatctttctcatttctatccacttagcttagataatatattatgagaataagtagttaatgcatgtgtgtcactctacccttagattatcttaacccctgctcagaatatgattatcacaagcaatatataaattattagtcaagttctctctacatgatcttcccacgggacaaaataaatacgatacccttggaatactctcgggtgaaatgctacaatggtatatccgtgggcttgtggattaactctgtaaccataatataccagaagtatttatgcgccattgttgggaattatatttctagtaacgtcgttaattaagaccaatagcaggaaccctagattttgagtacctccaaaaccacttgacaaaaacttctgcaaaactggacgggatgcaatgttcaagtaatgtcgatgattagattcgatttttcatggtcccgacaacaaccgacgagatgcaaaactggatccaaaactgacgtacaactcacagacttgagtgatgaaccctagacctaagggcctgttcactttgatgccaaaaaaaaccttaccaaaatttggcattgccaaaattttggcatagttggcaacttaccaaaattttggcaggatttcttatatagttaaaaaatttggcagcaaactaaatgtagccacttttttggcaactgtaccaaaatttggtaaggttgaaaatgacaccaaagtgaacaggccctaagtgacgaacagatgcaatactcaaaactaaaaaactaaatctaaaactaaaccagcactcgacatgacgatgcaatctagaattcaacaatgcaaaatctaatagaacaatgcaactgctcaaattgtctaggtaaagaataaatatttttgtatggcaattttcttgttatgggaagataaattacctaacgagcaactgcgctctgatacaaaccgatgagggatgttaggggatacaaactgatgagggatgttagggtcccgaccttccgataggtattgataaacagtcgatttgggcggagtcacaacacaactcgatccggcttctgaacaaacacgctactgagccccgcaatcgcagcaccatgtctcctctggttaccaaccgtgccgaaacccggttgacctcgccgagaaggctaatccctgcatgcgaatcaaagaacacaagcaagaacaagatagattgcaacacaattgcatatgaatgattaagcacttaaatttggggttttgtgtgttttcgtttgcagaggtacctgcttgggtgaaataaaagagactgagcgaaaggaatgcatggatgattaaagaagttgattggggaccaaaccaagaccttctccaagtccacttccatatcaccacgtcacttttggtccatagaagacaagagataaagttctacacgttttggattcggattcaggcctcctgacttcaaacggaccttgccgctgatctagaagcaatttcagggcccatgagtacttgttggaaagattattgagtctactttcagatggttttggtccgacattaaaattcctaccgagctgccggaattttcaaaacaagtcccgtatctcatcatgtccgaatctgatttgggttttgcgccttgtaattgaatcgtgggcttagcccaagggggtgtgcgtcctagggcaaccataggacgtccctaatcatacttaatcagtagccgtcatcatttagagtcgagttttgcttagattattttgttaagaacaatttcgccgctagatcggtttgtagaaccccatattcgagtgcttaatcattcatatgcaattgtgttttaatctatcttattcttgcttgtgttcttcgattcgtatgcatggattagccttctaggtgaggtcaactgggtttcggcacggttgataaacagagaggatgtggtgctgcgattgcggggctaagtagtgtgttcgttcagaagccggattgagttgtgtcgcgaatccgcccaaatcgactgtttatcaatacctatcagaggatcgggacctaacttctattgatgatcgttatcgaccagttttgaccgtcaatattacccaattaataaagactaactatgcttgcaatgcattattccataaataaaatattctattccactatatgcttggaaaactaaccatgtaggagaagctatcaaaatggaggagaatcgatagtaaaacaatcgatcaatcaaacagacattgtcaagtatcagacttgtggatagatgggctgagaactcaaatatgacatgatcaaataagcccaaaattccctgttctgacttaaggggcaaacgaggaattcacctaccgaattgtgggctgattgggtatggccagggttcggncnaannnncnnnnnnnnncccacccacccaaaccctaaacccaacccaaaanccacccttcaccatcaacccaaatcctatcactctttataacaatttttctcttacaaacctttctaatcattctcacatcgctacataccttcaaagaaactattttgatactcaaatttctacctttcctaaagagaactaaattgctcctttgattcanaataacatccagtcaatttgttttatagtccatcactgtttacgagattccggcaatgttttaatagcatcttttttttttttgtaagccttctgggttaatagtataacctaatttaaacaaacgccgggtatatatgccattaatattactcgagtgccaactttactttaagattggaataaaaataacgtttgtacacaggcaaaaaatttctctattcatcaaggcgtagacttttaatttcattacagattaacttgagggggccatttttcttttaaaattggaacaactattgtcggtgacactagcatttaaccaac

SEQ ID NO: 67155 - DNA, 10913 bp, Oryza sativa
ataaaaggccttaaaacctcattcattaagcgcatgaaagtactaggtgcattagtcaaaccaaaaggcattactaaccactcatacaaaccaaatttagttttgaaagctgttttccattcatctccaagtttcattctaatttggtggtagccactacgcaagtcaatctttgtgaaaattatagaaccacacaactcatcaagcatgtcgtctaacctaggaataggatgacaatatcggatagtaatattattaatggctctacaatcaacacacattcgccaagaaccatctttcttaggaaccaaaattacaggaactacacaaggactaaggctttgacgtacatacccgctgtccaaaagatcttgaacttgccgctgaatttccttagtctcctctaggttagttcgataagcagcacggtttggcaatgatgctcctggaatcaaatcaatttgatgctctatccctctcataggtggcaatcccggggatatctcagctggaaagacatcctcatactcctgcaaaaggttagtaacaacaggaggtatcgaacgagcaatatcatctagagaaaccaaggcttatttgcatatcaagaaatagcacatatcattatctgaaattacagcaatgtcacatttcgtagcaagcataacaccacccttcaacttaattccctcaaccttagaactaggtgaaagcttatcctttttgggtggaaaaacagatttagccacttgctgattttcagactcatcaagtttcaaactagcagctcgctctttatcagcttctacaatttcagcaggggtaaaaggtagcaaagtaattttcttttcattatgcacaaaagtgtatttattactcctatcatggtgtgtagcatcattatcatgttcccaaggacgacccagcaaaagtaaacaagcttgcataggaaccacatcacaatcaacagaatctgcatatgagccaatggaaaatgaaaccctacaaacctgtgttacctttgctcttccggaatcgtttaaccactgaatatggtaaggatgtggatgtgtacgtgttgtcaagccaagcttagtgaccaaatcagaactcaccaaattattgcagctacctgcatcaatgatcacacgtgcacgatggttgttgatgacaaagaaaatctgaaacaaattatggcgttgcaacctctcaggctactgtacctgcgtgctgagcacccgctgcacaatgatggtcctgtaatccgatgtgtcatcatgaccaaagacttcgccatcctcatcctcaacttcttcttcctcctcttcctctttcacgtcggaggtggtgatgtagccatcttctgtagcaacataggcccgttgactagggcaatctttttctgcacatgcccaaacccttggcaatggtggcactgaatgcgtcccgtcgaggcgatagatgaggaactcttggcaggtatctgcgaagaacctttacctgactctgcttggtggagatggttttggtgccgtagaagctccagatgcagctggtcgcttgctcgctggctgggaatgcacccgaaaagagacagccttgggcagtcccgcagatggcgtcgtgcgcggagtgtatgtacttgccttgttcttgccctgatggtcacgcccctgcaattccttctctgcaagcatagcaaaccgaaacaactggttgacagagttaaattctttataatcaacaatattctgaatttcctccctcaaacaagagtaaaaacaacaaatagcatcctcgaccccctccactatgccacagcgtctcacacccttttgtagctcaccatagtaatcctgtacagatttatccccttgttccaaacgcatcagtttcttgcgcaaatctctatgataagatggaggaacaaacctatcgcgcatagctaccttaagttcttcccaagtagtaggtagtaccccctcatcagacaacccagcccaccacatgatagcaaaatccttgaactcactactggcttgtctaactctatgttgctcaggtataagttgggcattaaactttgttctactgccatctcccaatcaaggtatttctcagcatcataatatcccgaaaaagatggtattttaaacataaccatagcataaggataatcgggcacacgattattattaccttgttggtggcgagtgccacccatacctgtgcggtttgtgcgtaggtgacgtcgtagctgtgcttgccttgtagctggtgtgtcaatatagccactggaatcatacaccgtatcttccggatgagcatcgtcgtcaccactcaccacttcctcattggaaggtgtctccaacgcggcaacccgatcagttagcgtggatatccgtttgtccaacctctccatgtggttcaggaagctgagtttagtgaaggcatcttgcacagactttccaacggcctccgtgatgtcctttttcttggagagttcatagttgctcttagctgacatagtcagcaaaatcctggggactcttctcaccttcgttacctgccattgaaacaccaaaacagaaacaaacggtgaaggttatccctaataatctactacgcaggtgtagtggtgcctctcaacgattctcagcaatatggagtacctaaccaagctcttataaggttcttagtagcaaagcaaaggatacctggaaggcgtagtcagcgatgcagggatcaagaacctgtgctgtccagaagtaaatatgtggagctaggaaggccaaatatatgtatatgagtggtacacaatccaatgacagatagtaatgctgaataaaaatcccaagtcacttgcccttagttgctggtctactcgtgtattagacagtagtggtaacaataatggttcaaggaaaatgacactagtaaatagcaaagaaggacttgcaggcaagcttcggcgagttttagcaaaaacaacaaaaccgaactggcagataagctcaacggagcacgtcgtgagcttaatgcagtagtggaaatcaacttttctttttttttcttttatttttttgatatttttttctttttccagaacacgaaaataggcacacctctaagttacagctcaatcggagttgatatgtggcctatggaattttctgaaaccactataaacaaggtgcaggaacttgtgggctcgaacagacaattttgcaagccaaattttagaatttttttctcttatctgaaaagttaaaatttgcctgattccgagtccgtatgcaaaagttatggctgtttgaagttttggcttctggctaagttttccaaaggggatataacctagcctattttgcggtggaattgggatatggtggcagcggagtttgtaggatgttgtggtgatgcgtggtgatctggaattgggtgtttatgatggcggaaatggctctcaaaggatagggttataaaggaaaaaacacacgactagactaaaacacgcactagaccagcaataggaacttaaactaggactcaaactcaacactacggactctgaaaaagaatcatgcaaaggctaaacacggtctaggttaaggttactaacgactaaattttttttggcttttctgtagactctaggataattacgaaaaacaaaaactaatctagggcaaagaaactgagcgaacctgacggtgaacctagagctctgataccacttgatgtgcactagggttcccgatcttccgaaatgttttgataaacaacgatttgggcggagtcgcgacacaaatcgatctgtcttcttgaacgcgcacgctcttgagccccgcaatcgcagcaccacgtctcctctggttatcacccgtgtcgaaacgcggatgacctcgccgagaaggctaatccctgtttgccaatcgaagaacacaaagaagaacgagatagaaaacaaccaaaattgcagatgaatgattaagctcacgagttgtggtcttacaaaccgatctagcggggaaactgttctcgacagattaatctaagcaaaacccaaagacctaaagatggcggcggtacttatatatagagtttagggtcttgcaacccgctctcgacgcaacgctaatgagttccaacgcgatacacggcccaaaagtccaaatacggtgacgcaacaccgggacagattctggacatcaacttgttcggtcgattcctattgactcggaaagaatttggatgtgggaccagaaccattggaaaggttatctttttagctttccatccatataaagaacgtgtagcgcccgttccgtcgtggcgcctagcgggaaaactatctcttaaaaaccctaattgcgaaatctgtttccttgcttgttgtctatccccgatctatcgtcaaagttcaatcccgaatctaaatccttcccaaatcaaatccctccgcagaagtctattttgcctccctcaggttcgatgggccgaattcctctcggcccatctcccccctccccatctccccctctctctctctctctctttctcccgctctgcccatgagccgcgccgagccctccctctccgctctcgctgccgttcccaccgatgccacccaaatcgccgcgccggccgcgcgcgcgcgcgccgtggtggccgaccggccactcgccgctgccgtccgcgcctgccgcgcctgccgcgcctcccgtgcctgccacccgtgtcgtcgctccactccaaaccgcccccgccgtcatcgccgtcgtcatcgacccggcctccgccactccgcgcgctagcctccaagggacggaggcagagctcctcctccctctgccgcgtcgcccccgttccctccttcttttcccaaagtggcaatgggcaagccccctttcttccttccttttccctttttctcttccttcgctggcgtcattcccctcctccctgtggacgatttggccactagccggagcgcccgatcactggcttgaccgtccaatgtcggttcccctctcccaaaccgactttgtcgcccatataaacccaagctcccccctttcctttcctctaccattcgccctcgctccaccgcgccattgccgtcccctctgtcccgcccccgccgtcaccgccgccgtcacgtgtgccgaagcagccggtgtgcgttaggacgcggaaggggacttcgggcgcgccctcttcttcctctacctcggcccgaggccggagtgatcactcccgtgccgtcagcctctcgtcacagcgccccacctcgtctcagtagtgcctccctccgttctccatcctcgttccatctcctccccttagactcgggtagtagcacgagtagcctcctcgtagctagctagcgccgccccgaccattgcagccgctcgctgtgtgctcgccaccgtcgccgcccgtgctccgtagcgcccgctcgtcgctggcctcgctcggcgtagctccgcccaatccgacgctagcaacggattcccggagtcgcgtagatgctctagctcgcccgaatcggtctcccgtcacaccttcgccgtttcccccttctcccaccgccggttgcccccgccgcaatccgccgccgtcgagcatcctccggcgaatccgagccgttggctcgtctcccctcgtcccgagcaacttcccggtgtgctcgctttcgactgtatcgccgtggttcgctacgccgcctgccaccgtcgtccgccgtccgttccggccgacgtcgtcatctacctcccgccggcccgcgtggcagccacgtaagcgccacgtcggcgccacctcggccgcgtccgagtcaagctgaccccggtccgccgctttccctccgccccactcgcgcgcgcggtccaccacgagccgtgaggctgcgcgtgggcccgccgcaccgcgtcctccgtgaaccgcgcgcatgcgccgcgcctccctccccaaaccctagcacaccctgcgtgcacctcgctcacggtgagccaagtcgccgacaagcgagtcccacccgggaccacgcgggatggacccggcccaccggctctctctctctcctccccgcccgcgcgcatgttttgggccgccttctcgggccggccggcccgttaagttcggccgagccgcccctttctctcgggccgcgccctagccgcctaaggaaagtctaatttccctccctccttcttttcttttcttttctttttcaaaaaggatttaaataaatccttttcctttagaccaaaaatccaataatcttagaaattcaatatcttcccaaccgtaagtccgtttgactctgttcaacttccaaaattcctcaaatctcgagatctatataatggcacgcttagaggtcaataatagggctttatttttgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattaataggattgcacttaatctgcttgtcccgtctgcaaggcagattggcggacctacctaacttgttgcatttgacccttccatcgaaattcttataccatgttcccttgtaaccacctagttacgcctcggcaatcgtgcactctgcacgagtaacgacggtcgccttcaaacttaaaatctgagaaacatcttgggtaaaacatgggttttataaaagacttggaaaacctgacaccagggtcggtgcttgcgaacctaaatgaatttccaaaatcgcggaccggggaacgtaccgggtgtacggtttcccgctcttgcacttaaggaccgtttccttggaatttcatccgaacataagacaagtacgaccacatgggtggaatgggacacccctggctaagtaactagctaatcgggggagccatgatgccaagagacatgtggattcaacggggtggtgtcggggaggacccccgggtttcttggcacagtatggtctgggacctcatctagtgttggtctgggacccctctcgttggcatatggtgaacctgtgtcggctttccaaatgccttgtcatgaaagccttaaggtctctagtcgtggccgttctgcacgggctggatgatctgggttagtaatgtcgtgtgggtaaagtgtaccccctctgcagaggttattaaactgttcgaacagccgtgcccacggtcatgggcggatgtgaggtgattcctagcgtagttttgtttgactactgctttgtgaaatttgctgatgtggtttgggattgatgtttggaaaatctgcggctgatgggatcatccaggcccaggtggccgtttaaaagccgttggccgggtgccaaccttgatcaattcaaaagactgataccttgcacatacttcgaccagacgagacgcactgtctcatctgtatcgtttgagaagcactcacttagttgtttcagaaaagagtttaaataaaatcaattgcaaaaacaacagcctttccttgaagcctgcattaaacacttatttcccatggcttgctgagtactcccgtactcacccttgctgtatataaataatcccccccagttgttgaagaagatgaagcggatcccgctgacgaggagttcttccaggagcaagccggctacgatgagttttagggttttcggcctagttcccaagtcgcgcctgtgatgtttggtccaagtcttggcttccgctttccttttgtaatgcagttgtgagctcgggatctgtccgcagcccaacatgactgggctcctactctataataaagagacctctgttgctgtgatattctgtcttcctgtgatactagcactgtttcctgggactggtatcgattaacaggttaatttggagcgtcacgggctagttctgctcgggactagtccggggcgtggcaagagatggtatcagagcacaggcttggccctagggcgaaacccgacgtttaggacgaccctaaggatgctaagttcaaaactacttgcgaaaagctaaggctccttttggtttctttattttcaatagtttgttgctaaaatggttattgatcttttctccctctttcaaaattgtagatggcagtgaacgccagcttcagttcccacggttttggcgagggtcaccacgtcgctcagcttcgtgacctcgcccgcttccttggcttctcgtgtcccgagtacacggggtactccgtggaccgtgttccccctcgctgtgagctctgtgtacctttaccctcgtggaggtatacacggagctggcctttgcccacaccacttcactgtggccaggcccactctccagatcgcgtaccaggacctctcctggactgcgcttcgacgcttggcccatgactacagccaccgtctcgggggctctgccttctggcagctcccacgccttccttctggccacgcagacgccaggtacccttgtccgtacagcgagtctcagccagtgctgactcgcatggtggagctttcggaggcttaggccactcagcacgacctactcctcgaggcttaccgctcccttgcccgccgctacgccgctctggaggcccgtctggccgaggagggtgtcacctcagttgacactgtctcttgggactcaggccgcctctgccacgccagccacctgtcctcccacagctctcgcggctcttcctgcactcccagtggcccgcgctcccccagctcgcgtgcgccgtactcaccagtgtactccccctacccacacccagttagcccctcctacacccccggacacaccccagttgcttcctcccgccgtggcccacgctttatccgcactgtgcggaagcatgttgttggttcttccaccgtgttccgcttcgactacccagctcccccaccgccagcggcccgtactgctgccggccctcgacaggttccgccggtcccttcgcgctagccgatcgacgtttcttcgactgaggagccgactacaagaggcagccaggcagacgaggagtagaggaggcagtcttcagcagctgtccgtgtgttaggcccttttgttccgccgccaactcttttggagtcatggcgagatagtgcgtgcgtgtgtttgatgtgggtgttgtttggtagtctggttctcgtaggtggtgtgcgtacagtcaagctcggcgtagctctgtgacttgtccacacccgttgtatcaggtgtttttatgatttgaaaaatccagtttatgcctagtgcgtgctatctgagttgttatttactttgctccttgccctcctaagtgcttatctgattcttacctcgccctcttcggtttagatggctagccgcccccgccgtgctgctcatgcatcagcctgcttcggttttgaggaaggtagagttgagccagaagcaaatcatgagtcagctaatgagcaatctcaccacagcaaccgttcgcaccgtactgcttcccgcaatgcagaagttgagcaaccccgccgcagcaaccgctcgcatcacacagcttcccgtatagcagagatggaacagtctcaccaatctcaccgcgctgctagtcacaattctggagaagaacgcatcccttccccacctcatgtggaaaacaacatgcaacacctgatggcagttcagacacagatcttgcaaggattagccgcggctatagccggctttcagcataatgcgcatggaaatggccaccctcacatgagcaacaatagatccaaactgaccgacttcctgaggtctcggccgccagagttctctcagaccgtcgagcccgttgaggctgacgattggctgaaggatgttgatagaaaactcaacttagtgcagtgtactcctgttgagaagacgctctacgcctctcaccagctaagaggacctgctgcagattggtgggagaattactgcaatgcacaccctgaactcactaacattgcttgggatgagtttgctatggctttccgtgcagctcatgtgcccgaaagcaccattgatatgaagaaagaggaatttaacaggcttaagcaaggcaacaacagtatcaatgagtacctaagtcagttcaacaagttggctcggtatgcccctaaggaagtggacacagacaataagaagatcaggaagttcttgaagggaatcgcagttggaatgagactccagttgcttgctcatgacttccccacttttcaacatatgatcaacaaggcacttctacttgaggatgccagaaaagagtctgccgaagaatataagaaacgcaagtctaaccatcaggggaattcttcccgaggcgcacctcgccctcgctatggtcaacccatgcaataccactagtcggtcactcaagctaaccgccagccaggctacgcccctcgtcctcagatgaaccgctcggcacctcagccacagcagcatgccccaagtggcaatactgcgcccaacagggttacctctttcaagtcaccgctaggactgtcagcagttcagtgtttccggtgtaaccagatgggtcactatgctagatagtgccatcagaatcctaccaacaccaactcagggcatgctaatggcagcactgccagaactcctactccagcagcagctctgtctcgtcctaactctcaggcaagaggacaaggttctcgtgcctccaacaactttggtcgaggccggatgaaccacattcaagctgagaccgctcaggatgttccagacgttgtgatgggtatgttctctgtcaactccgtacccgcaatagttctgtttgattcaggagcttcccattctttcatatca

SEQ ID NO: 67156 - DNA, 21374 bp, Oryza sativa
acatctacaagatacgattggtggcgaaaagttacagacaaattcaaggtgttgattatgatgaaactttctcgccagtcgccatgctaaaatctattcagattgttttagcgattgctgtctatttcgattatgagatatggaaaatggatgtcaaaacagctttcctcaatgcaaatctcgatgaggatgtgtacatgacacaacccaagggttttgttgatccacaattagttaaaaagatatgcaaattgcagaaatccatttatgggttgaagcaagcaatctcggagttggaatattcgttttgacgaagtagtcaaggcgttgggctttgtcaaaaacgaagaagagccttgtgtatacaagaagattagtgggagcgcactggtgtttctaatactatatgtagatgacatattattgattgggaacgatattcctatgcttgaattcgttaagacatcgttgaaaaatagtttttaatgaaggacttaggggaagcagcatatattctaggcataagaatctatagagatagatcaaagaggctaattggattaaggcagagtacatacattgacaaggtgttgaagaggttcaacatgcaagattctaagaaaggtttcttaccgatgtcacatgacattaatcttggcaagaatcagtgttctcaaacgactgatgagcgaaacaagatgagtgtgattccatatgcctcggcaatcggatccatcatgtatgctatgctatgtacacgtccagatgtttcatacgcacttagtgcaacaagccgataccaatcagatccaggtgagactcactggatagctgtaaagaatatccttaagtacttgataagaactaaggatatgttcctagtctatggaggacaggaagagctcgttgtaaatgattacaccgacgcaagctttcaaaccgacaaagatgattttagatcgcagtctggatttgtgttctgcctgaatggaggcgctgtgagttggaagagttccaagcaagatacattggctaattctacaacaaaaaccgaatacattgccgcttctgaagcagcaaaggaggctgtttggataaaaaaattcgtttctcaactaggtgtgatgactagtacttctagccctatggacctctattgcgataatagtggtgccattgcacaagccaaggagcctagatcgcatcaaaagtccacacattttatggcggtatcacctcattcacgagatagtgagtagaggatatgtgaagatatgcaaaatacatacggatttgaatgttgcagatccgttgacaaaggcactccctcagcctaagcatgaggcacacactagggcaataggtataagatacattcatgattgactctagtgcaagtgggagactgttagtgatatgccctagaggcaatcatagagataattgtatcacatactatgtttaaatatttatccgacattgttccttgaaatagataactccttattggttaatgaatatgtgattctttcatcagactctttatttgtttgttactatttctaaaggatccctgatcaaatatcatatgtagaacaaatatgtttatatgatcagaacatgtattaattgatgatcatgtctcatggatcatggtatagagatactaaattaataatctggacacatgttggtgaacatgttgttcgatagacccaacatgagacactgcaagagctatatgtgttgtgtcatcagtgatcttatttagtgttggtgttgaatccttagacttgagattatcatggttctcaacatgtgtagtagcttacttacggactactaaactctactatgtaaatgggtagctataaaagtagttttcgggtatgctatgaaacatgtagtgggatataaataaccaagatgggatttccccctcctatggagagatatctctgggcccctggatgttgtagattatggaagtgcatgaccatgccaaaggtgattgaggagtcaatcacaagttatataatctatcaacaggttcgagtgaatgattgagctattagaggatggcacatatctagccttgagcttagtcgatatcgtgaggcaccgggttcatacaagtatacagtagaggtttagccgatatgatctttatgtatgcgtagtgggtcaatacgttctgctaggggccgctgttgatgcgtggaccgaaaaggagttttcgggttacagccgagtatatatgaacctacagggtcgcacgcttaatgggcctgaataaggggattggatagagatccaatatgagcttaatttggatagggatccgaatcggagtcctacgggccttggagggctcgagtgatggatcctatatatttgtgaggggtgtgaccggcggaggcattgcatcacgtgagaaaccctagtcgtcactcccctccccgagcaaaaccctagccgcgcgcgggtgctagcacatctgcgcgtggcgttccatccctatacgtgtggataccggtaaaggcgccgctagtttgcggtgctgatcggtgtgggagtacggcaaggagaacacacgaggaggagaaggtcgagtcggtgcgatcgactacttcctctacatcgacgcgcgctacttcgcgagagttccttcgacttctcagcgtcttcttccgctgcacagcgcgtcgagtggtaactatctatgatctaatacttgcatggttcctggtttacgcgatagaaaattttgatttatcctatcgtagccttcgcgtatcccaacaatataatcattagatagcaatctattcttgaattcatacaaaaaagaacataggaatgagctcacctctaaatttaattgtcgcacacgagctcttgttatcggtccttaaatgaccattggaggattgttgtgtgtaaccgaggtagtgatgtctgcatcatcctccccctcttgaattgaagtcgtcctcaactcaagctcatcctcttctcccaagtatggcttcaaatctgaaatgtaaacgtgggactaaccctaaagtcgggaagcaactcaagtttatatgtattatcattaatcttctcaacaattttaaaaggaccatcagcacgaggcatcaacttagactttctcaattctggaaatctatcctttctcaagtgcaaccaaactaaatcacccggttcaagcttaacctcttgcctacctttactaccagcaattctatacttttcagtcatcttttcaatgttgaggttagttgactcatgcattttcagaataaattcagcgtgtgccttaggatcattatgaaccctctcactagtaggtaaaggcaaaatatcaattcgagcacgagggttgaaaccatacactatctgaaaaggacttaccttggtagtagaatgtgttgcccgattgtatgcaaactccacatgaggcaaacattcttctcacatcttcaaatttttcttcaaaatagccctcaatatggtacccaaagtttggttgactacctctgtttgtccatctgtttgtgggtgacatgatgtagaaaacaatagctttgtacccaagttgttccatagcgtgcgccaaaaatgacttaagagttttgcatctcgatctataacaatagtagaaggcataccatgcaagcgaacaatctcatggaaaaacatatcagcaatatgaacagcatcatcacttttatgacatggtatgaaatgtgccatcttagaaaaacgatccaccacaacaaaaatgctatccctccccctcttagttctgggcaatcccgaaacaaagtccatagaaatatctgcccaagaaatagaaggtacaggaagaggcatatacaaaccatgtggattcaaatgagacttagctttctgacaagtggtgcaacgtgctacgaacctctcaacatcttttctcatccttggccaaaagaaatgcatggccaaaacatcttccgtcttcttagctccaaaatgtcccatcaagcctcctccatgcgcttcctgtattatcaaaagacgaacggaaccaactggaatgcatagacggttagctctataaacaaatccaccattgatcacaatttttttccaagtacgtccctctttgcaatttaacatcacttcattaaaatcaggatcaagcgcatattgttctttaattgattcaagtacaaaaatccgacaatcaagttgggacaagaaagtatagcgcctagacaaaacatctgcaatcacattatctttccctttcttgcgtttgataacataaggaaaagattcaataaattcaacccatttagcatgtctacgattcaaattattttgagaccgaagatatttaagcgattcgtgatcggactgaataacaaattctttatgccacaaataatgacgccacgtctctaaagaacgtacaagagcatacaattccttatcatacgtggaataattcaaaacaggaccatgcaacttctcgctaaagtatgcaacaggcttaccatcttgcatcaacacacctccaatgccaactccactagcatcacattctaactcaaaagtcttaccaaagtttggaagttgtagcaatggtgcgtgtgtaagcttgttcttcaaagtgtcaaacgacttcccctgtgtctttccccaatggaagaccacccctttcttcatcaactcatgcaatggtgcagcaaaggtactaaaatctttgacgaaacggcgatagaatcctgcaagaccaaaaaaactcctcaactatgtgatggtttggggaaccggccaactctttatggcttcaattttcgtctcatccacctcaattccctttggagtaacaacatatccaagaaaagaaactcgttccgtgcaaaagatgcacttttcaaggttagcaaacaaacgtgcatcacgtagggcattaaaaacagcacataaatgatccatgtgttcatcaaaagacttgttgtaaatcaatatgtcatcaaagtaaactaccacaaatcgtccaataaaaggccttaaaacctcattcattaagcgcatgaaagtactaggtgcattagtcaaaccaaaaggcattactaaccactcatacaaaccaaatttagttttgaaagctgttttccattcatctccaagtttcattctaatttggtggtagccactacgcaagtcaatctttgtgaaaattatagaaccacacaactcatcaagcatgtcgtctaacctaggaataggatgacaatatcggatagtaatattattaatggctctacaatcaacacacattcgccaagaaccatctttcttaggaaccaaaattacaggaactacacaaggactaaggctttgacgtacatacccgctgtccaaaagatcttgaacttgccgctgaatttccttagtctcctctaggttagttcgataagcagcacggtttggcaatgatgctcctggaatcaaatcaatttgatgctctatccctctcataggtggcaatcccggggatatctcagctggaaagacatcctcatactcctgcaaaaggttagtaacaacaggaggtatcgaacgagcaatatcatctagagaaaccaaggcttatttgcatatcaagaaatagcacatatcattatctgaaattacagcaatgtcacatttcgtagcaagcataacaccacccttcaacttaattccctcaaccttagaactaggtgaaagcttatcctttttgggtggaaaaacagatttagccacttgctgattttcagactcatcaagtttcaaactagcagctcgctctttatcagcttctacaatttcagcaggggtaaaaggtagaaaagtaattttcttttcattatgcacaaaagtgtatttattactcctatcatggtgtgtagcatcattatcatgttcccaaggacgacccagcaaaagtaaacaagcttgcataggaaccacatcacaatcaacagaatctgcatatgagccaatggaaaatgaaaccctacaaacctgtgttacctttgctcttccggaatcgtttaaccactgaatatggtaaggatgtggatgtgtacgtgttgtcaagccaagcttagtgaccaaatcagaactcaccaaattattgcagctacctgcatcaatgatcacacgtgcacgatggttgttgatgacaaagaaaatctgaaacaaattatggcgttgcaacctctcaggctactgtacctgcgtgctgagcacccgctgcacaatgatggtcctgtaatccgatgtgtcatcatgaccaaagacttcgccatcctcatcctcaacttcttcttcctcctcttcctctttcacgtcggaggtggtgatgtagccatcttctgtagcaacataggcccgttgactagggcaatctttttctgcacatgcccaaacccttggcaatggtggcactgaatgcgtcccgtcgaggcgatagatgaggaactcttggcaggtatctgcgaagaacctttacctgactctgcttggtggagatggttttggtgccgtagaagctccagatgcagctggtcgcttgctcgctggctgggaatgcacccgaaaagagacagccttgggcagtcccgcagatggcgtcgtgcgcggagtgtatgtacttgccttgttcttgccctgatggtcacgcccctgcaattccttctctgcaagcatagcaaaccgaaacaactggttgacagagttaaattctttataatcaacaatattctgaatttcctccctcaaacaagagtaaaaacaacaaatagcatcctcgaccccctccactatgccacagcgtctcacacccttttgtagctcaccatagtaatcctgtacagatttatccccttgttccaaacgcatcagtttcttgcgcaaatctctatgataagatggaggaacaaacctatcgcgcatagctaccttaagttcttcccaagtagtaggtagtaccccctcatcagacaacccagcccaccacatgatagcaaaatccttgaactcactactggcttgtctaactctatgttgctcaggtataagttgggcattaaactttgttctactgccatctcccaatcaaggtatttctcagcatcataatatcccgaaaaagatggtattttaaacataaccatagcataaggataatcgggcacacgattattattaccttgttggtggcgagtgccacccatacctgtgcggtttgtgcgtaggtgacgtcgtagctgtgcttgccttgtagctggtgtgtcaatatagccactggaatcatacaccgtatcttccggatgagcatcgtcgtcaccactcaccacttcctcattggaaggtgtctccaacgcggcaacccgatcagttagcgtggatatccgtttgtccaacctctccatgtggttcaggaagctgagtttagtgaaggcatcttgcacagactttccaacggcctccgtgatgtcctttttcttggagagttcatagttgctcttagctgacatagtcagcaaaatcctggggactcttctcaccttcgttacctgccattgaaacaccaaaacagaaacaaacggtgaaggttatccctaataatctactacgcaggtgtagtggtgcctctcaacgattctcagcaatatggagtacctaaccaagctcttataaggttcttagtagcaaagcaaaggatacctggaaggcgtagtcagcgatgcagggatcaagaacctgtgctgtccagaagtaaatatgtggagctaggaaggccaaatatatgtatatgagtggtacacaatccaatgacagatagtaatgctgaataaaaatcccaagtcacttgcccttagttgctggtctactcgtgtattagacagtagtggtaacaataatggttcaaggaaaatgacactagtaaatagcaaagaaggacttgcaggcaagcttcggcgagttttagcaaaaacaacaaaaccgaactggcagataagctcaacggagcacgtcgtgagcttaatgcagtagtggaaatcaacttttctttttttttcttttatttttttgatatttttttctttttccagaacacgaaaataggcacacctctaagttacagctaaatcggagttgatatgtggcctatggaattttctgaaaccactataaacaaggtgcaggaacttgtgggctcgaacagacaattttgcaagccaaattttagaatttttttctcttatctgaaaagttaaaatttgcctgattccgagtccgtatgcaaaagttatggctgtttgaagttttggcttctggctaagttttccaaaggggatataacctagcctattttgcggtggaattgggatatggtggcagcggagtttgtaggatgttgtggtgatgcgtggtgatctggaattgggtgtttatgatggcggaaatggctctcaaaggatagggttataaaggaaaaaacacacgactagactaaaacacgcactagaccagcaataggaacttaaactaggactcaaactcaacactacggactctgaaaaagaatcatgcaaaggctaaacacggtctaggttaaggttactaacgactaaattttttttggcttttctgtagactctaggataattacgaaaaacaaaaactaatctagggcaaagaaactgagcgaacctgacggtgaacctagagctctgataccacttgatgtgcactagggttcccgatcttccgaaatgttttgataaacaacgatttgggcggagtcgcgacacaaatcgatctgtcttcttgaacgcgcacgctcttgagccccgcaatcgcagcaccacgtctcctctggttatcacccgtgtcgaaacgcggatgacctcgccgagaaggctaatccctgtttgccaatcgaagaacacaaagaagaacgagacagaaaacaaccaaaattgcagatgaatgattaagctcacgagttgtggtcttacaaaccgatctagcggcgaaactgttctcgacagattaatctaagcaaaacccaaagacctaaagatggcggcggtacttatatatagagtttagggtcttgcaacccgctctcgacgcaacgctaatgagttccaacgcgatacacgggccaaaagtccaaatacggtgacgcaacaccgggacagaatctggacatcaacttgttcgggcgattcctattgactcggaaagaatttggatgtgggaccagaaccattggaaaggttatctttttagctttccatccatataaagaacgtgtagcgcccgttccgtcgtggcgcctagcgggaaaactatctcttaaaaaccctaattgcgaaatctggttccttgcttggtgtctatccccgatctatcgtcaaagttcaatcccgaatctaaatccttcccaaatcaaatccctccgcagaagtctattttgcctccctcaggttcgatgggccgaattcctcttggcccatcttcccccttcccatctccccctctctctctctctctctttctcccgctctgcccatgagccgcgccgagccctccctttccggtctcgctgccggtcccaccgatgccacccaaattgccgcggccgccgcgcgcgcgcgcgccgtggtggccgaccgggcactcgccggtgccgtccgagcctgccgcgcctgccgagcctgcccgtgccttgcacccgtgtcgtcgcttcactccaaaccgcccccgacgttatcgccggtgttatagacccgggcttcgtcaattcgcgcgctagccttcaagggacggagggagagctcctccttcctctggcgcgttcgccccgttcccttctttcttttccaaagtgggaatgggcaaagccccccttttcttcctttccttttcccttttttctctttcctccgccggcgtcattcccctcctccttgtcgccgatttggccgctagccggagcgcccgatcactggcttgaccgtccaatgtcggttcccctctcccaaaccgactttgtcgcccatataaacccaagctcccccactttcctttcctctcccattcgccctcgctccaccgcgccattgccgtcccctctgtcccgcccccgccgtcaccgccgccgtcaggtgtgccgaaggagccggtgcgcgttaggacgcggaaggggactccgggcgcgccctcttcttcctcttccccggcctgagggtggagagatcactcccgtgccgtcagcctctcgtcacagcgccccgcctcgtctcggtagtgcctccctccgttctccctcctcgttccatctcctccccttagactcgggtagtagcacgagtagcctcgccgtagctaactagcgccgccccgaccgttgcagccgctcgctgtgtgctcgccgccatcgccgcccgtgcttcgtagcgcccgcttgtcgccggcctcgctcggcgtagctccgcctaatccgacgctagcaacggattcccggagttgcgtagatgctctagctcgcccgaatcggtctcccgtcgcgccattgccgtttcacccttctcccgccgccggttgccgctaccgcaatccgccgccgtcgagcatcccccggtgaatccgagctgttggctcgtctcccctcgtcccgagcaacttcccggtgtgctcgctttcgcctgtatcgccgtggttcgctccgccgcccgccaccgtcgtccgccgtccgttgcggcagacgtcgtcgtctacctcccgccggcccgcgtggcagccacgtaagtgccacgtcggcgccacctcggccgcgaccgtgtcaagctgacaacggttcgcagctttccccccgccccactcgcgcgcgcggtctaccgcgagccgtgaggctgcgcgtgggcccaccgcaccgcgtcctccgcgaaccgcgcgcatgcgccgcgcgtccctcctgaaaccctagcacacctcgcatgcacctcactcacggtgagtcgagtcgccgacaagcgagtcccacccaggaccacgcgggatggacccggcccaccggctctctctctctcctccccgcccgcgcgcatgttctgggccaccttctcgggccggccggctcgttaagttcggccgagccgcccctttctctcgggccgcgccctagccgcccgaggaaagtctaatttccctccctccttcttttcttttcttttctttttcaaaaaggatttaaataaatccttttcctttagaccaaaaatccaataatcttagaaattgaatatcttcccaaccgtaagtccgtttgactccgttcaacttccaaaattcctcaaatctcgagatctatctaatggcacgcttagaggtcaataatagggctttatttttgccgtttgctgagttatcccgtttcgcgtgtagtttcggagcccgaagacccgcagtgcgaggatttcgaggattaagctcaagatctcgagcaaggcaagccacctttgaacatcttgagcctatatttgaacttaattatgttgcttgaaaaatattatgcattaataggattgcacttaatctgcttgtcccgtctgcaaggcagattggcggacctacctaacttgttgcatttgacccttccatcgaaattcttataccatgttcccttgtaaccacctagttacgcctcggtaatcgtgcactctgcacgagtaacgacggtcgccttcaaacttaaaatctgagaaacatcttgggtaaaacatgggttttataaaagacttggaaaacctgacaccagggtcggtgcttgcgaacctaaatgaatttccaaaatcgcggaccggggaacgtaccgggtgtacggtttcccgctcttgcacttaaggaccgtttccttggaatttcatctgaacataagacaagtacgaccacatgggtggaatgggacacccctggctgagtaactagctaatcgggggagccatgatgccaagagacatgtggattcaacggggtggtgtcggggaggacccccgggtttcctggcatagtatggtctgggacctaatctagtgttggtctgggacccctctcgttggcatatggtgaacctgtgtcggctttccaaatgccttgtcatgaaagccttaaggtctctagtcgtggccgttctgcacgggctggatgatctgggttagtaatgtcgtgtgggtaaagtgtaccccctctgcagaggttattaaactgttcgaacagccgtgcccacggtcatgggcggatgtgaggtgattcctagcgtagttttgtttgactactgctttgtgaaatttgctgatgtggtttgggattgatgtttggaaaatctgcggctgatgggatcatccaggcccaggtggccgtttaaaagccgttggccgggtgccaaccttgatcaattcaaaagactgataccttgcacatacttcgaccagacgagacgcactgtctcatctgtatcgtttgagaagcactcacttagttgtttcagaaaagagtttaaataaaatcaattgcaaaaacaacagcctttccttgaagcctgcattaaacacttatttcccatggcttgctgagtactcccgtactcacccttgctgtatataaataatcccccccagttgttgaagaagatgaagcggatcccgctgacgaggagttcttccaggagcaagccggctacgatgagttttagggttttcggcctagttcccaagtcgcgcctgtgatgtttggtccaagtcttggcttccgctttccttttgtaatgcagttgtgagctcgggatctgtccgcagcccaacatgactgggctcctactctataataaagagacctctgttgctgtgatattctgtcttcctgtgatactagcactgtttcctgggactggtatcgattaacaggttaatttggagcgtcacgggctagttctgctcgggactagtccggggcgtggcaagagatggtatcagagcacaggcttggccctagggcgaaacccgacgtttaggacgaccctaaggatgctaagttcaaaactacttgcgaaaagctaaggctccttttggtttctttattttcaatagtttgttgctaaaatggttattgatcttttctccctctttcaaaattgtagatggcagtgaacgccagcttcagttcccacggttttggcgagggtcaccacgtcgctcagcttcgtgacctcgcccgcttccttggcttctcgtgtcccgagtacacggggtactccgtggaccgtgttccccctcgctgtgagctctgtgtacctttaccctcgtggaggtatacacggagctggcctttgcccacaccacttcactgtggccaggcccactctccagatcgcgtaccaggacctctcctggactgcgcttcgacgcttggcccatgactacagccaccgtctcgggggctctgccttctggcagctcccacgccttccttctggccacgcagacgccaggtacccttgtccgtacagcgagtctcagccagtgctgactcgcatggtggagctttcggaggcttaggccactcagcacgacctactcctcgaggcttaccgctcctttgcccgccgatacgccgctctggaggcccgtctggccgaggagggtgtcacctcagttgacactgtctcttgggactcagcccgcctatgccacgccagccacctgtcctcccacagctctcgcggctcttcctgcactcccagtggcccgcgctcccccagctcgcgtgcgccgtactcaccagtgtactccccctacccacacccagttagcccctcctacacccccggacacaccccagttgcttcctcccgccgtggcccacgctttatccgcactgtgcggaagcatgttgttggttcttccaccgtgttccgcttcgactacccagctcccccaccgccagcggcccgtactgctgccggccctcgacaggttccgccggtcccttcgcgctagccgatcgacgtttcttcgactgaggagccgactacaagaggcagccaggcagacgaggagtagaggaggcagtcttcagcagctgtccgtgtgttaggcccttttgttccgccgccaactcttttggagtcatggcgagatagtgcgtgcgtgtgtttgatgtgggtgttgtttggtagtctggttctcgtaggtggtgtgcgtacagtcaagctcggcgtagctctgtgacttgtccacacccgttgtatcaggtgtttttatgatttgaaaaatccagtttatgcctagtgcgtgctatctgagttgttatttactttgctccttgccctcctaagtgcttatctgattcttacctcgccctcttcggtttagatggctagccgcccccgccgtgctgctcatgcatcagcctgcttcggttttgaggaaggtagagttgagccagaagcaaatcatgagtcagctaatgagcaatctcaccacagcaaccgttcgcaccgtactgcttcccgcaatgcagaagttgagcaaccccgccgcagcaaccgctcgcatcacacagcttcccgtatagcagagatggaacagtctcaccaatctcaccgcgctgctagtcacaattctggagaagaacgcatcccttccccacctcatgtggaaaacaacatgcaacacctgatggcagttcagacacagatcttgcaaggattagccgcggctatagccggctttcagcataatgcgcatggaaatggccaccctcacatgagcaacaatagatccaaactgaccgacttcctgaggtctcggccgccagagttctctcagaccgtcgagcccgttgaggctgacgattggctgaaggatgttgatagaaaactcaacttagtgcagtgtactcctgttgagaagacgctctacgcctctcaccagctaagaggacctgctgcagattggtgggagaattactgcaatgcacaccctgaactcactaacattgcttgggatgagtttgctatggctttccgtgcagctcatgtgcccgaaagcaccattgatatgaagaaagaggaatttaacaggcttaagcaaggcaacaacagtatcaatgagtacctaagtcagttcaacaagttggctcggtatgcccctaaggaagtggacacagacaataagaagatcaggaagttcttgaagggaatcgcagttggaatgagactccagttgcttgctcatgacttccccacttttcaacatatgatcaacaaggcacttctacttgaggatgccagaaaagagtctgccgaagaatataagaaacgcaagtctaaccatcaggggaattcttcccgaggcgcacctcgccctcgctatggtcaacccatgcaataccactagtcggtcactcaagctaaccgccagccaggctacgcccctcgtcctcagatgaaccgctcggcacctcagccacagcagcatgccccaagtggcaatactgcgcccaacagggttacctctttcaagtcaccgctaggactgtcagcagttcagtgtttccggtgtaaccagatgggtcactatgctagatagtgccatcagaatcctaccaacaccaactcagggcatgctaatggcagcactgccagaactcctactccagcagcagctctgtctcgtcctaactctcaggcaagaggacaaggttctcgtgcctccaacaactttggtcgaggccggatgaaccacattcaagctgagaccgctcaggatgttccagacgttgtgatgggtatgttctctgtcaactccgtacccgcaatagttctgtttgattcaggagcttcccattctttcatatcacaagcttttgtgaaaagaaatggttggaaaacccaaaatttacatgtaccaatgatagtacattcccctggaaggaatataagggcaactcaaatatgcccggaagttaaccttagaattgaggaagttgacttcctagccaaaccgatagtcctggactcgcaaagcttggacatcatcctagggatggattggttggctaagcacaaaggacagatagattgtgccgaaaggtccatcaccttgcaaggacctggaggaaagcaagtccgctttacctctaacacccctaccacaagtcggtctatcctaacctgtttacaagtcacctccttggagtcggtgcccatagtctgtgaatatcctgacgtatttccagaagaattaacgagtatgccaccagaccaagagattgagttcgccatagaactggcaccaagcaccgcaccaattgcaaaaagaccctaccgaatggcagctaatgagttagcagaagtcaaaagacaaatcgaagaattggagagtaaaggttatgtgcgacccagctcatccccttggggagccccattgctcctggttaagaaaaaggatggctctgagagaatggtaatcgactatagagccctgaatgaagtaactataaagaacaagtacccgttgccacggattgatgatttgttcgatcaacttaaaggagcaagagttttctctaaagttgacttgagatcaggttaccaccaattgaaaatcagatctgaagatatcccgaagactgctttctcaacgcgttatggtctatatgagttcacagtgatgtccttcggactcaccaatgctctagcattcttcatgaacttaatgaataagatcttcatggaatacctggaccagtttgtcgtggtattcatcgatgacatcctgatatactccaagaatgaggaagaacatgctgaacacctgaggctgataatgggaaagctcagggatcatcaactattcgctaagttctcgaaatgcgaattctggttggaccgagtagcatttcttggacacgtgatctcctccaacggtgtcaaagtagatcccagcaaggttgaagctgtacttgcttggaacccgcccaagaatgtgtcagagatccgcagcttccttggcttagctggatattatcaaagattcattgaaggattctctaagctagccagacctatgaccgagctgttaaagaaggaaaagaaatttgaatggtcagcagcctgtgaagacggctttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagctcaggcctcatgaagtcaactatcccacccatgatctcgagttggcagccgtggttcatgctcttaagatcaggaggcactatttaatcgggaacagatgtgaagtatacacgatcacaaaagtcttaagtacatcttcactcagaccgagttaaatatgagacagagaagatggctggaactaatcaaggattacgatcttagaattcattaccatcccggtaaagctaatgtggtcgctgatgcgctaagtcacaagacctattgcgatgtagctcaaatatggccagaccaagatcgcctgtgcagagaattggagaagttaaggctgaccgtggtacagtcaggtgtccctaccagcttgacagtgcagcctaccctagaatcgcaaatccgggaagctcagaaagatgatgaagggataaaagaattaataaaaagaatacaggagaagaaggacaccgatttctccatagacgatcaaggcacaatttggtgcggtccacgcatctgtgtaccggccaagaaggagttaagagatctcattctaaaggaagctcatgagtccgcctactccattcatccaggaagtatgaagatgtaccaggatatcaaggcatacttctggtgggctggaatgaagcgagatatcgcagaatacgtagccctgtgtgacatttgccaaagagtcaaggcagagcatcagaggccagctggtctgctgcaacccctatcgattcccgagtgcaaatgggaagagatagaatggatttcatcaccggtttgccaagaacccctagtgggtacgactccatctggataatcgtggattgactcatgaaatcagctcatttcgtgccagtgaaaaccacctttgatggaaagaaactagcagaactctacatgacccatgtcgtatgtagatttggctgtcccaagaagattgtgttagatcgaggcactcagttcacctcaaggttctggaaacagttgcatgaagctcttggaaccgatctaaattttagtacagcttaccatccgcagaccgatggtcagacagaaagagtaaaccaaatcctagaagacatgctacgtgcgtgtgccatggattttgaaggcacttgggatcattgtttgccgtatgctgagttctcatacaacaacagttatcaggccagcattcagatgtcgccaaatgaggcaatgttcggaagaaagtgccgcactcccttgtgttggaatgaggtgggcgaagcactggtattcggtcctgacatactcaaggcagcagaagagcaagttaagctgatccgagaacgtttaaagacagctcagaaccgtcagaagaattacgctgacaatcggagacgtgaccttgagttcgaaaaaggagaccatgtgtacctgcgggtatcacctctccgtggtatgaggaggtttgggatgtccggcaagttagcaccccgctacatcggcccctacctcataaccgccaggcgtggcgaagtggcttattagcttgagttacctgaaggtctcgcagatgtgcacaacgtgttccatgtatcccagttaaagaaatgtcttcgagttccagaagaacaagttcccctgggtaatatcgagctggaaaggaatctgacctacaaggaaagaccgatcaaggttcttgaagaggcaggacgtcagactcgaaggaagaccatcaagttctataaggtccaatggagcaatcattccgaagatgaggcaacctgggaacgagaagatcttctccgcgccgagttcccggagctgctcccttagggctgaatctcggggtcgagattcttgttagggggttagtctgtagcgcccgttccgtcgtggcgcctagcgggaaaactatctcttaaaaaccctaattgcgaaatctgtttccttgcttgttgtctagtgaccgtgccatctcggatctcaaatccccgatctatcgtcaaagttcaatcccgaatccaaatccttcccaaatcaaatccctccgcaaagtctattttgcctccctcaggttcgatgggccgaattcctctcggcccatctccccctccctccccatctccccctctctctgtctctctgtctctctctctctcccgctctgcccgtgagccgcgccgagccctccctctccgctctcgctgccgttcccgccgataccgccaaatcgccgcgccgcccgcgcgcgcgcgccgtggtggccgaccggccagtcgccgccgccgtcagtgcctgccacgcctgcccgcgcctgccgcccgtgtcgtcgctccgctccaaaccgcccccgccgtcatcgccgtcatcattgactcggccctcgccactccgcgcgctagcctccaagggatggaggcagagctcctcctccctttgccgcgtcgccaccgttccctccttcttttcccaaagtggcaaggggcaagccccctttcttccttccttttccctttttctcttccttcgccggcgtcattcccctcctccctgtggacgatttggccactagccggagcgcccgatcactggcttgaccgtccaatgtcggttcccctctcccaaaccgactttgtcgcccatataaacccaagctcccccctttcctttcctctaccattcgccctcgctccaccgcgccattgccgtcccctctgtcccgcccccgccgtcaccgccgccgtcacgtgtgccgaagcagccggtgtgcgttaggacgcggaaggggacttcgggcgcgccctcttcttcctctacctcggcccgaggccggagtgatcactcccgtgccgtcagcctctcgtcacagcgccccacctcgtctcagtagtgcctccctccgttctccatcctcgttccatctcctccccttagactcgggtagtagcacgagtagcctcctcgtagctagctagcgccgccccgaccattgcagccgctcgctgtgtgctcgccaccgtcgccgcccgtgctccgtagcgcccgctcgtcgctggcctcgctcggcgtagctccgcccaatccgacgctagcaacggattcccggagtcgcgtagatgctctagctcgcccgaatcggtctcccgtcacaccttcgccgtttcccccttctcccaccgccggttgcccccgccgcaatccgccgccgtcgagcatcctccggcgaatccgagccgttggctcgtctcccctcgtcccgagcaacttcccggtgtgctcgctttcgactgtatcgccgtggttcgctacgccgcctgccaccgtcgtccgacgtccgttccggccgacgtcgtcatctacctcccgccgggcccgcgtggcagccacgtaagcgccacgtcggcgccacctcggccgcgtccgagtcaagctgaccccggtccggcgttttccttccggcccactcgcgcgcgcggtccaccacaagccgtgaggctgcgcgtgggcccgccgcaccgcgtcctccgtgaaccgcgcgcatgcaccgcgcctccctccccaaaccctagcacaccctgcgtgcacctcgctcacggtgagccaagtcgccgacaagcgagtccccccgggaccacgcgggatggacccggcccaccggctctctctctctcctccccgcccgcgcgcatgttttgggccgccttctcgggccggccggcccgttaagttcggccgagccgcccctttctctcgggccgcgccctagccgcctaaggaaagtctaatttccctccctccttcttttcttttcttttctttttcaaaaaggatttaaataaatccttttcctttagaccaaaaatccaataatcttagaaattcaatatcttcccaaccgtaagtccgtttgactctgttcaacttccaaaattcctcaaatctcgagatctatataatggcacgcttagaggtcaataatagggctttatttttgccggttg

SEQ ID NO: 67157 - DNA, 9060 bp, Oryza sativa
aaaaccatattttttctcgtgtgtttttttcttgttttctcgcacgtttttttgcttgtttttttcgaaggttcttttttgctttttttctaatacacgagaatatatgacgaaataaagccatgtagtagatggcaaaaaatcgatggatcccattcgactcgagcgtccatcaatttagtttttttctgacagttttttcagagcgatttgtttttaatagacggtgtttttttcttgcacggttttttaaaactatttttttagaaatggcgtgttttttcaacagttttttcctcgcatgtttttttaaaatattttaccgatgatggaaataatttttctcgcgcgtctttttttattattattgacaatggaaaacctttttagcgtgtttttttgcgcatttttttctgacttttgcctcacacgttattttaaccgtttttattttctcatgcattttctctttttaaatagttagattagagatagagaagagatatatactggttagaaatcagattttggttcgccctttccattttttctctcttgcattctttattttatacgaaccagctttttattttttacgaactatttttcgccactttcttagggaatcgaacaaactttttaagatgtttttttagatttttttcgcctttataggaattagacttttttttctgtttttaaaggaatcggatctagctttttttgtcaccactttttttttttgccttttatatgaatcagattttttttcccgtcggatctacagtttttttggccactcaggggaaaaaacttttgttgttgttgtttttctttattttctttttttacggtttttctttttatgcacctttctgtctttgttctctttctcttttatttttttttaacaaaaacgacctcaagtaccttgttgcaagattatagggactcaaatataaatataaaaattacagggactcaaatataaaagtacaaaccaaaaaattaaaatcatataaaaatggaatgttgtcgacctgtagattccgtttttgcaaacagatctttaatccggcacatcaatttttttcaaagtcaaattttttttccgtttctaagaccgaatctgatataggagtcaggacctttttttttgctatttcggatataggagtcggacattttaattttttttcattatttttttatggacgaaggaagcacctcttattttttaagtagtagagatgtgatcttgggagttgaattttattgaatcttgtacatgaactttgtttaaaacataattagcaagtgccaacctagtttgctatataatttaatttagaattttggaattaataaatatcgagttatacttaatgttagagtcacaaatataccttttcatgatttacttaaatagcaagagctactgctattgacttttcaaaatgtgagtttataatttgttgctacctggataaatttgaaatttgaaattcgtaaatagaaatttttaatggttgaaagagtgcaatctatttgaataatgatacaaataatatacccactgatctttttaatggttgtggacgttactattatgacacgtcctagtgaaccgacatcaattaattttaccttttcactctaaccttctcatctttgcaattgttgagagtcaaaataattgcagctaatacatgcataaattaattgagtttaaatagatacactcggaactccttttatctgacgacttgtttttgtttcttcaacgtctgttacataagatgctaaagccaatgatatccgcggaagggagaaggtggtgtcaatatgaattatttaacacgtggtcctctttcaataagaattttgtgggggaaaggatttcagcatagttatctcatggaaaattgaaatttccttgttctcagaaatttaggaatttttgggaatgatatctttttgaaagttgaacaaagattgatttaactcataaaaaaatttaacttggaagtttaaattttgaaacgcatcttgatttagtgcttgctatattagggtggttggtgactctactatcactgcaaagccttggaggtgactagagatcggtcggccgatcgaaatcttcaaaactcgagcgctgacgtcacgctgatatcagcgcccgacttacgtgcaaaactactttaaaatgattttttcttaaattacttatccaaatcatgatccgattgcaccattaaattcgttgtaattaaatcttcaaaataagaccatacatagatatattctgatgaaatttttttagcttattattgaattttttttaaatgttgcacgatgttccatcagatatatcggaattgtttcactaagtagatcgaaaatgtttcactcgtttaaatcgggtattatttcaccttatataaaaacaatgtttcagcaaatagcgaaagaatatttcagttcactacgacatttgatctatacacactaaaacattataagaatagtaggtgaaacattttttcggtggaacaaaaaataaaacaaattcccttaataggggtttctaaaatatgtgggttttttttgttgcaatggagtatttcagttcactgcaacattagatctatacatagtgaaacatagtgagtacactaggtaaaacattttttgtagaaaaaaataaaataaattctcttaacagggggttttcaaaaaatatgagttttttttttcaatgacgggtggtagcatagaacgctggtggggccagagcatgcatgcacgggggaggggcgtggggggagcgcacgatccggctcccccgcgtcgggcgaccggatcacatcattatcgcaaagctttaggcgctgcgatcgtggttgtcaacttgtcataaaaagttaccaacagcttgtaatggttgcttattagcagaaattaacaaaggattaaaactttgcaacacaacataaatagtaagcgacatagtacgcgtactatttgtttgaagatactaaatgatagaacaaaattgtgtggcatatagattagtccggcaatatatagattacattatgttccaattgatgctatgggcagtcaactttcttgcgatggtgcagatcattgcaatgccggcggcggcggctgcaccaagtggatagtcagcggcgtgctcgcgtcttctaaactgcttgtagatggtgacacaaccgatcaatctggcgatcaagtcagtcaagtaactgctcgatagatggtgatggatttcttgatgttcgtgcaggatctggagaacggcggccaaatcgtggtgttggcgtacttcatctcaaggtatcgatggcttcttcgtgtacacaggcgggttttccctcgtcgtcagggagctcggcagttgtgatctcgcgtgacgtgtgctgagtcctgaccagatacatgatatccacgtaggccaactggtgcaccacaactgtatggattagatgaaggcctgtacaaagattggtaggctttaaaacgcaagattagatgggcacattaaaattaaaagccacatgttgtcatgatattatgttgtatcaaatcaatgatcagatatttctggatatccacataggccaaccaccgagatatccgtactttcatatgtggtaactgcatggattagatgaagaatcgaagacccgtacaaagattggtgggctttaaaatacaagattagatgggcattagaattaaaagccacatgttgtattaatatgttgtcatgatattatgttgcatcaaatcaacgatcagaaatttttggttaacgggagagctcataaaaaatgcctgattagtatgtgtataaatgtatagatatatagatagatgtatagatatatatagatgtatagatgtatagacagataatgataatgtaaacaagtattatttggttcatacgacattatctttactactttaaaaagtacatttttttcaccaccgcagttgttctccttttcccttccaaccgtatgaggtccacagatccagtaatttatttttagtcctcccacccaattgaagataatttgaacttaaattggagatattttggtctgtatacgttgcttgatcagtaaggtttggtaatccgagctgacccaaatcaggagctgcaaatttaaattccccggttcatcgccggccgccgggacaagatgtgatcaagcaataattatgatccgcacggagaaggataataagttaatcacacaatcagggggatcatgcatcatggcaacaacagctaacccgctaatatataggtgcgaaatgtttgcttgataattagtggcaccccaccgtgtaaattaactttctctctgtttttcttcctttccatggcaggaagtcatatgactagcggttaacatcgagaacctaccttttgggtagccactcattgcctgttccacctccaccgtgcatccgtgatttcatacgtttgaaaagatcaaaagggatgcacctcacctcctccaaaagatcaggcagcaggaaaaagcaacgctcgagtagtctcaccggcaatggcatcgccttacgcatcatgccattcgttatgcccgactgcccataatttcatacatcgggaaaatggcaatgctggcctttcttttgtatgcgcgcgtgtaattttgaaacagacagcaacatgttagagtaggggtcaaatatagcagtcctattaagagctggacttataattgaaataggtataggataaagttagagtcggacactatcttatactctctcttaaatatagagtgggacaacacgatataatcattatgactacaatatagcgtatacaagtagggatacgatggcgactaggccatgtactcatagcggctagatgctatgttgattggggaggagcgcctataatcaaaagcccgaagatatattcttgtgctaaacttcattaacaaatgtcatgtgttcgtatgttgtcatctaacatatcttggtaatcaattactaaagtgatcgagaagactacttgtcgttccgttatatcaaacaacttttataacaagtgatatatactaaagctatacgtgtcatgcaattgtgtatgtttagggaacacacttactatttattataggcacacataatgtactccttgtcttggtaggaccaaaaggtgtcgtagatgtagttgaccaatccttaatggttattctcgagatttgtgacagtgaccacttgtggatcaaagaaggcaagttccggtgcattctcctgacaccactgccaacttaacctatacgcaagaaaaacgatcttataagcgggttaaatggattgttattactaaattgagttgagcgacaatacttacaaggagtagcacttaagtaggtttgtgtccaccgctcggagcctgtcgaggtcgaatagatccttaaagttgaccacgatataatttgttggaccaaggaatggctttcgatcgtggtctccaaggatattgctagctatattctgtctcctggcgttagatttctccatttagtatacgtgaaggtccttgcaagaggtgcccattgtggctagcacgtcgtctccaatcaatggcatacctagttggaactcttgtggagcgacgtacttcttctggacctccttccccttagtctcttcatgccccttgcccagatctagcttcttcggagccaaaaatgaggcctgcacctttcctcctcttcctctcccccttgaagtaggtttatcgagagtaattctctgaggagaagagtgcgcctttctgctcttcttcatcgattggggttgaggaatcgccatgctgtcggcctccatatggtcgtccccaaaatccatgtcatactgcaactccacatcataagatcttcttcatcgtcgtcttgattacgtcgccaccgattggtatcttcgccttcaccgctagcttattatgtcaccgctaatgggcatcttcatcttctgcctcatttgtcaccgactgattatttcgccaccatggctacacaactgtgtcgctatcgctgggcgccttcatcttcactaatgacagaccatattactgctgactggtttcttcgcctccacggctgtgcgacttcatcacctttgattggtgccactgtctttaccaccaccaatatctttgtcacctttgatgggcgatgtcatccccttgttagtcatctcgtttccatgccgactacataagctaccatcaatggacaactaaaactacaacagaagtacatgttacatgcttagggggctcatgaactcaagcgcgatgatcataccttcaatttggacttgttccagatgcatgcaacataaattcatgatcatgagtcaatttcttatgctcaacgagtgaactattcgttatttcccacgagggctatcatctgagtatttgtaagagtcaggatttaatttttacatctactgaggtacactctatgaggataaccactcggatcagaagccactaaaatgagatgcactcgatctacatcacccaggaattttatcacctgggagcatattaataggtgttctaggggtatcggtaggcatattttggccctaggcctaatatgtctgcagcccatattttcaagtgtggccaatcacgttcttttagggactaaggcattttttgcttaggcaaaagtgtgcatgatcaagtgcctaataccttaaaatccctttatatcgctgtcacttaactttttaggaggtggtaaaatgcattttaaaaggtgtcaaatagtgaagctttatatagttaccccactgacttgtttttatttatttaaggcgttgtttgggtttacaaagtaatcgattggatacaatatcgttgctttttgccacataagtgtgcatttttattgacaaatattatgggcttagactgattatatattttggtcattttccaggcggttggtaaatcctttatgagtttatttagtcggattttacaccacatatgccatatatttccaggtgtgatgaaaccatgtgtcttttagggactcaagcacatttgttaaagcagtgtgcgcatagtgtatgcccaatactttgaaaatttctttattcacagcatacaagcttcttgattgttgttttgctctgtgaattttccatgatgtatacaactttaggttgctcacatcatattttgcaaagcagtcggtatatcactcggatcatgttgatcggggattcacaccgcatatactatatattaatattaagtcacttggttggctacaattatcgaaatcactcggttgtttggtgttgacggtccttaaatcataatatctgaccatcaatacctgcatataacgaaataaaacatggtatccaacgtagtggtaggtattattactaatcatttccactagtgttggtgaaatatgtgtatgcgagtattttgagaagaaaacacatccgtcaagcgacaaactgcacctccgcgcattcaggacacatttacacggattggaggccccataagtcaattaaacaactccaaatgggcccaactatcatgccaatgggctgagggcctcaaaattagtgtccacaacgaaaaatgggccgaatggagccgtcccgggttcggccgaacctccagtttggccgaacgattttggtagccgttgatcgccaaatttcacgtggacggtcctgatcacatcctaatggcggttctggggtagtttggtcatttcgcataggttgtaaccgtcatacctgcctataaaagaagcagctcactctcatttccaacacacaactttgacctgaattacaagaggctttattgtatcttttgtacattagaataaggtagagagtaaggggaagttctggaggagtgcccggaagtttggcgctcatccgacttctacctcaaggagtgtagcttcctaggaggaattctggaggagtaccggagccgtcggtacactctgcttcgggttcggagaacttcttctataaagtaagcattcgtgtttctttcttatgttatttaattactttgtctaagtaagatagatatccatctttgcgggttcattgtttagtatttatactaagtgctctagtactaggactccagatagagaaggaagctcttgcgcaagtattagagtagtaattaataacttagacgtggtgtctagtttagagattacctttgttagttgtgtatcccacggatttgttagaggtagttggcaggtggtgatagccctgaatcccgtcctagtaatcctccacgttcggatacatcatagagctatagccggaaccacgctggcagacaagcaggggtcggtgcctgaagcaacagatagggaattacctttacttagcttaaataattaaaaatacatagagagtcctctctagcctgcctaccatcagttgctgtccttggatagtctcagccttaggtagattacacacattccctgagttcgatatctttttggggtcacctgaaggtgaagtgctacaacggtattccgtgcgcttgcggatttatctgtggtcgtaagaaataccaacaagcatttttggcgctgttgccggggaacggttgctaatttatccgagtctaggtcatcctcatatctttatttttacttcttcttgttttattcctttccttgatggagcaacccacaattcaaaacatttctgctcctcgggctaatctttgtgagtcatcctattcttcaaaaccaatcctttcaaatggctatgaaatcggtcctggctttatagccatggtttgagagcaaaccttctctggtggtattagtgaaaacccatacctccatcttcaggactttgagctagtgtgttcttgcctatccatcataggcatgacacatgaaactcttaagtggaaattgtttcctttttctcttagagatg

SEQ ID NO: 67158 - DNA, 42947 bp, Oryza sativa
cgatttacgtgcaaaactactttaaactgatttttgtcttaaattacttatccaaatcatgatccgattggaccattaaattcgttgcgattaaatctttaaaacaagaccacacatagatatattccgacgaatttttttaacttattattgaattatttttaaatgtttcacgatgttccaccaggtatatcggaattgtttcactgagtagatcgaaaatgtttcactcgtttaaatcaggtgttgtttcaccttatataaaaaacaatgtttcagcaaatagcgaaataatgtttcagttcactgcaacattagatatatacatagtgaaacattgtgaatacactagatgaaacatttttttggtggaacaaaaaataaaccaaattcccttaatagggggtttcaaaatatgtgggttattttattgcaatgaaatgtttcgttcactgcaacattagatctatacatagtgaaacattgcgagtacattaggtgaaacatttttagtgcaacaaaaagtaaaccaaattcccttaatagagggtttacaaaatatgtggttgatttgttgcaggtgggggcaggtaatgtggtggggcccaacagtagcgggggcggagccgcgggacagcgctcgatttttttctcccccgtcggtcgaccgacgaagagcattatcgtaaattattatattatttttctaggggtggtaaatttcttttatccttttccggttcgttttattaaattacggctgttttgggtccatttcaacggaagaaaattggtctagcagggccacagggtcatactttcttttcgataaaagctggtcttggtggtctcaatctcgagttcgctttgtttatccttcggtctccacacctcgcctgcacagttactgcaactgccgtcggtgtgttcggttaggcagtatagccaaagagcaattctacgtaatttagtaccttatagtatctaactatcgagacattctaaatttataataaaaaaaatagtatccccttaaaatcgtaaaattgctcgtaaccagatgtctactacatggctgtatctgattgcaaacgtggtcgaaacaaacgacttttgaggggataacttcataattgcttccgaaagaatcagaactaaacacgtctgatgacaaataattgacatgcgacaaaagcaatgggttttgtccataagcaaatgttttaattatatatcgtgctatacaaaggaaaggaatcttgctattaatcatctcgtcaaattcgtcgccgtttcttggatctagaaagatcgtgccattgccacacgagcttaattaataattgaacctctctcgtacgtccgaggatgcaattaaacccggtcgtcctgctatgtactccatccgtcccaaaataacttaattcttggtttccgtgtccaacgtttgaccgtccgttttattttaaaaaattataaaaaaatttaaaaagataagccacgcataaagtattattcatgttttatcatctaacaacaatgaaaatattaattataaaaaaaattcatataaaatggatagtcaaacgttagatacagaaactttggaattaagtcttcttgagacggagggagtacgcttggatggaaaaacgtaccggatatcgtagttggatcgacttgttggagtagtcctctcatcttgttgaaagccatttccccgtcgattaattctgagatttccggccgcgtacacatgtactcacctttggccgtaactgatcaaccacctccaggaacagtagccatcgatatactcgtagccgcttcctttgctatgtatatcgttctgttctattgtttgtgtttcctcgttgctgaatcgatcaagataaggacggaagtagctagtaataatcaagtacgccagctgcatcagcccagtaagcatcaccaaagagtattctaatattttattctcaaaactatatttttatctcctaaactgaatatataggaagtgagaaaactattatttttaatagatagcttaaaattgatttcctataattaaatgtgagccctccctttaactatcaacagaaaaaatgggtttttctatcctgccctgcgcgcgcacaacgcgagatgccgatctcctcatctctctcgcgatttttcttcactgacaccgatcaatctattcgagccgtctgttggttgctgatctccctcgattcccctctgccagctcctccatcccctccaatgccgccgacgcttgtgagggagacgatgatggctgctcgcgagtagggcgagaaaaggagcacgggaacattttctcccagcgcgcgcgagagagcgaagacagcgattgggaagaaaaaatcgctctctaacagtgggtaacgagatttccggaattgagaatctggattattggaagataggttagggaatctgttagatgcgatttttgaccaaactttcctaaatttgaggatagggaatagaataaggaagctgttagtgatgctctacgactacagtctacgactacagaccaaaaactgcgtctgttttcggtccattccaatataagaaaattttcgtaatttcttttcgacaaaagatggatttgggccattagataggcagttggctaaccatgtggtagttggttatagaacccgtacctataataccatatagggtgtcgatttgcaaccggcaccaacgattgaagtcatcagtgccgctagtattgtgccagcaatgatgaatccagaatgaaaatagacgggtgtcttgttcgaatgaaagtttcgggcgagaagcgttgactattataaaattcaaattttgatttattttaattttgatgaaaattctacataagaagttcttgctgaaatatcacaatgtttagtggtttgacaagcatatgcctacagaaattaagaaatttggttatctgtttattctttaatttgagttatttctggtacaaataagaaatttgatttacagtggattgatgtgtatagtttactagctttaggccatgtcctttcagatttagagttttttgcggtactttatgtatttgaaatttaactatatacccttcccaaaattgaacttctaggtacaaatatatacgtctcatcttagatacattttagatactgatactaattaaggtggtagaaaggcagtgtcgcggtagtatcaggaattaaacggtgtaatggaagaatgcaagctctaataattattttgtccgtgtcagttgtggtatacgtagttacgtacggtgtatccgatagtactctgttagggagtgtaaccaaatatccacaaggctgtatctgattgcgaacgtggccgaaacaaacgacttttgaggggatataactccataattaatcagattacttccgaaataatcagaattgaacaggttctacgacaaataattgacatggtgacaaaagcaatggaagtggataagcaaagattttatacaacatgcaattatttgaaatccttgaatccctgtgtctaactttagtcactcgttttttgagtctaatcctgggcgagtggatgggaagagcaccgtcagtggcggagctggacggaaaatcaaaggggggccagccggcttttgacagctcaaaaaattggcaatttctcctttttttcgtgtattggcaatacataaaagcgaatagtttgcagaagcggacaatatacttacatgttcatttaaactatacggcacgagtcttcactgtattgaaatcgctgctatgggccagcaagactgaattgggccatacggtggcctgctagacctggagaccatatataggggtaataaaaaatttctttttattgggaggggccatggcccctgccagcccccctcaattctgccactgagcaccgtgagcgtgctgtggagttaacgacccagctttttccgaaaagcacgatgcggggcgcacgggagggtgggaacagcacggacatgatgtggaacggtgcggcgtctgggtcagcatttcgtcaaacaccctgtgtgcgtgcaagtggctatctcaaggaaggagatggtgaatagttgcgggctgggttgggcggcctgcttaggggaagggaaaaagagaagaaaaaagtacaccaaaggtccctcaacttgtcatcgagttacaaaatcgtcctccaaccgtaaaactagatatatgtcatccctcaacttataaaaaccgttcactttaggtactttgatggttttgaccctagttttgtcctacgtggcggctgagtcagtgtaggccccatatgtcaggatgccacgtcagcaccctctctctccccctcttctctccacatatgttcacatattttcgctgatgtggcaaatgtctgggcccactcgtcaggcatggtgcgtgcaagaggtgcctctgccgctgtcgggagcaggaggctggctgccaccggtctcagccctcaccatgctcgcacgcggagatgccggagatctcggtggaggcagcgaagatgaagactcatcgtttccccaaccttatcgccgccgctaacagaggccctggtctaggaaggggcgtcctagatcatcttcggcagatcagtcgcgtgcgtcgctggtgagactgaaacagacccttggcgcctgatctgccgcctgtcacgctcgtcaatggcgtcgagcggatctagaggaatagggaaggagccggcgtcgacacccagtgttccgcggggggcggcggcgtgggcgcgtggggcggtgggtgtgcgaggaatcggagcttgtatagcagctccaacccgctgtaggagtcggagggaggagctcgtcggggaaatcctcggagacgagcgagcaacggcgacgtggttttgcttgacgacagagatacccgtggtctcctcgattgttgacggcgtgaacccctccctagacagcgtggagttgagcggcgtgtactcgtgcggtcgtgccacaacccgagcccgatgatgcttttcctccccatcctcatccgtcgtgctgccatgtcctcctcctgcggccgttgtctcccctctttgtttcgttgttcacagggcgggccggtcggtggggcaaggcgaggcgggataggaggaggtctaacggccggacacggtagcgctgggcagcagatagcggtgggtgcggaggaggctgccgaggcggctctgggcaccaccgaggcacggcgcgccgccaccaccgtcgaggccgagacctacgtggccgtcacagagtcgtcctccagcgccgcgcaggcttccgtcgaggacaggatcgaggtgctacaggtccagctccgccgcggctgctccggcagcggtgatgggtgcgaccatccatcgcgaggagcacacccaaggacaaattcgtcgttctccacatcaacgtgtcaatcaatcaatcaatgcatccatccttctagaacacgatggcagcagccactgcaacggcgacggcaacgaagctggcggtggtggtgtacacgaaggagccagcggggtcgccggtcggcgcaggggcggtggccggggatctcgccgggggagcgggcagcggagccatcttagacgccgggatgggggccgctccccgggcctatgcggcggctgtgacggtcggggaaaggcgacagcggcgctcgccgccggctgccgtgcacaggctggccgtctccctccgctgcttgagagcgaggaagaagagacatgtttacacccaaatttggcacctaggattaaaataggaaagatgaccaaaatttagaagtctaccggttttctccgagtgggccgatctgaccgccgtgtgttgggcggtcagaccaccggttgagggctggtcagaccgccggtgtgtggccggtctgaccggcaggtccaagtccgactgtgtttcgtcgggtctcgaggtttccttgctcgggaaagcatgtttcgggtttcctttggtttctatcccgagttggacgtggaggagggcctgtagagggcaagatcaacccctatataagagacatggccggttctattgtaactaaccaatctacagtcaatcaattgaatcgtttttcatattgcttttagttttctcttagtttgtctatctttctcggtttgcgccgtaaaccgttcgccaccgctgcgagagtgcgacatctctttgtaggtacgtcacggtgaacgagacggcggagcgcgcgctgttctactaaaggcgaggccgacggcggctccactacgtcgtccaaggcgcccctcctcctctggctcaacggtggccttgtctgctcgtcaatccggtacggcgccatggaggagctcggcccgttccacgtcaagagcgacggcgagacgctcagcgcgaggatgaggtggccaccagtgttatcgcaccacgtcgtgctgacctcgccccactgctctctgaggccgtcatgccgttcccgacgatgtcaacgggaagggggaaaagaagaaaggagaaggagaaaaagaaggaaagagaaggggcaatccgggtatttagaaaactatctcacctcttttatccctggaaataataaaataatgcgaccggtgttctacggccaattatacgcatttttagtgtccattagctgtgttacgttttttagtgttttctagctaattacatgttttttacgtgtcctgtagcaaattttgccgaacaaaagaatagggggtatagagaaaacgaaagaaaaaaagaaatagagaacaaggagtgtgaaaatgaaaactagtcagctagataggagaagagaaaaaacagagaaaagaatatgggttacatttaaaatgaaaaaaaaaagaaatagaggataaggagagaaaacgaaaaaaaaaagctatataagggatacagagagaacgaaaaagaaaatagaggattaggagacaaaaccaaaaaaaaaagaaatagaagataaggagagaaaaaaaagaagttatataggggcacaattggggctcgaacctagcacctcttgtctcatactctctccatttttataacgtaagactttctaacattacccatatttatatggatgctaatgaatctagacacacacatatgtctagatttattaacatacatacgaatgtagacaatgttagaaagtcttacattatgaaacggaggaagtagctatgatatctccatcattaaggacttgtttagttggaaaaaaatttgggtttgattgtcacatcggatattaaacgtagtctaatgacaaaacaaattatagattacgtcaggaaactgcgatacgaatttattaagcctaattaatccattattagcaaatgtttgtaccacatcgttaaatcatggcgcaattaggcttaaagattcgtctcgcaatttacacgtaaactgtataattagtttttttattttgtacacatttaatactccatacatgtttccaaacattcgatgtgataggtgaaaagtttttattttaagaactagacaagacctaagccaagcaaaccttttgtaaatcaaagtgcatatttatggttttatcctatgaagctctcagcaccaagtagtattgcgctgagctcggatgatttagcaagtccttgccatcttggacggaatctcagtgctaatattagtggcgttaagatgttatagcttagcgccaagcatgatgacaataagtaaaagatttattttttatttagtttttatcatggttcaatcttcaaataagatttctgaaagaaacattttgtcaaattttcggccgctttttccactgctcagcctgcacatgtatcacgcacgggaccagacgcagtgtgaatggcctgataagacaagcgagggcagtacttattccagcatcgtgtcaattggcaagttgattacaacacggaaaatcgaaagaacgtaactcacttgaaatatttttatatttttttatgtttaaattgggaagagtaacatttttttattattctctcttatttgtttcttttactctcctatgaaaattagaaagaacgtaactttcttaattctttttatatatttttatctttacagataaagaaagaaaacaaaaaataagctagataggagaaggaaaaaaagaaaagggcaaaatttgccacaggacacgcaaaaaacgtgtaattggctgggagacaccgtaaacacataacacggctaatggacactacgaaaaatgtgtaattggttataggacaccggtcgtattattttattatttctaggtcaaaagaggtgagaaaatttttaaaatagcgagattgcccctgacgccatcttctccaatccgaaataacaaaagttttgtagctgccggcaaggtagctggcggcggcgaccgcgcgccaggagcggcagatggcgcggaggcggacgtgcagcgatggctgctgcatcgcactgttcttgctggtggcagcagcgcaatgcctcgtgctgctcgctggcgcagccggagcggcggagccacgcacgcgccagggagactacctggacagactgcgtggctcgccatcgtcgagggtgtcgctggccgtcgtgtcagccgaggatcgtagcgcgccatcactctccgataggtggcatgcggcgccaacgacagcgccggcggcgcttgggagccaggaggcggaccgcatggtgatgctgctagggcagccgaacagcctgggcttcgcacaatacgttgggtatgtgtgatggtggacgaggtgacggggcgcgcgctgttctactacctcgccaaggccaacggcggctccgccacgtcgtccaaggggcccctcctcctctggctcaacggtggccttggctgctcgtcactcgggtacggcaccatcgaggagctcggcctgttccgcgtcaagagcgacggcgagatgctcagcgcgaggatgagatggccaccagtgtcgtcgcaccacgtcgcgctgacctcgccccattgctcctctgaggttaccatgccattcccgacgatgtcaacgggaaggggaaaagaatgaaggagaaggagaaaaagaagctaagagaaggggcaatccggatatttagaaaaatatctcacctcttttatcctggaaataataaaataatacgaccggtgtcctacggccaattacacattttttgcgtgtcctatggcaaattttgcccaagaatagaatagaggatacagagaaaacgaaagaaaaaagaaatagaggataaggagtgaaaacgaaaactaataagctagataggagaagagaaaaaaatagagaagaatatgggatacatttaaaacaaaaaaaaagaaatagaggataaggagagaaaacgaaaaaaagaagctatataggggatacagagaacgaaaaagaaaatagagggtaaggagagaacgaaaaaaaaaagaaatagaggataaggagagaaaaaaagaagctatatagggggacaattggggctcgaacctagcacctcttgtctcgtagctatgatatctccaccattaaggccttgtttagtcgagaaaattttaggtttgattatcacgtcagatatacagacacacatttaaagtattaaacgtagcctaataagaaaacaaattatagattccgtcaggaaactgcaagacgaatttattaagactaattaatccatcattagtaaatgtttgtaacacattgtcaaatcatggcacaattagacttaaaagattcatctcgcaatttacatgtaaactgtgtaattagttttttattttgtccatatttagtactccatacatgtgtccaaacatttgatgtgatgggtaaaaagtttttgttttggaaactagacaaggcctaatccaagcaaaccttttgtaaatcaaagtgcatggttatggttttatcctatgaagctctcagtgccatgtagtatggcgctgagctcggatgatttggcaagtccttgtcacctcgcatgaaatctcagcgctaatattagtggcactaggacgctatagatcagcggcaagcatgatggtgctaagtaaaagacttagttttgtaattagtttttatcatggttaaatcttcaaacaaattttctaagagaatcattttgtcaaattttcggccgctttttccactgctcagcctgcacatgtatcacgcacgggaccagacgcagtgtgaatggcctgataagacaagcgaggggcagtgcttattccagcattgggtcaattggcaagttgattacaacacggaaaattaaattggatgatccttaaattggaagtatgtcagaacaataaaagagtggcagccgtgcaaattagctttatgcaaaatctaattcgcgcgcgctctctgttttgtcttgttgcgccacatactcatcggccgtccgatccaacaagctctggtgcgtctgtacatagcctggtgattcacggacgtgccatcatccagaggaatccaaattggaagccatgtgacgctctacgctacgccggcttcaaaaataattttctcttaaacaaatcatccgatctacgatccgattacaccgttgtgttcgtaagaattgaatctttataacaagatctcatatgattatgttttgatgaaaaattagaaattacttttataatatatctaaattacttttagatttcactaaattacttcttagacccataaaagtaaatttaaaaaagcctaaaagtaatttacatatattatagaagtaacttagaaaaaaaaataactttatcacgacattaaaagtaaatccgttatggaggtaaaaacatgagtctatatagaaattaaatttaatcagcacaaattacatcattgactaaaaatgattataaaataaacaactcacaacatgaatgtatagatttcttttaatgccgtaacaagttacttcacttttgttttaagttacttttataatataggtaaattactttctggctttattaaattaattttatgactaagaagtaatttaatgaaatctaaaagtaatttagatatattataaaagtaatttctattttttcataaaaatatagtcatgtgagatcttgttataaagatttaattgctatgaacacaatggtgtaatcagatcgtaaatcggatgggtaatctaagagaaaattctataagaagaaaaaaaatacatgcacttttgaatataatagtagtaactagatatgaggttgagaggtagctggttatgaccatacagagaacggtctcgttgtagacacgtcctagctttatctattgttgccacgtttattttgtagtcatgtctgatgacaggtagctagggtggtggagaccatttgattttttttcacgaacataaaaaaatataaacattaatatattaaaaaatagaaaaaaataagtagaacccatatatcagtaacatatagaaaaaaaaatatttttctcctctcatttttcatttattttttcaaaattaaaaacaacattttattctttctttttaaatttaattgttttctatgtaactgacatgtggatcccactgacacgtaagcgttaccgtggtatgccacgtcatctcaagaatcaggttgaagtctatttgaacctatatggcattcatgataagtttagggattcaaaaatatattggtatgccacgtcatctcaagaatcaggttgaagtctatttgaacctatatggcattcatgataagtttagggattcaaaaatatattttaatagtttagagatctaaataacacatctgtaaggactacccgtgtatttcactctaatgttaattgtttagttatgtgatgttcttcataataataatagggatagcatgggtattctaattaaattaattttctcatgcatgtacttataccagcattgcatctatcggcaagtcgattacaacacggaaaattaaattggatggtccttaattatgtcaaaactataaacgagttgcagccgcacaagttagctttatctatcattgccacatttattttcctacatgcgacactgtcagcacctggatctggacttcacgacgccgacggcctcgagctcctccccaacctgtcctcacctcgtccatcacgtgcacggtgccccgttacctcaccaccacatcgtcggcttcgctgccaggaactgccggcgcacggtaccggtgaaggggtatcctcgccatcacgggcctcttccttatttgtttatagttgcgccaagccgccactgccaccggcgggggaggcggtgacctttgaacgacgccagcctctcctcgtcgcccaccagcttgctggccttctccgccaccagcacccagtgtttgaaatttcggttcgaaattttcaaaatttcggaaattttgaatttcgccccccaccgaaatgctaacatctcgcccgaaaatttcggtttttttgtatttttttgtgaatttggttacattttattcaaatttattaaaaatctgtcaaaaattcaaaaaatttcatacgaattttttccgaaatttctgaaatttcaattctatcgctcagctgcggcagaaatgctgatttcgaaatttaaaaccctaccaacaccctctgttggcaccgccacctgctagcttgttggattaggaaagaagtttgatcctaagagcaaagctatcattttgcaaaaattatctctccaaaatagcaagaattcatacaataacgtgtatggtgtctaccagtaaattaccacgtttttgaagtgtcctcgagcaaatttacattcttgtggtgtctcccaacaaaaacaacattttttgagtgtcttgtagcaaattttgcctaaattctaataggtgttatattatgatagtgcttgctaaggcaaatttgcacatagcattttttttctaaactaaacatttggaaagttattgatagtcaattttaaaagtttgatcaaatcttgtgatatttgagtttattgcaatatcctttttgtgtcagatgattgaagaatatataattcttatgtgtaggagttacattagaatcgaaattttggttcactgttatgctttttctaacattactattctcagaaaaaatgcaaaaaatgttaatgctttttctacctttaggaggtatgcatttttaaagtgatagtagaatacccatgcaagtgatagtagaggtagtctcttcactgttatatatatctgctaaactgttggagccatttatatcgtgcaatattatatctgctcctgaaatgtgtcttaactaatggcataccattccatatgcatcaattaattggcatataccattccacaactcaatggtcctagcaaaaggcgagttaatttgcgagatgggcttttctgaatggccttttttgaatgagctaattaattctttcaataagtacactatataaatagcatgacagtatacctggcctctatataaatagcatgccgcagggtgatcagtgtgttgcctagaattggtgtgttgttcccatcagaaaatacaaccatgatcaacacggaacgtgatttccacatggtcggaggggaaggagaaattagctatgccaggaattctagggttcaagtaactactctatctatctgtctggctgtcaatctgcatatatctgtctctcttactcactaacacatatgcgcgcgtttcactgcttttttccttaaaaaaaagagggtaagaggtttgcctcatatatattgatatagcagagttacttgctattgtgatacaaggtattttgccaatcatctgcatgcaagttatgaggtctgttagaacaatagctttaatttatgatagtatcagcaaacaagtaaactataagttgtgatagtgcaaaggtaaactaggttgtacccatgatgcatgattgcatggagcatatttatgaatttgaaaccatataaaattcactgacttcattagttaccaggaaaaaaaatgcttgtacagcatacaaagacaagattggaaattctttttgttggctcctagtatcgtacctgatatgaacctagaagtacaatgttttacgtacttttcatccgaagattaaagtggattaaagtgtattccttatacaccagttagaatagagggtatttgcccggcgaaaaagaaaaatagagggttttttcctctatccatggcgatcaagggagctttactcaggaatcattaaaaagaaattctgatgagtacagctttttggcttcctttgatttgtagagaaaacgaagaaagcaataggttccttgatatagaaagtaacatgtttcattttttgacacgaatgaatcgatgttttctttctttttttatcagattgatcaatgcacaatatttaattatttgattatgttatactcgaatttaattccagctaatgatacatcatatattagtagcaataattaacaatcttttcacatgcatgtacgctgttagaacaaggctatgatggagactaagtcaatcctcgataaggtaacccaagaagtatacactggtcttttaccacgtaacatggttattgccgaccttggctgctcttcaggaccgaacacattgcgttttgtctcggaggtgataaatatcataactaagtgccaaaataagctaggacaacttgatttaatggatcttcagttcttcttaaatgacctacctggtaatgacttcaatcacctctttcggacattggaaacgtttaagaaggcaaatgaaacaaatcatgaaggagaaatagtacctgcatactatatttgtggagtgccaggttcctattacacaaggctttttcctcaacaaactattcatctctttcactcctcgatatctcttcactggctctctcaggtacgcaataaaattaatcaagtgtaacatctatatatagtactacaagatgttcatacacatgtggtctctgccaatgcaagtcaaatcatcagcatgatactttgagttaattagcagtgctatcatttacttaggtgcctgaggagctgaatggcaggaaaaaagtgtacctaaatgaagaaaacatatacatcacaaagactacaccacagtccgtggtgaaactattccaagagcagttctacaaggacttctccctcttcctcacgttacgccatgaggaactcgtgcttgggggccagatggtactgacattttgtgggagaaagaatgaggacgcacgcagtggatcagaactaaacaatctctttggtttgcttgcacaatcactacaatctcttgtcgctgaggtacatatacaattatctatgcgaatttggtgtcactctctcaagatgcgatacaagatacaccctctatccctaaatgtttgacgccgttgacttttttaaatatgtttgaccgttcgtcttattgaaaaaatttaagtaattattaatttcttttctatcatttgattcattattaaatatacttttatgtatacatatagttttacatttttcacaaaagtttttgaataagacaaatggtcaaacatgtttaaaaaagtcaacggcgtgaaacatttagggaaggagggagtatatcatatataaaaaggaaattttcaggtgaatacatgtaattaaaataaactctcggcatgtatataacagggcttggtggagaaggaaaaccttgagtccttcaatctaccactgtatgggccatccgtcggtgaggtagatgaaatagtgaagaacgtcaatttgttcgaaatggatcacatcaatctgtttgagtgtaattgggatccttatgatgactcacaaggtgatattgtgcatgacagtgccttgagtggcatgaatgtagcaaagtgcattagagccgcactgcagcccttaattgcatcttattttggagaagacatactcaatgcgttgtttgaagaatatgctcaccgtgttgccaagcaccttgagaaggagaagggtaagtttgcttttattgtcgtatctttgaagaaaagatgctacataaagatcgggagctagtactcgagtatatcactaaatgtattgctacgttaaacatatttcatatctgctacttgtttgtttctttcacctacttgcatgttattgtcctccctggatgtatatgtgcatgatcaaatatggtcattatatttgtgtttccttgtatctctatggatataaataaaggttaattggatccgtaccattataaatttatctgctaggaataatatcattgctatttaataatttgctctaatgtcattacaattttatacttatttaaaatatatatataccccgtacttaacccttcactatattttctaatatttttagaccaaatcaaccccttctccttgctcgtcctctcatctcttcaatgggtctaaatccaatccaaatccgcaccaacccaacacctcttcaaagcagctcactcaaccaatccaccccacttcttcacctctgggacccaatccaaaccagtccacaagcagtttcaggccaaaccaacccaaaccataatagtcttagtggattcaatccatttggaatccatggattcaacccacatgcagtccacaacggtgctaagcgcatcgctcaatggccgcacagataggaatcgtacagcaaaggccggaccccaccatggacttcttcgataccaatcttgcgaggaagaacgtgacatccacacgcagcgatggcctgcttcttttttaggtggatgaaatcaaggcgacggcgagcaggacgaacccgacgttcgcggcgctggcgctgcgtttcgccgttcgcgtcgagctcgccggccaccacgcagagcccgaacggcagtaggtcgagccccagccatggccgcggtgtagtttgtcgaaggatttgggtaacgtgcacgtgaagcgccgcgacggcgcggcctccgccgcagcccgcagcaatgcaggtgaaccctcactcctgtccgcatctagccggctagcctccgaccgtgctgcgctctcccgctccgccgcgatggcccatcccgccaagcacgcgccaccagctcggctgctcctcgatgcgctccgcaccaccaccgccgctattcgcgtgcgtgcgccagctgcgctctcccgcgccgcctccgagaagatcgccgtgccgcggatcgcaccaagccacgccgtgccgcctccgccgccgccgcctcaagcacagtaggactcaggccattcagttcatccactcctattcctgggttgaaccgatgggtagaatccatttttgacccaaaaaatttagggaaaattggaaccatgccattataattttgtaaaatttaagatatgtcatcctgacccacatgtcattgactcatgtaggtcctacatgtcattgagataccgatggcatatctcaaactttgcaaaattataatgacatggttccaaattacccaaaaatttattacgacatcgaaaccaatccaacccatatttcagtgagtccaaatcgctccaacccattccaagtcctaccccatttcaatccaaccgaagacggtccatttaaaaacccaacccattccaccatttacatccagttgtcgtcctcctgcatcaaaagcatcatacggatgccacacggcaccggaaagcttccaccaattgaggtgcttgaacagggtggattgtatcaccatttgtgtgagacctgcggcgaggagccctctcgaacagtgccacccccaacaccagcatgtcgaagccctagctcgtacagcgccaccacctcgtgcttgcgcctctcctccttcatttttttgcatgatggcgttgacgatgacgtcgaccggcacgaacacaaccttacttggccttactaaaactagactgaatttagaatctaacaatcgatgtcaaacgtaatctattcgccacaaaattatctacgacaactttattattcgatcgagataaagtttaagattgttattaggctgtaaaagctccttaataaaatctaagtttggtgaaactagtggtaagaaatctgatagagtaaggtgcgatctacgtttatcccaccaccaaacactacatcaaaaactgtaaaatcaaagtgtttttgattctttattctgtgatgaacaagtggcgtctgtgattattggttttgatacttagagattattggcgaagtggttttggagatgattggtttttacaggtgatatacaggtgctgctggatatgtggtccggttagaccgggcagtggttgctggtcagaccggcgtgtatcgcgcggtcagaccggctagcccgcggtctgaccggccgattctgtatttcgggttgtttgttgggatatccgtgattgtttcatgtttatggcttctagatggatactatgggtatgtaatcactacactggccacggtcacctgtgacgggcccaaaccatcacctttgacggctttgagcatggtcagtgatcagtggtcactagtgagtccagtcaccttttacgggtggccggccgtcacaggtgacacccacctctgacgggcaagttactagaaggccgtcagaggtgttggtctccgctagcctagggccagttgagacccgtcacaggtggctcatctctgatggccctttaagtaaaggccgtcagaggtgatggtctccgtagatagaagcggtcacaggtgatctacctgtgacggccccgaaagtaaaggcccatcacaggtaggtcacctctgacgggcctttatttgcgagtccgtcataggtgaggttacctttgatgaattttggttccgacccgtcactgatgtattaattccagaaaaaaaaataaatgctaaatattggctagccctaggatttgctagccatgccctttaaaaacagaaacatcacaaatatattccagttacccccctaatataacatcacagatccatctcaaacatcacagatccccaacatcacagatccatctcaaaaattgacatcattcacatatgcaattcaaatgccacaattttgcacagcaaattcataccccttgaaagccacaatttcggtcgttactcatagaactgcatatatgcttaacaaattgattaaagccataatgtccttgacctccacgacctgtcaattagaaaaaaaggagagaacaaatgaatagtacaacgtaaatcgtagttgatcaaatttgatgacaatttagcaaactaccataaatattgcacatatgaaagtaaattacattgcactccataatgtagaatcataaaaacaactttttttacatcacaagaatttatctagccaagtttatgagtctatttgacatgaaaacatcctttcttgttcattatttccgcaagaatgaaggtggacacttcgcctctaatagcgggagggttgatgggtgagatcttcaagccagctctacctttctgtttaataaatcagagattagcacgtttagaatagcaatgttggtattgaaatgagcttattcaccattagcaacaacctcagtgtcgaaatctttcacctctcttagaagtgttgacatgttgtggcacacgtggaaaccacactgatctccgatctgttgtgcacatgcaaacttggtgtcatgatagagttcgtccttaccctccttgtgcctaccacccttttccacatatgggccccaaaccatatttaaggccttggtgatttcagtgaaatcataatctttcgtcttattggagttaaggtaggtaaccctactccacttaggtacgatgactaaaagaatccaatgttgcctgtgcggtggttatgtagcattagtaataagaaccttaacttcaataacaatatgcacaaagggtattgtcctcttaatcctggttgtgtgtacacatgatgtactccttgtcttggtgggcccataaacaccggttgagatagtcaaccacatcagtgaagctctagagtaaattgacctcgttcaccatggatggatcatggaacccaacctaattaccaaggcgacgacgctcgatccaacacaaccttaaaacatttacgtattagaactaacttaattaggagatatagtccaatcatatcacaagtatagaaggtctgcacttacaaggagtagcattttagaagtccagtgtccaacttccggatcctgaacaagtcgaagaggtcatcaaagcctataattatataggcaggcgacgataggaacggctgctggtcgtgatgtccaactatggatgactccctcattttccgcttggcattacttagctccatgtattgcctatatagctcttagcaagcaatacccatcacggctaacacattgtcctccaccaatggcatgcctagttcaaattgggctggcgccctcacgacctttcccgctttgctcaccgacatcgatgtagcagccttgcccctttttggcaccggtgccaactccccgatcttccccttgccgcgttgacgcttctggcccttgacaagtggtggggaactatcggcctttcttgtggtcttaattggagccaagctttgagctatatctgccaagtccatagcagctccactaggagaatgaggtactgacaatgccgaaccacggggagcctcaattgatagcttagacttgggaggtgtaagctccgtcggttgacttggacgaggagtcatcttcacaactatgtcttctttgggccattgtatgaacatcttgcgcgcatcgcccaaagtcatgatttcatcattggggggcacaggcagcggatagactgaccaggtgtcctttactgtatcgatggacaccttggcatacccagctagcaagtctgcgttgtggaccttatctataaccgagggtttgaaagccatgccctcagcgacttcgggagcgaaagttggttggaccctagccagtaggatacactgtgctacgccctgcatatgtaaagtttgaatttaatattggaacgtgtaaaggtttttgattagatatggatcggataacatcatttacctctatgtggtccactgcagctagtggtgcgaccgagagaccaggtgccggcacctctgtggatgcacaactactcctacgctgtgacagactcgcgttgtgttgtgcacgaggagttggatgcatagcgtgtgttgtgcctcgaggtatattcatgtcggcgaggacctttttaaccctttcttccaccctagcgtccatgcttgcttctagttcttgaatgacctctaccttaagctcggccttcaaacgagcgtctctctcttccttggagactttccgtttcctatattgggagctgtattgtggcagtccatgcttccagggcacatcgctgccaattccccgagtccggccaggatgttctttggttccgagcgcctttgtgaggatgtcatcttcgcgcctcttcggcgtggactcaacctcgctttgtgaagcttgttcagcaaccaaccccaactataaaaacaagaatcgtttattcaaacttctacttcatgcgaacggtaattagttaggttaagtagtgaactcaccagttcctgatagatgacggcagcacttttgttctcaaatgtgacagagtcgttcgggttgaccttaccacatgcccgcgcccagttgcgagctctttgttcagggatgttcgaaaacggggcagggacattcgctgctgcagtggctgcatcctcttgggctcatattagctccttgccgatgtacccttcggtgcccagccgatgcgggtgctcgagaagctcctagttaattacctccgtaggtctaggtctgcgagagaacgtccgattaagctgtctgtggtcttcttcgcttcgcactctccatacatggtgtgatagtggtagatgtgcagatgtgggagccagcagcgatccacggcctcgtcggtccgtgcgccgatgttggtgaaatagtcttagcatcgtcttcacccgccctcgtcgtctagcctcctcagtcttaaacgacatgttggtgtagattgcttgatgaagacatgcgtggagctgcgtagctcgaatagcttgatgtcacaacagttgagtcgggattatattaggaaagggagaagtcgttggagatggtaggtgcagatagcggactccacttagtatatagcgatacacatccccacagccaagtgagtatagcttagtaataaagcatttgattgtttttgtgtgtcactgtagtgtacagttgcatgcatgcacaagcatacacacaatgcagtgtacaacactagcatgtgaggattgtgtcacaatatatggctccgtctatatatgacgcgctcatctccggggaccttcacggatgacttggccagtggcttcacgggaaaaccccgaccacacggatgcataacgcgacgcctgcggcgatgaagatggagagaacacgtcaagaaggaggcagtgccggcaaggatgattgagtagtcatcgacgatgcccaaagagaccgcgacgagcgtgaaggtgtcgccagccagtggactctcagtgagacatcctcactcctcattgttgttgcaaaatccaacatgcatggcaagggcatctctcccataggagaaaacccaagcttggtcccgagtggaccaggagagtggatggaagagggtcagaatcagtggaatgggggagagatctccctctcttgcccttggagggctccttttattcatatgtaacagaaaattacttctttgccattgatttattatacatatacaacacccttttagaggtattttagtcattttatacattagtttatgcaacatcctaagtatggggttattccccaacactcactcgacagacgacgttagcagtagcgtctgaagacaccatcgtgtcttttaggtggtgctgcagtggtcacaatggcggcatcctcggtgcgacgatgtcggcatgcacgtcggccaccttcttcagcgggatggcactcggcggacggcatcacggtggtctgacgggtacgacaagcgttagggcgttgcccacaaggaagacgagataacctcacggttgacagcggctccgctccatggggacaggtagcgtaggcggcgatcgaccgacaatctgacatgatgacgatggcatgccggccggcggcctctgatgggatggcatggacgagcaccgcttggtagtgcttcagtgactctatggtcttcacaacatggttttaaatttcgaaatcaacatttctgtcgctggtgggcgatagtaccgaaatttccgaaatttcaaacaaatttcgtatgaaattttttgaatttttgatagattttgaataaatttgaataaaatttgaccaatttcataaaaaattgcaaaaaatcaaaattttcgggcgagatgtgagcattttagtgggggcgaaattttagaaatttcgaactgaaatttcaaaccctgcttcacagacgcgggaatgataacaatccggcctaggtggggttggccgaggcccaacaaattaaggttgaccagaccccaacagttcttagggacacccactcagggaaaggcccaatctctctaaaagactagtccaataggggaagggtggctctctcttttaaggtagcttcctcctcccaagctaagcaaggtgggattatttagagcctcacacggtcgctgtccgacgttggtgtctttgccagcgggtaatagtggaggatgtcctcatcagggcagcttggcggcatccgcgttgttgtcaacaagacctcctgaatcggcatgaggcggcgtccgcggctactctgacgatctccatcacgatatgacgaggtgcactactggagaaatgctttgtactcctaattggtaacccctgtagtcccggttttctaaccgggactaaagtttagtctcggttagtcctgttggttcaaatagtcccgttgcttttataaaccaggactaaaaattgttttttgtcccgatttttaatggagcctggactattgtagaatttggtcgaccgaccaaaagatggtttctccagtagtggtggcgtcacgatggcgattagtcgacaaaggcgagcactgcttggcagcgcttcggcgactcaacgaaacggttgatggcacggatggagtagatgacaccgtgcgggcgtgagtgttggcgctccggctgatgttctcctcgagcggctcgacgatgagtgtgaggaaaatggcaaagccgacgagggcaagcagacgttggtggtgtcgcgaagaggaggctgcgaccggcaagttgacgacgtccagcgtctcgatgacatatcacatcgcccagctagagacgtcgtgaggtagagattgcggccggcgaggcgaggacgtcgcggcagcaggtacatgtgtcactggtggccggcgtctccgacgagagggaccaacacgatctccggcaggcagcaccggcaactcgtctcgtcgccatctcgtgcacgcatgatgaactgaactgaaagagaaagaaaacaagaagaagactcaagaagctatatatatccatggcgatggctgactacgtacgcgctcccctccgtgttctgcgcagccgctgtccacgcgttctgtccggccaccggcgtgcagcgccttgtcaccaggacgatatatcgatggctgtgctgtcgcgaggtgtagatgggctgtagctgaatatcgatgaaggtgtggatgattctgaatcggaggtggatgttgtggttgtgcacttgtgctgtggagtgtatgtgaaatggctatgtgtagtgtgaggagatgaaaggaatggcagtggatgatctgtgtggaatggcgcctgtcgatggcctcctttttataggcacaggagtaaccctaaccagcaccggccgcgcactcctcggcgccgccgcggccacgcgttggtttgctccgaagcctccgggcgccattgctgcggatatactgtgggccggcggcctgtagttgcgcttcacgctcatcgtgtatatgcggccggatatccacgcctgtacgcgtacgcggccaggatttctcgccaaatggcaacgacctacaacaggccgccggcccatatatgcagcttcggtgttagtcccagcttgccgctgctttaattaaacccatggaaaaccatccggcatacatataagtatacgtatacggtaggtgcacggccacgagaactcacgtataactgtacaagcttctcacatgtcgctcaagtcggggggcgctgatgcgcagctagtagcgcggccgtgcacgcgcgcgatcagctgcctccctctagtctctcttcttcgtatcactatcgctacttacttaaaaaaataagaggggcttctatagttcgtcaaaaatatcagacgaaaaaaaccgagaaaaaaaaaccggacgaaaaaagtccgatccaaagacggagtgataaaaaaaagggagaaaaaaaaagtccgataaagaaaacggagcgaaaagaaagggcgagaataaaattctgtccgacccaaaaaaaaataggaacctaacgaaaaaaacgagcgaaaaaaacctggtgaaaaaacagtccgatccaaaaaaaaatcggagcgaacaaaacgggagaaaaaaaaatatccgacccaaaaaaatacgggaaaaaaaagcggaaaaaaacgaaacgagtcagtaaaaaaatagggcaaaaaatttaaaaaattgtttgattccaaagaaaaaggaattatatgtgatatggtaaaaaaatcgaccgggcgaaaaaaaccgagcgaaaaaccgggcgaaaaaataaaaaaaagtccgataaaaaacggggcaaaaaaaaaatctgtccgatccaaaaaaaaaggaaaaaaggggaagaaaaatcgaaatccaactctatcgacacggtaaaaaaagggctaaaaagataaaaaaatatccgattccaaagaaaaacatattatatgtgacgcggtaaaaaaatcgaccgggcgaaaaaagaaacccgagcgaaaaaccgggcaaaaaaaaataaaaaaagtccgataaaagaacggggcaaaaaaaaatctgtccgatcaaaaaaaaggcaaaaaaaaaaggggaagaaaaatcgaaacgaatccaactccgtcgacgcggtaaaaaaagggcgaaaaaaataaaaaaaagtctgattacaaagaaaaatgaattatatgcgacgcggtaagaaaaagaatcctattatatccagaaaggtccgacactgtaataaagtggtgaaaaaaaccgttcgtaaaaaaaatgcacgagaaaaaaataaaaaggcagaaaaaagcgcggcggaaaaaagtctaatttctattcgttgttttagttgtccttttatatctcttctttatctctaatctaatataacctaactatttaaaaagagaagtttctaccgtatatttaaaaagaaaaaaatacgcgagaaaataaaaacggtttaaaaaatgcgtgaggaaaaaaatgccagaaaaaagtgcaaaagaaaacacgctagaaaaaaagttctatagtccaaaaaaaacacatgagaaaaaaatacgtctgtaaaaaagcaaaaaaaaagcatacgaggaaaaaattgttagaaaaaaacgctaaattgatggacacttggtcggataggctccatccactttttttcatctcctacacgacttttgtttgtcatctattctcctatagtggagaccctgcacatctttataggcaattatcatactattttttgaagtatagctattattcttgataacatattatatggaaataatcttagaaaataaacatattttaattgttatttagagaagagtgcacagtgacactattttgtgtagacttgaccatacgaggcagtgtaggatttgattggttgcaagaatgagattaaaagaatattttagattatatgcatgttgttatatgaataattcaattattggtaaagcaaacatcttaaggttgccatcatcgaggttgggctattacatttaagatgttccaattttctgattgtcattgacatggttatgaatgaaaaacgtatattatcattacgtctttttcacccgttgcaatgcacgggcatgtttgctagtatatatactatatataaaagctttgtataagcgtatacaaaagtttatatacgggtatataaactttctgtcgtatacaaagtttgtatacgtgtatttttttggtttttatatgtacgtataaaactttgtatgcacgtacgtataaaatcttaaaaaatatgcatatacatttttttatacacgtatacaaaatttatatatgtacgtataaaaaaccgaaaatactgaaaagatatggaaagaaaaaaaggaaaaaaaagaaaaaaaaagaaaccgtgcgctgtgaaaaaaaaaaccacgggctgtccgccacccttctctccgcacgtgacacgtgtgcagtcacaagggggagggctcacgcggctggtcgctaattagcattctcggctgaacaaatcaaatatgcgcaacatgtcgaactctcccgaccctgcgaggcgagctagcgcacgcaaatgtgtttcacctcctctctccaccacacatgcttcaagtggctaggagggcatcctcccttttaaggaggtccccctctcctagaataagtaaggtggtactaaactttacatgcatgccatcccaggtccccctctcctagaataagtaaggtagtactaaactttacatgcataccatcccatgaggtgggcttttgtgattttccaaagaattaatcttcgaatgggccttagcccatctattaattccaacagcatacgtatgcaccaatcatgctcacatatatgatatatgtgattgtaccgcatacatgcgatcttgtttgcttgatgtataaaacgacgaaatatcatcaaacaaatatttcatcgctcaatgaaatatatttctaaatagtttgatcagatgcactgattgcaacgccctgttatgtagaacatcgaagaaaacatagtgcacgtatgtacaaaatcctagtaaaaagatgatgaaatgctcaaatacagcaaaatggataaatgatggcctgaaacaagcccatcatgcggcttcttcctctatttcaatgattggatctgtcttcttctagagtggttatatctgccttcttcctccactatggtggatggatccgccttcttcctctggcgtcaccacatgcgtggccagacagagatcattggtggcaaactgggcctccataatgagagaaatcaatatattgtcgtgatatgagaggacttgtttgatttgtcgccaacggtggatgagatatacccacacacaacgaaatgccattgatagagacttcattcacgtctgtgtactcgcaacagcatagattgtcccacctgtatgagttgaggctctgcaggaggttcggaaatgcagtggagcgtcacgtcttatttttatccccgtgtcatttctctataaaaaaatgcaacttttatacaagtgaagttcaattattgatttgctttgttttttatttttttattaatctagatgcatcattgtgcttaaatacattatatataatttataatttcacattggtacgtaagaatttaaaccaaagcacactttatttcatgtaggtaagcatttagaccaaaacattctctctttttttaacatttaaggttggaaccttacttgtttcgccattagaaagaatatatgttaaaaaaagtgattgatagattacaatctaacaattttgcttcttctacctttattttagcttcctaatcttacatggtgctattaatttcagtagcatgaaattaaacatccaagttccccgaaaggatcaatgcatagattagtcgcatggtcgaatgtgtttctagctaccactaaaaattaagtaccaccgtcaagttatttgctgatttactgaacttttttatcatgctaaagtatcactgcctcagttaccggctatgtttcttcaggaatccaatattttacacgttccctcgcaactaaattagtgcacaccttatccacttatcctttttccgcaccgctcgaatcccttcatccgtggttcctcctatgattcttttcttccttctatggttactgttctgtcttcacccggtgacgcaactgacttgggcaccatctacttactcctttaccttctcttaaaccagacgatggcaagctaatcacatcctagtggcttgtagggcattgtctttttcatctcttcaacaacatgttgctcccccctaccccgcctcctccaccacggcataccagtaagcctagacttttgtgttccgatgacctcctcccttgctgattcgccctaccgcctcttcctctactagactaccacgacaagatgcttacaaccgtgggctcattcttcctagtgagatgtcagtgcccattttttcctcctctttatcagacccagataggagtatctgtagaaacttccactgatttgagtagaaagtgttgatttttttagttgaaacatttcaattgaaatacttttgatttgaaagtatagggattttggttagaaagttttgagtttttcaattgatttttttaaaaaaatatttgaattgcaagtttagcccacaacttaaaaggtttttagatttttaattgaaaattttgtcattttttagatgaaagatttgatattttagttggaagtttcatatttcatatcaaaagcttttttttacactgagttgtagttttaattcagcctagaaaaatgcctatgcgttgcaataggggaagataattttcatgattaataaaaactcttccaatttcaacggcaaaccaaaacaagacaaacaaagcaatagtaatacaaagtcagaaatcatgtatagtattgtactcagttgcgctcgcttcattcgtcatcacacaaaaaaatccattactacacatatcggtagcctcaaatcgatcaggtggctattccataagttgacacgtgtgtgttctgctatacgtcattgatcaaatatttaaattttgattattcaattagtgaaagtttttcacctgtagatggaaattatttgcaaagtaacaaactttccttatacacaacataatgataattttaaaaggaagatatttatgagaggaatttggaagagaaaaaagagggaaaaaaaagaaaaggaggataaaagagaggagatagaatggagagggagaggacaagatgatcaggagaaaaaaaggataaaatagaaaaaagatgccatcggggtagagacgcgtgccgccaagttagggctttcaacgagcaccccaatagattacagacagaccataagtatccgcatctgtaaaaatcaaatctcattttccaatagggctcctaagacatccgtataaaaaaatccatttttccagacaacccacttaaaataagggtattttggcatctcgggctcttaactctcccgcatgcaaatttttattctccaatcctctctctctcccatcaccccactccactcctctcttctcccagcacacaaacacacactctctctctcccactcctctcccacactcctctccccactcgtccgtctcgggagcaggctctagcggcggcggtagcgatggcatcttcctcttctcccccactcctcctctccactctactccctcttgacggcagtggaaggcggaggaggcatgcgacagtgtggatccgacggcggccacgctccccatgtgcggtggggacggatcggacggtggggaagtgcagcagcggcggatccggtggtggggaggcacgagggcgtcggatccggctccggtgacagtgacagcgacgggagcgggataacctagccgcccctagccccctacgcccccatgacgatgtcgacgacgatgaggatgaggtcgacggcgacgatgacgacgacggcttccagcaacgatggtgacaacgaggaggacggtggcggcttctagggttagggtttagtattttttggtttttatttttttcggatttttatttttgtgtgctgacgacagattttcgcgtgcgggtacaaatagtgattttcgcagaccattcggtgcgtgcgtctagccctactgcatgtgaaaacccctttcaggccatctgcaaaaaatccttttttaatagtgttagcagcccccatatttcctctgagatgagaataagattaaatatcaatcgcttttccacctatgatttgccataattatccgttaaataatgtattttttatgagtgatatatgatcgatcgatacttctccgtaatccatatttgttatattggttctgaaatctatctatctatctatatctatatctatatcaatatctatctatctacctatctatctatacctatactaattagtcacttcctacgagctcacatattaaccagaaaaatctagcccttgattaactagatcgcaacatctcaaccattaatcactatgtttaatattatgggcttctttaagagtcaatctgtttaatattatggcctatttgaaagcccatcttgaaaaaaaaaaataatccaatctgttattgcctatacccgtacgtctatctatctatctatctatctatctatacatctatacatatactaattgggcacttcctacgagctctcatatatattaaccagaaaaatctagcccttgattaactagattgcaacatcttgaccattgatcactatgtttaatattatgggcttctttcagagccaatccaaggcctatttgaaagcccatccaatttgtgttttgaaaaaaaaaatccaacctgagcctctcgcaacaaaaagaacagaacgcgagacagtatcatgaaaagcagctcccgttgcgcttcatcctgatcaataacgaatttggactccatccgatccaattagactgtgagcaaatgggaacgtacatgagcacatgagacttccgctagaaagatgggagacgttctaaatacactttgttctgatttgggctccaactgctgctgattatatcagggatgatccttcccagctaaatcttaggtgtgattttattatttttttaagctgaaaactctacagaggttcgacatgttctatgcgcatctgcaggtagcttgcagtaatgtttttgtttcttctgttgcttctcccgtcttgcacatctcagtgtgatttgctgataggccagttctgttatgtgatttatgttttatagcaacctaacaatgtatgatcagtctagaatttgcaatagatcgactacttcattaatttgagtgtgggcactgcgtatgatcagtaattaaaatcataggaaaactctttcttctttaagaaaggaacaatgtattttttaagacagaaaactataattttttacaaaggaaaattgcaaattcacacaaaacccaggaactgctttatatttattaattacaatttcaaaagtaatagatcatgtataagggataattgagacttcaaactccgtacttattaatttccaatttataaattaaattagtaaaataactaaattaaaattccaacatggcataaaatgtcgacatatagttaaattatgattttttttatttttataacaccgacaataataacccatgcaatgcacgggtagacgactagtaattctaattgtttaattagcagtacagtacagtagaacactagagggcggtacagacgtcaggggatatgttacatcctgaccagtacatctgccgacaccacgcactaaaatgtcgtcgcgcctcaacatggatctacagtcaaactaatcgatctacagtcccgtcttcccttcagtcccactgtcgctagcgacaccgaaacagctgaatattaatcatctcgctaaattcgccgccaatttagtggatctagctagatcgtgccattgtcacacgaggtcacgacttacgcgtgatcaattgtttaattgaacctctcgattacgcgtcatcgctctcgtactgccgaggaggcagactgatcacccggccggtcgtcctgctatacgcttgaatggaaactggatattggatagacttgagtagttctcaccttgttgaatgctgtgtcgctctgggttttcttatccaacgtttcatttcaagtgccgtgtcccttcgtcctatttcaagtgcacttgtgagttttcgtatttaacatttgaccgtccgtattatttaaaaaatctattatatgctaaaagtccatgaaacttcctacaaacgctctcaagccgccatgtaggatttctataaacgctcctaagccatcatgtggcactccaataaattaaaaagattctaaatattctaaaaaatctcaaccgttgatttccccttaactgcaggacccactatttaaattgtagatgtattatgtttagaaatagttacatgtacgtactccctcctctcccgtgtcctcttttttaagctaacctctcctattttctagctaacaattaaataaaaaataatttaattagtatttcttaatttagacctatattaaaaaaaatatggtacatggatgcatattctaacactgtacataccataaaccgatgtgcaaatattagagtacaatttaatatgtggattaagaaatcatgcacttcttttgttccaaaattataagtataaaatataagcatatataaaatattgacataccaaacgtgttaaacttaataaacattaccacatacatacttaaaaaaaatcgtagcaccaacaagtacattgcacacatatagcactctaatcaacaaatccccaatttcaacggtcaaattcataaatttggggaaaaaaagggttatagaattattctctgatctataaatttcaccaattaaaaccaaagaaagagaaagagtgggagaagatttttttttaagataatggaataaatcctggcctttacttcaaagaagctacaactacttattaatctcacaaagagaacaagcactcaggcaactacataaagagtgactaaaaaccaacacaaaggacaaaacaaatttgagagggggaattgaggagtatatcttgctcttcgatgtccccaaaagttcccgcaaaaaatgtctccaaaacgagtggattttgagaaggagaggtgagaggggagagagcaagagctcttctcaggcttgcgcatgggacaaggggggaatggatggggagagggaggggggaggggtggggcctgtcggttaagtgctacccaccacccaggaggagcgtgcaaaaggcactggcgccttggggtggagggggggcatgataacaccagctactctggcgtaccaaaaaggatcatttctagaataagttttttatgggtctatttttaaaataagtttttggaaaggaccaaatggtaaacaatctagcatctcaaacaccgtaccaaaatccaaatatacatatattttagagaccgagtacgtattgatctataaacacgtgtatctaacaaaattgcttaaaaataattaatttcaataaataatatttttggaaaaaactacgattattaaaggtacaattttcgatagatgacgccgttgaattttcggtacacattcggcagtttatttatattaaaaataaataataataatttattttttgacttggtttataacttaacatgacttacatttccacatgttttcataaaaatattaaataagacaaatggtcaaacgcgtgtaaagaaaatatacttacccacgcaaatgcgcgggttaccttcctagtttatgaaatagtcgcacgctataaaagacggaaaccatcatcacatccctaatttcattaaaatcttattgaaagcccagctacatgtttaatatttataaacatcagaatttaaatggtgagtgaaatctcatacaccaacgattctagtgttccctccccacgtttgaccaccatcagaaacagaaatagtaaccatcgatttttatacagccagttcctttactattgtcctgttgtttgtttcttcgttgctgaatcgatcaagatttgcatgggagtgcttgccgtacggagactgatagtataatcaagtaggccacctgcatgaaagcccagtaacgggccaaaaatcagagtaatcaagtttttgaccccgtagaaaaaaaatcggtttcgatgacgcgtaatatagcaatacactaacattattatagaaacgtactaaaagaaggactaaaaccgatacctataatacttttcccacctaaacacgtgccaataggacgccaacggctagaaaccggtacccctgtgaccaaatagttgccggtttttaactgaatcttcacctatctttcctgccagagaaaggtgcatgttccagcaaaaagctagcaccttttattctagggaaattttgctgtaggacacagtgactttgtgttttagctctaggacacatcaaaagttgatttttggcggaatgcattctgaaaatatggttattgactgatggacaccgcagacattaaaatattgatttctggttgaataggagagatagacagtgtgaaaggttaaaaatgcacctaggtccactagtcatattcttctgcaacatcagactccctcctggcatcatctgactccgccacggtggcatagcctggcaaaccctcagcgcatgtgggtggtggcacagtctggctaccctcagtgcacatgggcacagtgcggcctggctcgtgttgctgatggaggtgcgcgtgaaggtagccgctgcacacggagggagggagcttcggtggcgacacgaaggaaactgcggtgattccggcggcaagtagaggacattggggtggtgcgcaaccctcggcgtccccggcaatgcgtgaagggagttgcggcggcgcgtggccctcggtgaccctagatgcaagtgtcctcctccccgctgcggccggcttctctaactcctctattagcttccccttcccctccttgccgccgtcggttggcactatccattcgttggctttccctcctccttcccgacatcgctagcttcctctccccctctggtgaagacctcgacagcggcgctctgcgctgtgctctatgcacttgagcacacggcgtgccagggttaattttgtcctgacgcgtcaaaaagtgggccctctctcgcctagtcagcattaaaacactaaaataattagcatggtgtgctcttgcaaataaccaaaattacagagtattttcctccaaaagtgactttgtgcaacgtcttatagctaaaacaacgaaatctcaatgtcccgtagcaaaaatttacctttattctatcccatcatagtggttggttccgaggcccagtttagagccaatacttttgagacattcactcccggaagtagacattggaggacccacttaaataatcagtacctatatagctgtcaaacatatgtgtcggttctagttaagaaccaacaccaccgacacctatgagctctatatatagctcatccccttcctctcaagctgatcgagtaaagaacatattttttggtgttgttggagattgattgctaaaaggttatttttatttctcactccatttcactcttgcttgttgaactgaactatttgctatgtatatatataaagtgtgcaaccgaaacaattatttgtatttgttttctacggtaaatatttttttatctgttttgtttatttaattagatccatcctcggatgaccacatgacaattttgagtttaagtattgacatgacggtagttgattttgtacataatatttattattaggtgctttaaataatattcatacagtagtaaagagaagtgtaacacaatgttataataattaaatcattgaattgcttgtaaattataaaatccaaattgtatttatactgcatggtttgtaacaaaataaattattatattatttttcaaggggtggtaaatttattttatctttttcatgttcgttttattaaattacggctgtttttggtccatttcaacggaagaaaattggtctctcatggacacagggtcatagtttcttttcgataaaagcaggcctcaagctcgagttcgctttgtttatcattctgtcttgacagctcgcctgcacagttactgcaactgctgttagtgtgtgcccgatagtgttcgtttagggagtataaaccaaaatgtccacaacgctgtatctgattgcaaacatggcggaaacaaacgatttttgaggggataactttataattgcttccgaaagaatcagaactaaacaggtttgatgacagataattgacatggtgagaaaagcaatggttttgtccacaagcaaaggttttatatatcgtgctatacaaaggaaacgaatcttactgtatactgtattaatcatgtcactaaattcgccgtcatttcttggatctagcaagagttggtaactttttttagaagaagataatcacgatcgagacacctaaacgccttgcggtgatataggaaagctagactaagatgggttttgatagattaaactgactagcggagccgatttagatagaatgatggataactacccgtctcatgggcaaacggaaggtttatgggacaaatctacaaaggatttcgcattctcgcagcgaaggcagacgatttgtgacgcaaattgacaaagatggacgaactaaactagaaaagtatatgcgatataggaaaaaacgattcaatagcttgtatgtagattgtgtgttgtatattacaattgaaccggcattgtctcttatataggggtttgtcttgccctctagaggccctcctccatgtccaactcggggtaaaaaccaaaggaaacccaaaacatagcctcccgagtaaggaatctcaagactcgacgaaaacagagtcggtctcggactctgccggtacgaccggccaaatgctgcaggttagaccggcccatatatggcggtcagaccggcctagtagaggaaaccgacaactttctcaaatcttggcaattttccttgttttgaacctaggtgccaaattcaggtgtaaacgcatgccccctgcctttttgatgaataataaagcatcatattcggcttgattatttgtacaaaaatattccaaacaaaccgatgtttcaaagcatgtaccattgggcgaaaacaaaacatatcctcttccgccataaagatttgattgtagccggcgttaccatccaagaaactaatcaccttatgtcctgaagaatcattgatcaacatgtgggctataggcacggtaaaaaaaacatgtgagctataggcatagaatattcatctttaggagtaggttttttcaaatctctaaaatctatgcacactctaatcataccactccccttcttatcaaccggaataatgctagacacccactccgcataccgacatggcctaataaaccccaccttcaataaccggtctatctcttccttgacccgatcatataatagaggattaaagtgacgaggtggtttcttataaggcctaaatcctggttttatcgaaagccattgttcaacaagatcagggctaagttccggcatctcatggtactcccatgcaaagctatcaatgtattctttaagcaactcgattatcttaaccttataatcgttaaccttataatcggctttcatgtttttgtttacaaaagtcggccttggtatatttccatcacctatatctatttcctctaatggatcggccgatataaacccttttcctagcttttctacttcatcaaaatcttcaatggtttccctaatatagttctttgtagaccgatattcttgcactcacttttgtaaccactctaaattaacgtatgagaagacgaagactctaaccattagcacatcaaagaaaactttattactcttctttcggcttccttggtcatcccaatgccacacaactttttttagaggttacgaggtggtgttaagcgatgttaagattttcactcttctcttatatgtcaccaaatatttttcataactagtaaggtgaagatctcactgttaaccgttctacacataccgacggacccctaatttaaattatctgttaaattttttcccctatacaagccaatgattaattatatttttcgttaattaaaagggtacaccaggggaacgagctaatacagttcattctccttcctaaagtggtgttaaaattaagagggtgctattttggcaacaacaacatgagtgtgactatgttaaagtcgaatgaatgtttttgtttaacctttagaactttgatttcaaaaatttacatgacaataagtttataaaacctaggcaaaatttgctatatgatattaaacaaatgtggtctttgttgtgtgctgggtagctctcactgccaccgctccaccctaacttagatctcaccaccacctcttcagtacttggatctagacttcatgacgccggcggcctcaagctcctccccaacccatcaatcacctcgatctgcgttgacctcggccgacatcaatgtcctcacctccttcatcacggcaccccatcgcctcaccaccacatcgtcggtttcgccgctaggaaccaccagcacaccggggaaggggcatcctcgccatcatgggcctcttccttatttgtttatagctgtgccaagccaccactgctgctggggggagggggtgacctttgaacaacgccagcctcgccttgtgacgaatctactattcctccttttttcggccagcacccttattctccatatttttcttatttctattttattcaaattataaatatttactctaggtgtgttacctttttagaaggttgcaaattgtactttctccctctctgggctctaatcacctactttttgtttcatacttctagaaaatgacaaatctgcctggccttaatttctataaatagcacaccataagggagagccagtgcaacattattgtattagctattattcccattggaacacacaaccacgatgaatgttaacgtagaacatgactttcacatggttggaggggaaggagaaattagctacgccaagaattccagggttcaagtaactacccatctctctccctcccttaccccccccccccctccccctcgcttggtgtgtcaacagcttgcatgtaagtaataagcaatgagatagcatcaattcacattggcaacaatacttgtaccatgccatgattaaggaaaaactaagttgcaccatccatgatgcatggagtgcacatatagatccatttggaacactactccctgatcagcgtctagattaattgtagaaagttgctcggacctctttcaaacactattaattagacgttattttcgtttgtcataactctcctacatatgccatgtaagtatttttatagtatgcagctgtcttaaagaactgcctgtgtaatctgcctataggaaatatttgttttctacaggtctattatcacaggcagttggttaaaagcatgtaaaatgggttaccggctgcctgtaaaaagtattttcctagtactatgctatctaacaaaaaaaagagttcctatacatagatattagatggtctatccttctccttttctttctaaagatccaatgtttaattataacaataaatgaattttgacatgtatgtatatatggtgctaggcgaaagctatgattgaggctaagtttgtccttgataaggcaatccgagaactgtacgcaacccttctagctaatatcatggttgttgccgaccttggttgctcttcaggacagaatacattacattttgtctctgaggtgataaacatctttacgaagcaccaaaacaatttgggacaaagtgatacggtggatcttcagttcttcttaaatgacctaccgggtaatgacttcaaccacctctttcggatattgaacacattcacattcaagggggcatcaaatcacaaaggagatatactacctgcataccatatctatggggcaccaggatcttattacaccaggctttttcctcctcaagctgttcacctatttcactcctcgttgtcccttcattggcgctcacaggtaggtaatgttgatgatagtataatgcaaaatgctctttcaagtttcaaacatgtattttctccactcttattaagtcacataatcgtcatgataatgttatatattacaagtgctatatcacttccttaggtgccggagcaacttaatgggaagcaaaaatcatatctaaatgaagaaaacatctacatcaccaagactaccccactacacgtggtgaagctattccaagagcagttcatcaaggacgtctctctcttcctcaagttacgccacgaggaactagtggatggggggcggatggtactaacaatttatggaagaaagagtgaggacccatatagtggagatgtaaatgatatttttggtttgcttggaaaatcactacaatctcttgttgctgaggtaatatactcctttgatcccattctattttacttgtcatatatatgagacattgacataatcatctctgcatatgtaattttagcataacttttccttcaaatagatctatggaaaattattgaaaatatatctacataaaggcattcttgttgactaattattgaaaatataatctactaatcaatttcatttttttacatatatatatcatgtctcaatagttttgcatatatcgttagtaatttatgatttttatgtttgactacacacatcctaaagtgcaatagattttgtgattggagtattcttggttaaccaaatatatacctacatcctgtcatataagggactttgcctctcctatcttatcgatgatataagagatttttggtgtactatttgtgtgacactctgggcccaattaggatgtggcctatgagtgtcatgtacacttaattggtactatcttatgagttgagcaagagtaaaaccaacttataaaaccttgtcgctctaaccatacaacttctgagttaacccttttacatgaaacgagcacaaaagtataagtagattgctatgtgtaataagtgggtctgccgggctaggctgtgcggatttacagctattataggttgccacattaatcaactcaaattttattcaatcttatccaccaattaaccactaactctcacttaatatagctaggatagtcctttatctatattctaaatatctagaaaagagagaatatagataaatgactatcctagagacagtgtgtgtagtaaaattatgggatttccacgttaataaaatctaaactaaactttcgatgtgtattaatacttaatagggtctcgtggagaaggaa

SEQ ID NO: 67159 - DNA, 39637 bp, Oryza sativa
atttctactatattcctattccaccagctagatactactaaactaacttgagagaaatgagagagctattgcttgaggtgtgtgagtgaagtaagaagagaagctccttttataggcaggtaatgacggttgtgacggttgaaatggtcgataataccctccaaccgtcattcgggatcaattccagtcatccatccaaaccctgcatccatcggtgccacggaaggttcgaccaaaccatgggctggcctaacccaacccatcttcggctagcggcctcttttgttgtcctcctccgtagacttgtgaattttggcccaatgtgtcgtgttatttatgagttcatggctcattcatacataagtatagttcttgacaccgtacgatttgtttatcgtctgagttgatgtcgattctcctccactttattgtcattctctgcaaaaggttagtatacctaatactagtggaattttattattctaacatatatatgcattgcaagcatcactagttctcctctattttagtaatattgacggtcgaaactgatcgataacgaccgtctacagcgggaccggtggtcttttttgcatagaatagtttgaggtgtttccataatcttcaaaagatcaccctcaaactagaatgataattccaaaggctgaatttcttcttcctttgtttctggcggttcgaatgagaattcaacggttgaatcttggtgtatggaggtagatggctccgattcaacggttgaatgttcatctggtgtaggctcgatttcctggatgctgtcgcaatgaaaaaaagagatgttgtcaagtatccgatcgagttccgtatcttccgttgtcatcttgtgtgcgaatgatcgttgggcgcaaatatcaaaatacatggtagactccgtgtctaaactcgaatggaagtattcctcagcaacgtggtcagataggcacaagtctgggctggctagagttagcaaatagaactgtgctcaggctacactgatggactccttctagtcatgctaaagttgagaacctccctacggagagaaactacacgactaatgggaagaaagcaaggcaaaacattttttttcaactcctcccatggtcccatttcccatatagcttcatccgcaattcaagaaacatggtgctatgccacttgccatgtgtctttgggcttgtaactttattctgggatcccagcctaagtggggcccaaattgggtgctcctcaacctggtggagcacgaccctccagaccccttggtcgtattctcacctctttaaatagctagatacctctttagaatttctcgagttttgttaaattaaagttttagccattgctactttatcttgcagttacacatgttggctaggccgtctaattactcgtttttagaaccccaccttatcatgaagaggtaggaggaggagacggctgtacttaccacatgtaagtattaccgtgtacttcgtctggtgccacacaataatacaatgtaaaaacctatacaatcactttctacgtgcaaatgaacaaaataaatatacatagacagtcccttcggtcgggtgcgcgtcgaccaacagctgatcttcgagcattaggtctcgcatcacctcgggtggccttgggaagaagggacctgatctaatgtgacgctaataagctacaggcaggtgtcaggcaggtcttgtttagctctgcaaaaatttttactctacatgacacattgaatataatagccgtcaagccgtgcgttgcacgggctctttatttatatcatcataaataaatattaaaattttagttatgtatgaatatgtggtcttttctaattacaatggctcttagattatattaaaagaagagtttttatgaaatatacattgttaaatattgattcctaatcaatagaatacttaaaacgataaaattcatattttttaattcattttgagtatgacttccaatggcatattttcttaatacaatgtcccaatatactattattagattaataataaataaaacaattttagtcatgtttatccctcaacattgattaaaagaaaagtacttcatctgaatttgttggaggaatgatgtatttttctgaagtaatgaatatcaatgaaaacataaattgttcaactggatgaagcatgcaacagattatagtgatataggatgatacacatatatatacttatttatcgtgagaacatggcataataaaggatcaaaatcaaataacatatagtattaacatatagtaagaggaaaccatgtactacgtataaatattaatggattagttctaggagccaaatcaagaactctgctgtactatcctaccataatgttaatatggattggttccgtgtccaataatttttcattgtgtgccatgttaggataaagtaggatcagcaaaatgcatgggattattcttttttccatggttttggaaaatagggacgaaaataaaccatgtttcactgcacaccatttgtctttttcatgcatgcatgtatattactgaagcaacgcatgcatatctattgcttttttccacccatgcattattatcgaaaaaaactgcacatgcatatctattgtttttttccatgccctttgcctttgcatgaccacctgtataacacaaaatttatgatgaatcaactaaataatataattatgcatctatttgccaatatcgggtggaggttctctaatagatttcggtagttagaggatctttttcttctgttggtgtctattagtttgtgtttgcttagctttgtttctgctatcgtaaactttctgtgtgagttctgtaataattggctgtagctctttgagtaaaggccggaatgttacattccattataaaaaaaatcaactaaataatatacggagagtttttttttttgcggggatagtttaggaaagtccgaacatatttttgaacataaatatgaaaaaagttttttacaatataataataagggtagcaaattcttatcacataggaaaaaaaatacattttaaaacaaatatactcccttcatccacaaatatttttgatcctagacttcaaattctatccacaaatataagggatttaagagtagaactttgtaaagccacctctcatttaatatttttcgatcaatcttatccctaaccatcgttctactgccccttcaccccgttttaaactttatcttcatttttccttcattcctaatctcttgaaatcgcttatatttaaggagagagtgaatatatgaagaatggtaaaagtagatcaaatacagataaaaagtcagactatgcaaattgatggaatacttacatgtagtacatgtggcgaccactatggatcttcctaaatgccagcgaatttgtcaaagcaaatagatggaagacttctatgaattattatggtacgatgaccatggattggcttgtcaggtgctatcgaacttgttgatgctgaatcaacatctcaacatcaaaaatatatacagtatggtgatgacgtagattagttcctattggacgctgtgacagatgagaagtatgcatgtaaagagaattgaactggaaattagaagttagaatcaaaccttaacaatggagaaaacaacaattagcattcggctgacgttgtgtgcttttccggcgctcaccggctgcacgtcaacctcgccttagtgattgtgtgttgctagatccgataacgttgatatattcgcctttgccgcggccgagcgagcagaacataaatggcgtacgatgtgcttgtatgtactgtttcctcctgcctttctccgtcgtttgccgctgccggccggcgcgatggccatgccgtgccctcccgtatcttccattgcatctgatcagatcgatctcagtaaatatggatggactcatcggtttagaaaaagaaacaaatacccacgttcgaaagaaaaaggaaaaagaatgcgtgcgtgaaaggatcatatcgatgggcttgacaatataggttacatgggctttaaaagacccaccacgtggaacttggattagattgtaatcaacggttgacatattatggtttgtttaatcaatggcttgatcttcctgattaacgtgagagctccaaaaaagtgcccgattagtatggatacatatttaaagtattaagcgtagtctaataacaaaacagattaaagattccaccagaaaactacgagacgaatttattaagtctaattaatccgttatcagtaaatgtttactgtagcaccacatggttaaattatagcgcaattaggcttaaaagatttgtctcgcaatttcttagtgaactgtgtagttgattatttttgtctacatctagtacttcgtgtatatatctaaatattaaatattaaatgtgatagctatgaaaaattttgtccgggcctaactctgctaggcatcaacgagtccatgattcaatcaccggctttgagagtggagtaaatttttcactcgtcagacaagctctagtgcggtaacccctgcggtggattggacacacagctgcatgcatggcatacaatccgtggagcatggcttttgcttttttttttcgcaggcctcgacagccagtcacgaagttccgctgagccgctgacaatgggtcgcgtcaagctttacaattgatgttactgcttctgcttgctgctagctcccttagagtagaatataacatgtcctatataatccctctattttataatataaatcattctaacatttctcatattcatattaatattaatgaatctagatatatatctatctatattcattaccatcaatataaatgtggaaaatgctagaatgatttataatgtgaaacggagagagtaatagttttattcggattaatcattatacgatggttgtgtttagctcacactaaaattggaagtttggttgaaattgaaatgatgtgatggaaaagttagacatttgtgtgtataaaacagttttgatgtgatgaataactttagaactaaagacggtcgataacacggtcgatatgttacgtcctgttcttgattaagtttgtttacacgaaggaagtactgtgctgctatagcgtttacagtacagtgcttcgttaaatgccactggtacggaaacatttttctcgtgtgcccgaaaaattggcatctctcttagcggtaccgtaacggcgcatggagagtgattgagtacagttagtcaagttatgctcgcctccccgtccaaaaaaaaatcacaaatataatgtcgaaacaagatttcagcaatactaaaaaggtggctatcaagctgaaaaagtagatgggtttacagacaagaaattttatacaggttcagaccttcataataagaaataataccctactcctgtccggggattgatccgtcgagtgtattattgatcgtatgatctgggagaaaaatcgtgttctaagaggcacccggacccctctttatataggggaaggggtccgtattacaaagtacaacccatatctctaacggaataggtagttacagataagatacaatcgtaacctactataatcccaggtgcttccttgatatacaagtttagacatttaacccaaaaacttttaaagatattctatctatacatggtacccccatacccagtcggatatacattccgtgtgggtatggggtatccataatctccacagtagcccctaagacctttatggtcaacgaaatagtcctttctcgtaattcaaaacgataatacaagtgattcagcttcttctgccttggtgtcccgagtactgaagtcaaagactgtgaagggctgaaaataaaaagaaaatcaggtgcatcgaccagatgcacctaattaggtgtagcccccgactatgtgatccatccgagtggttcaaggtacattacaaccaccgaatcactttgggaattaaatatttaatcttaagcagcacgtgataaaatatccaaccgactgctttaaccataatacacccagaaaaggcataacgagacccgagtgaaaagcactctaaaagtctataaaccaacatatatgacaagaatctgagtaaaaaactcttaaaggattcatcaactgttgtataaagaatgacaaatgacaagtcaatatggcctaagctgtgacttatgtcaatatcaaaataagcatataacatgctgaggggatagctatctgaaattagccatctcaacaaaacccaagcagctttgcaacctaaaaaggtcaacaaaattagtattacacttttctaccgggcaccttctttatttcgcattacagtaattccaaagaattatctaactgcatcgaaaaggatttcaacggcattgggctatcctgttgtgagcaatttttaccaaggcaaaaatatatgctgaaatccctaaggaacacaaccagccacgccaatattgaagttgggctgaaagcactgtataggcctaggcccattagcacctcccgataccctaacaaaaaacgctaaacaagtgccgcttcgtcttccctgccgagacctccgccactttccccattctccgctacagtacagcgaccactccggcgagaactagggctagcaaatccacaccaatccactcctctcgaagcttcgtaaattcgcaaaaatcttttgcgcaaccaccgcaccaatctccccttcattcatcgccatccttgcttcaaatcccatcatccattctcgcatccatggcgtatgagagagagttttgagagtcaatgggctccctccgatgttacagaggagaacttcaaggagatggtggcgcacaacgttctcctagcgaaggaaattatcgggtggcgtgcggcgtgcggtgaagcatttctgacccctgacacacacgaggtcgtggtattttctcacttcttctatggtggcttttctctcccaacatcgaaattcttcagggggatccttgaattttacgggattagcttgcatcatctgaaccccaattccatagttcacattgccaatttcatccatgcctgcgaagctttcctgggtattaggccgcactttgccttattccgccgcatcttcttcctcaagccccagccaaacaagagcaagccgtgcgttgttgggggagctagttttcagttaaggggaacccttagtcggaaatacttccccatgcccttcaaaacctcaaacaagggctggcatgcaaactggttctatgtgcagaatcctgaaccagcgctccctgagtactcttgccttcccccagtataacaagacacttggaactcgcttccagtgggagatgaagccgctcaaccgcttaccctaatggagcacatgttgaaacttaaagagcaaggcctgcaaggggagcaaatcactcggcactttatcaacagccagctggcacctattaaagagagatcccgcacagtcttcgaatttgatggcaaaactgaccccaatcgtgaagatccaaaatctcttgagttcaagattatgaaggagaagatgtacaaaatcttctctaacgctattgtggtctgctattcacacctgctgccagtggtgccatataacactttcaaccctcctccatcggtatgtatcaaaaatatctcggccttcctgatgacatccttttgtcttttgtaatgttagctgaaaacttgaaatattatgcataggaattttctcttatgaaatctgatcctccaatcgctcaacgccgctcgccccgccggcaggctggtcaggccagtgatgggccgaaaatccaatctgacgctcagcccaacatctcaaagccaactaactagtcgggctctcagaaaaggaaattaattctttgtgacgacgaaggtgacaatgttgggaaagctggcagcaaagaggtgaccggaaaacagccaaggcaggctaacccgaaaaagaaaacatccagtcgtccaataccaaaaatcaggaagtcatccaggtacgagtcatctagcaatttctcctgtattgccaaacatacaccatcaaggtagcaatttctcctttattagcaatttctcaaatctgcaggaagccatttgacatcgattcctctggaaaagaccctgaaccgactgacaaggagactgatcctacgaccaccacagaaaccgggctgactgttgaaaatcgcccgactggtagtcaaccggcgaccgacaatgtagaggccggaaatgaacccccgactggaaaccagtcggccgaagctgaagccggtgctaatcaggagcccccgactggaaacgagtcgggtactgaacaaaataaggacatcccggaaacagaggctcgggcaagcagccctcccccaaaaaataccaacaccgacccggagtccaattcatctgataaggtgcaagggcctgctcgtcctcaaccgaagattataacaggtaatcaattctccgaattcattttgacttgacaaattctcttcgattacttcatcatcatttgtgagtgttcaaaggcccaatgatcggcgacgaagaagatgttcttcggattcagtcagctgaagattctcgcccacccatcttagttaaatggtgggatgatgaaatgcagcctcaagggatcataataaataagcagaaagaagatgaggaagtgtccttgcttgcaaagacgctcaatcaggccactcatctcgtaaatgtatgtttctcacatatagctttactcatcctatcggccacttcactaaattgaaatgaatttgcaatgcagagaattcatcttaggaatgaagcgaaaactacaaccctcgagaaactggttccacatctcgaaaccctggaagcgactagagcccaactccatgaaactagggagcttgctaggaaaaccgaacaagatctcagggaccaaatcaccgagctccaagattccaatttcgagctgagtggttcatccaaaggtaacccctacacctgattaacttattctaggctgctatccgcatccaattaatcagtggaatatattacagtacaagctgccaagatcaccgagctagaaaagcaaatcaaagctctggaaaaagacaagggtgaactaaccaaaaagagggactcggctctaaaagatgtcgaaggtatttgtagttaaaactctaaaatcattcttatcttcgtgcctggacgttgatgtgaaccttttatgcagatcgcaaaattaaatctcaggctcaattcgaagtcctggtcaacaagattaagaagcttgaaggagctagggatgaagttgccaacgccgccacaccactcatccaagccatgttttttaataacaatggtccgagttcgttcgacgctgttgaaatcttcgacaagctgagagctgctccagatacatactttaagaacatcaaagaagctggatgcatgggagcgagcatggcattggcaatgaccaagtccctgtacccgaagattgatattgacgctgtcgacggctttgcaaatgggaccagtgaagaagatgcccttgacctcatcaataatgcatagaaggttgccgacaaaatcgctgctgatgttgttgagagatttcaagacagtaatctcggtccgactgggtctgatgattctgataatgaaaaaactaagtctgattgacattgtgtgatgtgacttatgatgatggaggcacaatttgtacaatactgatgtatttatgctgtgcttgataatttaaactcagctcttgatttcttaaaagtttttgtcaaaccttattgagcctagaacccgcaaaagttgttaaaaacattcagtcctcattgactaagccaaaaaatcaaacaaggcaatgataaaccaagtaagcaaattgaattgataagaatcacactctattattattatagtagcccccgactgttaactcaaggagaaacttgatattagcagtcaaagagggaaagaagatacaaaagtaatgcctaagcataaaaacgacgaagatgctcaatattccaagagttgtcgacgtgagtaccatcttcacgcttgagtcgataataacctggccgagtaacttcagaaattatgaacggtccctcccataatggagataacttgtgccgatctcgtgtagtttgaatcttcctcaagaccatgtctccgactaagaatgcccgcgatcgaacgtttcggttgtgatagcgtcgcaaccattgtaaataccgtgccgactaaatcaatgctgcctcacaagcttcctccagtcggttgagatcatcaactcggtcttctccgtagcgctcctccttgaaattgcgaaatcgcaaggattcgaattctacctcacttgacaacattgcttccacaccatgaaccagaagaaacggtgattgccccgtggcccgactaggcatagtgcgtagagaccaaagtacagatgacagctgatcaacccacttgccggtgtagggatgcagtccgacgaagtcttgtgctttgattccttgaagtaccataccattggcacgttcaacttgtccattgctcataggatgcgctacggaggcataacaaattttgatgctgaagtcttcacaaaaatctttaaacacacaaccagtgaattgagtaccattatcggtgataattcgattgggtaccccaaaccagtgcacgatgttgacgaagaaatctctagccttgtccgctgtgattgtgacgactggcttggcttctatccacttggagaacttgtcaacagctacaaatagatgagtgaaaccaccggtagcccttttgaaagggccaaccatgtcgagcccccaaaccgcgaacggccaggataatgggatagtttgcaactcctgagctggtaaatgagtttgtcgggcaaaaaattgacaaccttcgcatgttcgcacaattttatcggcgtctgatacagcagtgggctagaaaaaaccctgccgataagccttgccgacaatggttgtggggacacccgatatagtcatggtgccccacgaatatgtaactgcccaggatgttcagttaagcatgaaatgatataaaagtataaacttcgattatacaatactcaagtcacttagttcacaacacaacataaatacaaaccattacatatatggcctataaagccttatttctacaaacagataaactgctagactccaccacaggaaatgcctgagcgtagggtgacctagaaaccatagctgtcccactctaacgggtcaacaggatcttcacaagcatcctcctcctcatgatctgaacccatttatgagtacaaaaggtactcagcaagacatgcttatgataataaatacaataattgcaatataaaacatgcagtatcgagagctgcaaggtttaaaccctaaccttaacagttatttcatagagcctaacttaataaacatttgatataaacaacactattgaacatttaatttaaacaataataacgagcataaaaatataaatgttacttataattaacatgaatagaacattaagtaataaataagttaaccatattaattaatagccatttagtttaacttgtgcccataatctggaatcacccatagacacatctccattaaccgggagcacggcgtattcgaatactcaacgactctgcagcgtatgcccagctttacccgcacgatacccacagctggccgggctgaaaagtaacaaggtgtaatattgctccatatatctttcccttctgcctagtaagttaaaggatgcttgggatgttgctcggagtgatccggtccgaggtgtgtaccaacctacgtccgcatccacttaccattgttcgttactcgatgggcagccgagaacttcatgggccaatagggcagttctgaactctcggggcccatcgagcccacatatataaatcatataaacatgaaccatgtcactttgcttcacacacttgaaagctaatggcgagtacactgaaaggcctgcagaagtttaatcaattggagcaatatacggccaggttcgacaaatcgatcgtgtggatgggcgaaactatgtcattcttattgacacaagggggtttattattatatcaattttaaataagaaataaccataaatatatccatatatccatcacgaccataaacaggtccataaaaccaaacacatgaactctatcatgtgtaccacccgctcacatgcgctgtcaacagttcttagcatatagccataaatagttccataagcatgttttcataagcaataataataatatccatattaaatcgatagcatgctaaataattaacagtttgtttaaatgtttctcaaattttatcctaagtttgttagactctaaggctcattaaggtgtttataacaacaaacagaaaatataatgcaataatagtaatataattaatttaaaagaattcgtgcagtctatcgtactccaaaggacaagtacgctactaaaataactctctatctactcggattaaatttctcaagggagggtgcatgtattgcaaccttcgggctcgatgtagtcgcacaaaccatctcctcctggcacggagatttcactcgcttcgactaccgaaccaaagtcagcattttctatttacgcaacaatcatcaccacaataaataacagaaaaacaaagataaccaaaacaaatagtatcacaaagtgcaacaatgggtgaaaaggatttaaagaaataattttagggattttttggaatttcggtgaacggcgaaccataggcctaaaattagggtcgtgacaacgggtgctcggattgcaacgaaactgacacggatggattcggaataagaaaaaggatttttcttatttatttttcaatagaaaaatcggatttttcttttcttctctcgctctgtacaggaacggccggcaactccctggcgccggtggtggagatggccggttttgagcaagggggcgccggtttcacgatctaggggtcagggcgactccgttcccgtggttggcggcggcacaggcggtggcgcaggcggtggcggcggggctggcgacggcggcctagagcaggaggcggcggcggccatggcggcagtggtgcaaggggagcgcggtggtggcggcggctcggcctatggcggccgggagcggcggcgcgccgtatggctggcggtggccgaacagagcggcgacgccgggaggaggcgctggtgacgttccggcgacggattggaatgggaaagagagggaaaaggtagtactcggcatggagaatccatttttaccttcaatttcagaggatttgcgatgtatgcgacgaatttaggagctttattaatggcgcaaattttgcgttttggggatttttcctccggtaatggcgatttgattcagtggagataggtgcgcatttgagtagtaagagaggtcggaattgcggttcttttacccccggtattgagccttctagttgagggacgaaggagatacggaggcgggaagctggaggtgtcgtccggggattcgtccgtcgatcggcctcatgtgcacgcgtgcgagcgtgtggcatgcgcgggctggcacgagctgggcgcgagcgtgcgcgagcatggtgcgggatcagcgcgtgacaacaccgggcgacacaggccctggctcggccgagcccagtagaggaagaaagaaaaggaaaaacagagaaaggaagaagaaagagaaaaacagagaaagagggaaaaagaaaagaaaagaaaaaataatagagaaaaggaaaactagggtggaaataaagaaaaggaaattttgggcaaaattaaactagatagaatttgaactgatgtgatatttagatggtgcgatatttgggatagatttaaatcggattcaaaggaattatttgagggatgatatgcactttgcgacaaaaaattaaacgagaaaagaaacaccggaaacaaacttggaaaataatattttaaataaatgtctaactcgacggttatatttttagagaatcaaagcaaactaaatcggttttaaaaagttgtcaaattttaaggatgttacaatggttcgtgcggcagcgtgattgtcgctgatgcccgagtgtatatctctgagcaattgccttccctcctccaaagagacacaacgttgcagaattcctgatggacttttcttgtacagctcggtctcatgtatgacataaagcttgctgcgcctggaaatccgctcggcttcgtctttatcctgagggagttcttgcttggtcaaaaacttgatgagggctctctccagtcggcgtcgatcatgcttacttcttgagtgtctacagcctcggttgtttcccttcttggtacggttggttcgtaaagatgctcaacaaacacatcagagggagatgtttctcgtttcgaaccgaaattggctagtctgtcggccgcctcgttattatgtcggaggacatgggttaactcggggccgtcaaacttgtcttctaacttgcgcacctcttgtcgataagcagccatattatcatcgaggcaggaccattcttacatgacttgattaacaaccaactgagaatctcaacggactatcagacgacgaatccctaaagatactgtcgaaacaagatttcggcaatactaaaaatggggaggctatcaagctagaaaagtggatgggtttgaagacaaggaattttacataggttcaggccttcttaatcaagaagtaataccctactcctgtccggggattgatccgccgagtgtattattgatcgtatgatctaggagaaaattgtgtccctagagggacccggacccctccttatataggggaaggggtccatattacaaaatatagcccatatccctaacggaatatgtgattacagataaaatacaatcgtaaccgactaggatcctgggtatttcctagacatacaagtttagaaaactaacctgagtcctcctaaagatattctatctatatctggtaccccgtacccaaccaaactatacatgccgtatagatatggggtatctataatctccacagtagcccccgagacctttacagtcgacgaaataaccttctcttggagcataaagcaataatccgtgtgcttcaatttcttctgctctggcctcccgagtactaaaatcaaagactgtgaagtgcgaaaaaagaaaataaaaactgggtgcatcgagtagatgcacctaattaggtgtagcccccgactatgtggttagttaaaaatctaaacatgtagtcaagaaccgagagattttacaaccaaacatcatatagcaaagcatacgtggcattcaataaaacacccagccgactgcttcttggctttaatatatcgagaatagagatatgaaaaggcccgagtgataaacactcaaaaggtccataaatagacatatttgacaagaatccgagtaaaaactcttaagatgatccaccaaatatgataaaaatcatggtaattaacaagtctaatagcctaggctatgaccctcaccataaccaaaacaagcatatgacatgctaagagaatgactattagtaaactagtcatctcgaatcaacccaaacagcttttggagcctaaaaaagcttacaaaaatagtataacacttttctgtcgggcacctttttatttgcatcgtagtaattccaaggaattatctaaccgcgtcaaaaaggattttaacagcatcgggtcacaccattgtgagcacaaattgccaaagcaaaaaatgcctaagtccctagggatcacaacgggccacgctgataataatattgggctgaagtactgtataggcctaggcccattagcactcccgataccctagtgaaataaacactgaagtccaagcgacgtttcgtcttccccgccgagactctcgccattttccccatttctcgctacagtgcaaaaccgcgccgacgaagctagggttcaccaatccgctccaatccatcctcaaaaactccgtgaaatccttctgcacgaccaccgcaccgattccccatccccttcgagccacatctcggaccaaatcaaaccatccagttcacatccatggcggaagagagagaaagctttgagagtcagtgggcgccctccgacgtgaccaaggaaaatctgaaagaaatggtggcgcacgacgttcttctggcgaaagagatcatcgggtggcgaccagcattcggcgaagcgttcccgacccatgatacacatgaagttgtggtattttctcacttcttctatggcggtttttctcttccaacctcaagattcttccggggtattctgaatttctatgggattagcatgcatcacttgaacccaaactccaaagttcacattgccaattttattcatgcctgcgaagcttttttgggcactaggccacacttcgccttgttccgccgcatcttcttcctcaagccccaaccgaacaagagcaaaccatgcgtcgttggggggggctagtttccaacttaggggaactttgagccaaaaatacttctccatgcccttcaaaacctcaaacaaaggctggcatgtgaactggttttatgttcaaaaccctgagcctgcactcccggagtacttatgtctccccccagtttatcaggacacttgtaactcattgcctatgggagatgaagctgctcaagcactggaactgatggagcgcatgataaagctgaaggaacaaggtctgcaaggtgaacagatcactcggcactttatcaagagtcggttagctcctattaaggcgagatctcgtacagccttcgaatttgatggcaagcacgacccaaaccgtgaagatccagattctcttgattttgaggtcatgaaggagagaatgtacaagatcttctcaaatgctatcgtagtcagctactcacacttgctgccggtagtgccgtacaatgtattcaatcctcctccaccggtacatattcaaacatctcaacctccctcaaaagcatgatctcatctcttgttaaattgtttgacattcatgctcaggagttcgcgttgatgaagtcggatcctccaatcgctcagcgccgatcacctcgccttcaaactggtcaggaaagtggaggaccaaagattcggtctgaaacccaaccaaacacctctaatccagccggccagtcagattcccacaagaggaagttagttctgagtgacgacgaaggcgatgatgccagaaaacctgaagataaaggggcgaccggaaaactaccgaagcaagccaatccaaagaagaaaacatccagttgtcctatgccgaaaatcaggaagtcttccaggtacaaatcatataacgatcttccttgtattgatgctcacccatcatgaaaatgatactgatagcacaactcaaacttgtaggaaaccatctgatatagatccttctgggaaagactcttatccgactaacatggagacgggctcctcaaaagaaactgggccgactgcaaaagatcatccgagtgacaatcagccggcaaccgacaatgtagaacccagcaacgaacccccgactggaagccagtcggccgaagctggagccgaagttaaccaggagcccccgactagaaaccagtcggacacagggccaagccaagagatctctgaagttgaagctcaagcaggcagccctcccggaaaggatgccagcaatggcccaggatccagatctcctgtaaaggcacaagagtccactcgtccccgtcgagaaatcatcacaggtaaacacattatctgaaatcattttgatccaacagactttattcgattgtttcacctttattcatggatacattagggccaatgattggtgatgaagaagaaattctccggatacgagcggctgaagattcgcgccctcctattctggtcaagtggtgggataacgatgggatcgtaataaataagcaaaaagaagatgaggaggtatgcctgctgaagaaggcactcagccaggctactcgcattgtaaacgtaagtttcttgacgcccgacctcaaccatctgttcgccatttagctcaagcgctaataaaactgttttgcagaggattcatctcaggaacgaagcaaaaaccgcaaccctggagaaattagttcctcatctcggcacccttgaggccaccagaaatcaactgcacgaagccaaagaacttgccaggaaaactaagcatgatctgagggatcggattgctgaggtccaggaatccaattttgaactgagtggctcatcaaaaggtacacataaactctgtccaactaacttgtgctgctatctttgtaatttcgattaaccggagtcaatatagtgcaagccgccaagatatctcaactggagaaacagattcagactctggagaatgacaaggctgaactagcaagacagagggactcggctttgaaagatgttgaaggtaccagtaatcaatacttcaaaagccatcattttctttatgctgacttattaatgtgaatctgttgatgcagaccgcaagatcaagtcacaagctcaatttgacatcttagtcggcaaaatcaaaaggcttgaaagggctagggatgaagttgctaatgctgctaccccactcgagtacattcgatgctcccgaaatcttcgacaagctgagtgttgctccggattcttatttcaagaatatcaaagaggctgggagtatgggagcgagcctggctttagcgatgaccaagtccctatacccgaagatcgatattgacgctgttgatggctttgcagacgggacaagcgaagaagctgctcttgacctcatcaatgacgcacaaaaagccatcgataaggtagcggttgatgtagttgagagattgcaggacaccgatcttcgaccgactggtcctgataactctgatgatgaaaagactgatactaattgatgtaatttgacaacaatgattctgatgatgatgatggaggcacaatttgtacaatactgatgaatttatgctgtgctcagtatttcaaacctagcttctgatttcttaaaagcttttgtcaaaccttattgaacctaaaacccgcaaaagctattaaaaagctttcagtcctcatggactaatccgaaaaatcaagcaaggcaatgataaatcaagtaagcaaattgaattgataaagatcacactccattattattataatagcccccgactgataacttcaagggggagcttgatgttagcagtcaaaatagggaaatacaaaagtaaaacttaagcataaaaacgatgaagatgttcgatattccaggagttgtcgataggtgtaccgtcttcacgcttgagtcgataggaacctggccaagtgacttctaagattataaatggcccttcccataagggggataacttgtgccgatatcgtgtagtttgaatttttcttagaaccaggtcgccgactaagaaggttcatgatcgaatgttacgattatgatagcgacgcaacccttgcaagtatcgggccgactgaattaaggttgcttcgcgggcctcttccagtcggtgtagatcatccactcggtcttctttgtagcgctcctcgcgaaagttacgaaaatgcagagattcaaattccaccttgctaggcaacattgctttggctccataaactaggaagaatggcgactagcccgtagcccgactgggggtggtgcgcaaggaccaaagtacagatggcagctgttccacccatttgccggcatagggattcagtcggtagaaaactcgtgcctttattccttgtagacccatgccgttggctcgtttgacttgtccattgctcataggatgcgctacgtgggcgtggcatatttaaacgccaaagtcttcacagaagtctttaaatactctgctagtgaattgtgtgccgttatcagtgatgatccgattaggtactccaaaccgatgcacattgttgatgaaaaaatctctagctttgtctgccgtgattttgatgaccggtttagcttcaatccacttggagaatttgtcgacagccacaaagagatgagtgtaaccttcaagcccccaaaccgcaaacggccaggacaacgggatggtttgcaaatcttgggctggcagatgagtttatctggcgaaaaattgacaacctccacatgtccgcacaatcttatcagcatcggacacagctgtaggccagaaaaaaccttgccgataagccttgccgacaatggtccgtgcagcagcgtgattgccacaaataccagaatgtatatccttcaataattgtctcccttcctccaaagacacacagcgttgcaggattcctgatggacttttcttgtacagctcggtctcatgaataatataaagcctgctgcgcctggaaatccgctcggcttcatctttatcttgggggagttcttggttggttagaaatcgtataaggggctctctccagtcggcttcaaccatagctatgtcttgagtgtccgtggcctcaactatttctttccttggtacggttggttcgtaaagatgttcgacgaatttgtcggaaggagctgcttcgcgtttggatccaaaatgtgctagtctgtcggctgcttcgttattgtgccgaagaacgtaagtgagttcgagtccatcgaacttatcttccaacttgcgtacctcttgccgataggcggtcatgttatcatcaaggctggaccactctttcataacttgattaacaaccaactgtgaatctccacgaactatcaaacgcctaattcccaaagagattgcaatccgtagtccgtgaataagcgcctcgtattctgccacattgtgagatgcagaaaaatgtatccacaacacgtaacttagtctttctccaatcggggaaattaaaacaaccccaacaccagtgcccgaaaatctcttcgacccgtcaaagtgcatagtccaatactccatcttctcatcgggcgttgttgacagaaaacacgaggccgttaacaggcgtatcctcttggcactcggcgacgaaatcggctaaagcttgggacttgatcgaagttcgcggcttgaacgatatatccaaggacatcagttctaaggcccattttgtgatccgcccgtttgctttgtgattatgaagtatatcgtcgagcggaaacgatgtaaccaccgtgaccgagtgaccctggaagtagtgagataatttcctgacggtaattagaacaccatataacagcttctgaacttgaggatatcttgtcttggagtcggccaaaacctcgctaacgaagtagattggtcgctggactctctgaacatggccttcttcttcacgctcgacaaccaataccgtgctcacaacctgagaagttgccgatacgtacagtactagcggctcttgcggatgtggtgaggccaaaattggtggagtggtgagaagtttcttgaagtcttcaaaggctttctgtgctttgggtccccactggaaattgtctgttttctttaacagcttgaagaagggcatcctccgctcgccgagtcgtgaaacaaactggctgagcgccgccatgcatccagtcagcttttggacatctttctgcgaactcggcggtttgatgttgaggatggcgttgactttctctgggttggcctgtatgcctctatgagacaccataaatccaagcagcttccctgacggtactgcgaaggtgcatttttcagggttcagtttcatcctgaacgcgcggatgctcacaaaggtttcttccaggtccatgatcaaatcatctttctgcttggtcttgacgactacgtcatccacataagcttcaacgttgcgaccgatctgagttgagaaacatctctggatcaagcgttgagaagttgctcctgcgttctttaatccaaaggcatggtgatgtagcagtaggccccaaagggcgtgatgaatgaagtcttcaagcagtcggattccttcaatcggatctgatgatatcctgagtagcaatccaaaaaactgagtagctcgcagccggcggtcgaatcgactacctggtcaatgcgaggcaacccaaaaggatctttggggcaagacttgttgaggtcggtgtaatcgacacacatgcgccattgcccggtcttcttccgaactaaaactgggttagccagccagtcgggatgaaggacttctttgatgaagcctgctactaatagcttggtcaattcctccttgatcgcgtccttcctgtcttgtgcgaagcggcggagtcgttgtttgatgggtttagcgtcttccttaacatgcaaagagtgctcaatcacctctctgggaataccaggcatatcggatggttttcacgcaaagatatctttattattttgaagaaaggtgatgagcgcgctttcctatttacaatctaactcggggcctattacagcagttttagtaggatcagaaggatctagaggaattttcttggtcttggcttcgctttctccactctttgagatcttggttgaaggcacttctccttcacttgccatggttgcagccagtcggatgtcttctcgggcgatcgcgatctcgcgggtttgggccatctcgcagctttccttgtcgcatgtgacggcttgtttgatgtcgctccgtagggatatgactcctcgaggacaaggcatcttcatcatcatgtaggtgtagtgcggaacggccataaatttggcaaacgccgggcgcccgggtatggcatgatacgctgtctcgaagtcagcaacctcgaagcagacgttctctgtgcggaagttctcccgagtaccaaaggtgaccggaagagtaatctggccgagtcgcgtggcggatagccctgggatgactccgtggaagggcgcattactcggcttcaactcggtgcgagggatctgcatgtgatgtgaccatggctactatggatacaaccattgctcacatcatggatgaacaagatgatatcaagatcaagtcctccaagtgctggaatcagattcagccacctgctacactgctgacttcaaatggccgccgaatctgcatacgacctccgtttttggcccatgagtacttgatggaaagctctcggagtcctctttccaacggatctagcatcatcgccaaattccatccaagtcatccatagatgaagaaacaaggtgctgcgtcacctgtcatgagcctgtgggcttgtaacttcatttgggacccggcccaggtggggcccatgtggggtgcgccccaagctggtggagcacgaccctaggcacccctaggtcgtcctcccacccctatatatagctagttaccccttcagggtttctcgggttttgatagattaaagtttagccattgctacttgcttgcagcgcgcgtgtcggctagaccgtccgtctgcttgttcttcggaaccccaacatatcatttgtattaaattcctatttgcaatatcagattgcttttatcttgttcttgcttgtttcttcaatttgcttgcaggaatagggttgatctgcaccggcaagatcaacaatccacggagaggtgtatcgatcgctaaggcgcaacacaatgtctcgtatggttgtagtcggatcgtcaacgtttctcccaaatcgtagttatcataactcaccgaaagatcgggccaacaacagccttgagtgtcgagaggaactcaaggttcatcaggtggtatcagagctttcattgctcggtgagttttaatctacccataactagaaaattgccatgaaaaaattgtgccattgcattgtttttatcagtttttgctttgttgagttttgtgttacatcgtcgagtcgagttgctggtgttagcgtctagttcgtttacagatacagtcgtcgtcacctccgtgtatctgttgtcgtcgggacctacgaaaacggaatcggctcgctgccacgattctatttttgtagttttcaaaagtttttaccggttggtttttgcagttgttgagttgcatcttgggtttgctgaccgccgtgcttctgttttggccgtgcctgtgtcgtgcacgagaggaggaaggtgaattaccatatctgattttggaagtagtcaagtttgttttggaaagatatagtagattggattgattaaaaatcagtttcctttttatcccatacaccaaattcggctgccatccactccacctcctggccgactcccactcgcccctttggccgagtccgactccctccctccctttcacagttccgagttttgtgaaacaccttggtgaatttttatttggtgtcggtttcgagatctatttggaaaaacagaaccggcataaattcagcattccatttttgtataattttaattttgggtttagacttttacatttgtgtccctataatttttatatttacgtttgagtccctgtagcgttacattgacgtccttgaatctgtttttgtaaaaaaaatcaaaaaaaaagaaagaaaaaaaaaggcagaaaggtgcaaaaaaaaaaagcaaagaaaagccgcaccctaaaaaaaagaaaagaaaaggaaaggaaaaaaagaaagaagaaagaaagaaaagagaaaatattgttatgtttgagctgaacttcatatatgagagttgtgcatgagttgttcctagtgctatcttatcgtattgtttgtgtctaggctcgcgtctctagtacgttctagcctaggaccagcacgatacttgactttgaaccattattcaactttgcattctctgatttgaaccattgctttcctttgctacatattttaagcctacccagagctctacagatttgattgtagccgtacagcaagtgcttgccaaggcatcgatacatccaacctccattggggtgcttggttgagtcggtgtatgtcaccttttcgcttgcattggtaagaacttgtaagagcttggttaaaagcttgagtgtgtttgatatttgagctgccactacttagtagttgataggagcgtgcatatatttgtgtatgtttcttgtttgctactaaccatggcaggattgcgaaaggggaaacgagatggtcatgctcaacatcgacttcttcaccatcaacgagatatattgtcttcttcacgctttgcatacaaggtacatgataacgatcttgcaagtgtagaatctaatttgcctgtttttgatggtaattatgattccgccgctaatgttaattgggagctagcagtagacaaacaatttgatgagtatgatttctctaatgctcaaatgattaaggctgctagtaataagtgtactggttctgcatcttcttggtggtatactgttggcaataagcttgaaacttgggatgaatgcaaaacaatgatgagaaaaaattttgtgttttcatattataaacgtactctccttgagaaattagaacatctaaaacaaggtgacaaaaccgtgcgggagtactttcatgactttaaaatttgtatcacttatagtggtttaaaagaaagcaatgagaacacaatgactagattttttagagggcttaattctgatattcagactgggcttattaatgtgacatataatcatataggccatttgttgacgattgcttgcagtgttgagagcaatattttaaagaacccaagggagaaataagctatgcttgtgcctcctattactgacactttgcagggagctcagaacattcaccatgaggagaagagcaatatgctcgagatgtcatctccatcactcacgaaggaagaagagaagactgatgcacctacattatctgaagagggcataaaaggtaaattaaatggtgctggtattactcaaggtgagtgtgcttctgatgagtcacatttgtccactatccatgctaatctagagcaaattttggtggaaactacttctgatttgcctttgtcacaagttgatttacttgctgttccttgtgataaagaagagttgtgtgataatgcttcacttatatccctaccacaactagtgaatgaacatgctatttctagtgtttctttgtgtgccgattttaagcatgttgttcacattgctaatgatgtacaggaacgtgaattgctatcttctttaaatattttgggctatgttcagtttgatgatttttgtgagctcgataatttgaagaagaaattatttgctaagtctgatttgccttgtccaactagtgctatttttcatatatttggtgaatctgatgatagaggaatatatttggtgcatagagtttacatatgttcagattttgaacctcctatacatatggataaaacatgcaagctagagagaaatgttattgctaacaaaattatcttgagtttgtcttgttttgatttgatgaaacaggttgttttaaatcgaccacgcgttgagcaccatatggaaaaaccgaggacggttttccgtgaagaaggggaggatgatgtgaccatggctactatggatacaaccattgctcacatcatggatgaacaagatgatatcaagatcaagtcctccaagtgctggaatcagattcggccacctgctacactgctgacttcaaatggccgctgaatctgcatacgacctccgttttcggcccatgagtacttgatggaaagctctcggagtcctctttccaacggatctggcatcatcgccaaattccatccaagtcatccacagatgaagaaacaaggtgctgcgtcacctgtcatgagcctgtgggcttgtaacttcatttgggaccccgacccaggtggggcccatgtggggtgcgccctaagctggtggagcacgaccctaggcacccctaggtcatcctcccacccctatatatagctagttaccccttcagggtttctccggttttgatagattaaagtttagccattgctacttgcttgcagcgcgcgtgtcggctagaccgtctgtctgcttgttcttcggaaccccaacttatcatttgtaataaattcctatttgcaatatcatattgcttttatcttgttcttgcttgtttcttcaatttgcttgcaggaatagggttgatctgcaccggcaagatcaacaatccacggagaggtgtatcgatcgctaaggcgcaacacaacggcttgtacagttgtagtcggatcgtcaacgtttctcccaaatcgtagttatcacaactcaccgaaagatcgggccaacaataaccttgagtgttgagaggaactcagggttcatcagcatgtcgtccagggtcttgtcgaagaggatattgagtgcgctgccgccatcgatgagggatctgcgaagcttgacattgcgaaccactgggtctagtaccagggggtacccccccgggtggaccactcggtctggacgatccgagcggtcaaacttgattgttgtctctgaccaccgaagatattggggcgtatcgggctgaacagcgttgatctcccattcagtcagcttttgctttcttttagactcgtaagccagagggccaccaaagatgtgattgagttccttgcgatggtcttgaaaacctgtcgaggcatcatcattatcatccttctttttcgacgtgctttgatctccatcggaggtcttccgtgcattcttggcatattgctccgcaaactgtttgtagacgaagcaatctttagctgtatgattggagttgggatgatgcggacattgggagttcatgatcttgtcaaaagtgttgacgcgcgaacgttgtcgggaggtgtgtgtagtagtcgcaccaagttcctcgggcttactcttgcggtccttgtgattgttacttccaccccctcccatagtcggcgcatctttctttggcttccaggtgggacccgactgcttggatgcgataatggcgtcttcggctttggcatactcgttggctttttcaaacatctgtttgaccgtcttgggaggcttgcgcccgaacttaccgactagatcttcgtgacgaatccccttggtgaaagcagcgatgatgacatcgtcggtaatgtcagagatcttgttgcgttgttcagagaagcgtcagatgtaatctcgaagggattctccagacttctgaatgacgttgtagagatcaaactgtgtgccagggcgttcaaaggtgccctggaagttggcgatgaagtggtcatgaagttccgcccatgatccgattgtgccacagggtaaccaatgaagccaggaccgggcagaatccgctagggccacaggtaagtagtttgccatggccttgctgtctcctcctgctgcgcggattgcgagaccgtagacggtaagccaagactccggattagtggtgccgtcatacttcttgattccagtcggcttgaagccgggctggccaatccactcgacgcaggtcgttagtaaaggcagctactccatccacgtcgtcgtcgtagcgatccggtgaatggcgatgggcatggcctcgtgctgcatggcgctggttgattgtatcacgaagatcgacagggcgcctacaaggtggggagcgaggctgttcaactcggcgctccctgtgtcgcttaggaggcgagtgaaccgatcgctcgttgtggcccctgctcctgcgattggatcctgcgccggcgatgctgaggcttggctggtgataatcttgagatcgaagatgggggacccggctgccagtcggcgtgcggacgcttctggagttaaccgggaccgaggcagcaatcatggtcttggtctggttcaagatgttgacgacgtggtcagcttggttgagtgcgtcttccttgaggatggtgtcgaggagggtgatcgccgcaacagcgttctgttgagggctacagaagaccgccgtcccctcaacgtcttgctgcccgatgagatctcgcgctcgtcgccctgcgtccaaggctcgttgtcgtcggtcctcggcctcctttgtagcccgttcgtgttcctgttgctcacactgcagccgttcttgctcttgtgcttggcgctcctcttccagtcggcgtcgctcggcctcctgttgtacgcgtcgtgcttctgtttctcgggcttggcgttgttcttccgtctcgttatcggccatgaagacgtcgaaatagagaggggtgtagttatcttcaaagctttcgtcgaagtcgtcgaggtcgcggttgtcgtagcggtagccgaattcgtcatactctatgatctctgttggtcgtgagtcgacgccgggggagctgaagtagctttccaattgatccgtcgaaaccgtgccgagtggctggagtatgacgctgacttccttggagctaggctggatcggtgttgaagccgaattctgcctaggcctacggggagaagacgtccttttagtgaaggtccactttgcaatccgtccatttgcttcgcgattatgaagtatgtcactgagtgggaacggtgtgaccaccgtgaccaagtgaccttgaaaatagtgggataatttcctgacggtaattaaaacaccatataacaacttttgcacgtgaggatatcatgtcttggagttggccaaaacctcgctgacgaagtaaattggtcgctggactttttggacatggccatcttcttcacgctcgacaaccaggaccgtgctcacaacttgagatgtcgccgacacatacagcaacagcggctcttgcgggtgtggtgaagctaagatcggtggagttgtgagaagtttcttgaagtcttcgaaggatttctaagcttcgggtccccactagaaattgtcgattttctttagcaacttgaaaaagggcatcccctgctcaccgagtcgtgagacaaaccggctgagcgccgccatgcatccagttagcttttggacgtatttctgagaacttggcggtttcatgttgaggatggcattgatattctccgggttggcttatatgcccctatgggacaccataaagccaagcagcttccctaacggtactccgaagattcattttttaggattcaatttcatcctgaaggcgcagatgcttgcaaaggtctcttctagatctgtaatcaaatcatccttttgcttggtcttgacaactacttcatcaatgtaagtctcaacgttgcgaccaatctgagttgaaaaacacctctggatcatgtgttgataagttgctcctgcgttcttcaatccaaaaggtatggtgatgtagcagtaagccccgaaaggcgtgatgaatgaagtcttcaagcagtcgaactcatttaagcggatctgatgataccctgagtagcaatccagaaaactgagtagctcacagccggccgttgagtcaactacctagtcaatgcgaggtaacccgaagggatctttaggacaatatttgttgaggtcagtgtaatcaacacacatacgacattgtcctgtcttcttccgaaccaggactgggtttaccagccagtcgggatgtaggacttccttgatgaagcctgctgctagcagcttggtcaattcctccttgatggcatccttcctatcctatgcaaaacggcggagtcgctgattaatgggtttagcatcttccttaacatgtaaatagtgctcaatcacctccctaggaataccaggcatatcagatggtttccacgcaaaaatatctttattattttgaagaaaggtgatgagcgctttcctatttacaatctaactcggcgcctattacaacagtcttagtgggacagagggatctagagggattttcttggttttggcatcgctttctccgctctttggtaacttgggtgcaggcacttctccttcggttgctgttgatgcagccagtcggatctcctcttgagcgagcgtgatctcgcgtgtttgggccatctcgtagctttccttatcgcagctgacgacctgcttgatgtcgctccgcagagatatgactcctcgaggtcctagaatcttaatcatcatgtaggtatagtgtgggacggccataaacttggctaacgccggccatccgagtatagcaaggtacgctgtctcgaaatcagcaacttcgaagcaaatgttctctgtgcgaaagttctcccgagtgccgaaggtaaccggcaaagtgatctggccgagcggagtagaagatagcccggggatgactctgtgaaagggcgcagtactcggcttcagctcggtccaagggatctgcatgtcatccagagtcatggcgaaaaggatattgagtgcgctgccaccatcgatgagagatcgttggagcttgacgttgcgaaccactgggtctagtaccagggggtaccaccccggatggaccactcggtcaggatgaaccgagcggtcaaacttgatagctgtctctgaccaccgaagatgttggggcgtatcgggctaaacagcattgatctcccgttcagtcagcttttgctttcgtttggattcgtaagccaggggcccaccaaagatgtggttgagttcgttacgggagtcttaaaaaccagtcggggcatcgtcttcatcatccttcttcttcgacgtgctttgatctccgtcagtcagcttccgtgcgttcttggcatattgctctgcgaactgtttgtagacgaagcaatctttggccgtgtgattttaattcagatgacgtgggcattgggagttcatgatcttgctgaaggtgttgacgcgtgaacgttgtcgggaggatggtgtagtagttgccacaatttcttcgggcttacgcttgcgatccttgcgattggcacttccactcccccctgtagtcggcgcatctttctttggtttccaggtgctgcccgactgcttggatgcagtgacagcgtcttctgctttggcgtactcattggccttttcaaacatttgcttgactgtcttgagaggcttgtgtccaaacttgccgactaagagttcatggcaaatacccttagtgaaggtggcgatgataatgtcgtcggtgatgtctgagatcttgttacgttgttcagagaaacgtcggatgtaatctcggagagattctccggacttctggataacgttgtaaagatcaaactaggtaccagggcattcaaaagtgccctggaagttggcgatgaagtggtcgcgaagcactgcccaagatcgaatcgtgccatggggtaacccgtgaagccaggaccaggcagagtctgctagggccactggtagataattagccatggctttgctatctcctcctactgcgtgaattgcaaaactgtagacggtgacccaagactcgggatttttcatgccttcgtacttctcgattccagtcggtttgaagctggttggccaatccactcgacgcaagtcacttgtgaaggcaacaactccatccacatcgtcgtcgtaacgatctggtgaatgatgggggatgtggcctctcaccgcacgacgctggttgatagtatcgcgaagatcgacgggacgcctgcgacgtggagagcggggctgttcagcctaacgctccctgtgtcggtcggcaggcgagtgaatagatcgttcaccatggtccctgttcctgcgactagatcccgcgccggcaacgctgaggcttggttgatgatagtcttgagatcgaagaggcggaactcggctgccagtcggcgtacggacacttgaggcgttgactgggaccgaggcggcgatcatggtcttggtctggtttaagatgttgacgacgtgattgggtgcgtcttccttaagtagagtgtcaagaagggtgatcgctgctatcgcgttctgctgcggggtgtgaaaaaccgccgtcccttcaacgtcttgttgtctgataagttctcgtgctcgtcgcccagcctccacggcgcactgttgccggtcctcagcctccttcacggctcgttcacgctcctgttgctcacgctgcagccggtctcgctcttgtgcttgacgctcctcctccagtcggcgacgctcggcttcttgtcgcgtgcgcagttcttctgtttctcgggcttgacgctgttcttccgtctcgttgtcagccatgaaaacgccgaagaagagaggcgtgtagctgttttcgtagccttcttcgaagtcgtcgaggttgttctagtcgtagtggtagccgaagtcgtcgtactcgaggatctccgtcggtcgagaatcaacaccaggggagctgaggtagccatccaattcttccgtcgaaactgtcccaagaggttggagtatgacgccgacatccctggagcaagactggattggggccgaggccggatcccgtctaggcctacagggagaagacgcccttgtggtgaagacagcagccaaatcgtcggggaggttcatcaggattgagggataggccccatcgtcttgatcaagtcgtgtcggagtagattgaatctcgtccgagtggtttgaagccgactcggttgagatgatcttggagtagatctcggccgagttcgggataccgaacggggcggagacctggcctctccctgactggttcgaatctgagtcgaggagagaaatcttgccgaagtcgttggtgatgaagtcgaggttgcccaaccggaatgcctgcccgggagggaagacgaagtcattgatatcggagacgaaacccatcgcactagtcagcgatgaacttgacgctacccctacctggtgcgccaactgtcgaaacaagatttcggcaatactaaaagggggtggctatcaagatggaaaagtggatgggtttagagacaaagaattttatacaggttcaggccttcttaataagatgtaataccctactcctgtccggggattgatccgccgagtgtattattgatcgtatgatctgggagaaaaatcgtgtcccaagaggcacccggacccctccttatataggggaaggggtccgtattacaaagtacaacccatatctctaacggaataggtagttacagataagatacaatcgtaacctactagaatcccgggtgcttccttgatatacaagtttagacatttaacccgaaaccttttaaagatattctatctatacatagtacccccatactaagtcgaatatacatgccgtgtgggtatggggtatccataatatccacatataaatcaagaaatccaaaaatagaaactctaactcttatccaccgccgtcttcgctcccgtgcctaggaaccgtcgttgtttctacggtagtgctcggagcacgtgatcaccaccgctccaaaggctgccatggtcgttagtggtcactccctttccgagcggccgcggatccaccacttccgagctggaggaacacggcggctgatatgccattcttgaaactgctgcttactcaaggccgccgtcgtcgtccccgcagttccggtggcaaaccacccctccctagggcagcaatgccggatccgccgctcttgaggatatcgttgtcatcctagttgtcgccattgtcatcacatcttctcgtagcgctagatccgatgcctccactgccattagatcgagccatcgtggagctgccactgccggatcatcacatcggggatccaacgatggcggatccactcgtcaagcagccagcgccggtcctatcaccgccctctcctaccacatgttcctcctgaggcctctggtggctggttgtcgaggagtggtgagataaagggaggagacgaaatgagaggagatgaggaaggagagactaaggagaggaaaataaaggagactgtgagaaaaaaggggaagaacatgagagaaaaggagaggaagagatggatttgtggccacatacgaatgcagtctctggcttcttagcaggaccatatgtgaaaattgattttcctaatatgtcgttactggatactgtatccattatagcctgtttgtaaaaataaatgaggcatctaagaaaaaaatcatttttagtaatgcgcccagcaggttgagcactcttaaacacatgtatccctctatttcaaaataaaggaccagaattccattaattactataaaagttatattggtgggtgatagataagggtatttaagggttaaaatttctcaaactgtggatcgatagtaagtaagaatataggtgttgaagcccgaactcctctagtggagagaaaggacacccctttcggtttcgaccaaggtacttgtgtcatagtaagggcttgtttagttgacaaaaaaaaattacccctgcatgttacatccgttatacggacacacatttgaagtattaaacgtagtctaataacaaaataaattatagattataccaagaaactgcgaggcgaatttattaagcctaattaatccaccattagcaaatgtttactgtagcactacattgtcaaatcatggcgtaattaggcttaaaagattcatctcgcaatttcttggtgaactgtgtaattggttttttctacatttaatactctatacatgtgtccaaacatttcacgtgacattgtgaaaaaatttgtttgggaactagacaaaccctaactgttgatgttgcggacagcagaagcaaagtcgggcatacgatgtactgtatcatagtaactgtatcttggagcggatcaggaatgagaactctatttcttgaagtatgatgagctagaactagggccatcaatgatagtggggccagcagctgatggggccacaacttgcaaatgtacaacggatctcgaaaagtttcgtcccgatagtttaaaaatggataataggtcattcagcgtatcattaacaaaataataataacagcaaaataataataacttatatataaaacttttatatatgtattttagtgacttaaaataccaatactgaaaaataaacttcgatgaacaaacttcaaatattatatttaagttttaaaatttaaattttagcggcgactaatgctgtatggagaaaacgatggggcctttcttctccagaaagttttatttttgttgttgaatggccgaattgttacaaaatagttcggaacagaacaatatatttttgtaggaaaaatacacagggaatgtgcaaaatttactaaacagacaatatgtttccgttgaacaaaggtagtttgttaactttttttctaagagaaacattagtgtgccgtcggtgtgttttgaccacagaaactgaatgaaatatttagttcgataactgcagcgtataatcgattttggtgggacccacaaaaataaatctcaatcccacctctatccactcctctcctctcgcgaccagccggaaaattccgcatgcgcacgttctcgttttccctcgttccccttcctttgccctctccctgcccaaacattccaaagctccaatccggtgataatctctccctgcccaaacattccaaagctccaatccggtgataatctagaaattaacccatggaggagagcagatcaggtcaaccagctatggatccaactagatcggatccttcgcggtgctcgtgtggctcgtgctcgtgctcatgtgggctgttgcacatgatgccatggaatcagtatgccgccgcatacggcgccgctgcaagctggctccagcggttgtgttggcgagtttgcttctcgttggcacggtcgtgcatcaacgaggtcatggagcgcaggtaggaaatggcaccctgggggatgcgtattgagggcctcaacaaacaacaccttgatccactaccaccgtcggttaaaactaattttgagtattataggagataagctcccgagtcccaccagtgctataaatagaagaaccgtagagaggagtgaatgctctaatctctcgccaaaccctaaagccgtgacgctatctcagccaacggcgtgaagaaggaaagcaaagccgaaggaagaagaagaaaaggcaagaagaaaaacagaggaatcaatttcaatggcttctagtgcaggtcagtagattaatttgtaattcgagtaaatgtaattgcttataagctaaagtaataagatcctgtaatttagaactccaacattgtggtatcagagctgatcttttacctaatccatccttcataatctcatcatccctgcctaagccatatttgcctttattttaaaccgagaagtggttcagcttgatgaatctttaagtgatatgagtccaattaaggttttaagctctactgttgttgcattctaattttattttgtcgagcagtagaggaaagatggaaggaggggataaactagattgaaattcctcaaaaccgtgtcactaaatttgtggagactagacacgctatcttcttagaaaataataaagtagggaactcaaaagataaggagagtaatcttgaagaaatccgggctaatgctccaatactggaaatccgagagactaatattccaatttttcaagctgtgccacagaatgtagtgccgccaacaacgggtaattctagaccctcttgctctaaaactactgtcggagggtaaactccttgagcggggcactgtggggacccccttccttgttcgaaccagggacacgggtgaggctttgagagtcgatgttggaagatgcagaggggtcgggcccctcgggaatgatggagacacaagcgatttagacaggtttggaccgctgtagaagtgtaataccctactcctgtatgtggttgattctggtgggagaatacaaatgctttctttctctgagttgcgacccccccccttcactcaggcatagacctccttttatatcttaagggattaccacaaaggcccaagacctagcttcaagggaaaggaaaacattctttacaggtaattaatgggtgtcttgtcctcccgacgtgtgaagccacgtgagcctcaccgcagcatcggccccatcccatcacgccgagcgtcacgggcggacgcacatgtcattccttcttaattgttgtcgactttcgactgtccggccccacaattgggaggggatctctcaaacggaccagtttgggaaaagctggtgcgagtccaaatgagaggcatgaagccccacattaatggtgacaagacgggggaggcgcaagccacgccctctgctagccgccgtcacatttgtcattccggttgcaagtggcccattagtgtgccgcagctgacaagacctctttaaatgcggtaggctggcgcggggagcacccgcccaggccacatatgtgaaacagagcgtggagggggtcagggtggcccgacacctagaaagaatgggaggtagccgccgctccaactccgggcccgacccccgaggggggcgccacgtgggcttggggcggccttctccctctatacagggtaccccggtttggcccgggcggtgtcgtggtagctggaggtgcgcggcaacggattagacacgtatggacgatgtacaaaatcgaatacatggaatccttgcttcttttttttattataggtactataaagatagattatagataaaggtaaaatattaaaaaaccaactcaaatatggataacgtaccaaaaatttggtggaaacagcttcaatttttataatagtagatagataggatgtatgcaacgtttttgtggtgttcagataatatagggtgctcttgtggtgttcatattggcatttgagaaaagtgggcctgaaggactgatctgggggagcaatttggatggaaaatttaggcgcactatacgtggtggtcggaaaaaaaatcacgcctactacggggacgatgtaagaaatttttttttggcaaaaacatgttaaatttttataatagataaagaatagacttgatttactcagcctatgatcatgatttttctatccgagtaaagcaatattgatttacttggattctatataaaaaaaataggaacgacatatatattacctgaagctagaaactaaagtttgcgtgtgccttatctttagctcttttttttctctgattggtgcggggacggagtcggataaccgaaaaaaaatcgtgcactgtacggagacgaagtcagataaaaaaatacgctactttgcatgacgtacgaaatctagtggcaaaaataccttgaatttttataatagatattacctgaagctagcaactaaagtttgcgtgtgccttatctttatctctttttttttctctaattggtgcggggacggagtcggataaccgaaaaaaaatcgtgcactgtacggagacggagtcggataaaaaagagtcgtataaaaaaatacactactgtgcatgacgtacgaaatcagtggcaaaaacaccttgaatttttatataactaaaaaaatacctgtacgttgcaacgggtaaagatg

SEQ ID NO: 67160 - DNA, 13159 bp, Oryza sativa
cacaaccgcactagcagctcctataaaccatcattccaactagttcatactactacggcctcccaatgcaatgttagacattaaacaacttaataagctaaggccgtcccattcctagcacatgtggttgcacagtatacttagatggtgacacaaagttcggtccttaattgactagggcgagcactccccctatcggtatgcaactagcaccatatgcataccacttgccgcccaagtctaaaatcacacttttacacattttaattcacaaatatcagagatattcacctctgtccagcagtgaaaatactccccaaattctcatttaaaaagtgatcatgaagttatttagcaactactaggcatggccaagcgtaaggcttttatgtaagcatgtataaacccaattgagcactttgaaagtactctaaccatttctaaggttacaatcagtgaggatcacaattattcaaagaagtaaatgcagcaattaggtcatagctaccataaccaagtttcaaataccgttatagtctaaattcacatgcaactttgcaaacaaatattttcaatcctcaaaacatgggattcaatgtgatcaaatattgggaggataaaacttgccttgttcctgggaaatgttagcacctaattcacttcttcaccatttacgcaattatctatataaagtacacgttatgcaattaaacaccaaaataggtaaaaacccaaaaggctctaaaatgcatgatttgtgcaccgtgggtaggtactggtctaagatgaatttaggtgaaagaatttctattttatctctttttatttgtcagttatgagttttagaagtttgctcggtatagggtggtatttacttaggtagtgttatgaaatatttttgcaaagtgatttttattaggtttgatttctcaggggtgtagagatgtgttttcaaagataatacatttggtttcataacttttagagttattatgaatttcttatgtattttacaagttttaacgtgttgtaggtaggtagcttctatgtgtacatggttttggagttttatgtccagtacatgtttcatattgtttgtgatgtataaaatgactaattttatcaaccaatataatcttagttcacaattttagagattatattactctactacacattttataagctaggggagtgttctatgttagttactgaacataccaacctagaaattgatatatgagctaagtgtgctaagtttttggtggttagggatggaactatgacctctctggtccatcaagttttattttggttacttagagctagagtacatttatatatacatttatacatatgtattgcctaaccaataccatgtgattagcacttatgttatctatttaaagtttagtgacatatttagtatagaaggtgccacattttaatttaactaattaaagttcattacttgctggttctgaagaaacttggttcattccatttggactaaagatgaattctctacaaattttagaagttgaagggtgctctaagttgtttattccttatataaatatttaggggcttttattgcactgtaagtatatatttttattatatatctttgaagtgctaaacttggttattctgcggaacttgagtttactcaaaaaggaagtaagatgaattttatataaatttttaaagttcagcttatctaaaactagttattttgtagaatatacatttagaggtatttggtgtaaagcaagtgcatctttttattttattttaccttagagagtaagttggtgaatctgtggaagttgagtttgcttcaatttaagttgaaatgaattctctatgcattttgtaaatttgtgcatgctttatgtgtagtttttcttagataaattttagaggtgaaatttatactgcaagtgccaagttttatgtttccatattaaagctcatccttctatgagttcacagaaacttgaatcatctcaaaatgagctatatttcactttgtatgaattttacaagtttgcatgtttttctgttgaaaatataaagctctagaggattttctttagattttcagatttttaagctcatggggtccacctgtcagtgagataccaatatgcaaaaagatctctgggttttcaggcaatcaatccgcagtcctatgactgttgcattgtgtggcagtttttacaaagtagtacctacagttttgtttcttctccacagaggtccctggttcgagctgaaacagagctagccatggctgagctcgttctcgagctttctggcggtgaacggtggcagatctcggcatgaaaccaaaagagaaaaggaagaggggttctttgcgaagctaatggtagtcttatcgtgatctgtggttaccggaatcaatggcgacggcggcacgagtggcggtgggtctcggggtagtgatgcatgtcacgttagaggccggatctaggtggataaaatgcatgcatgcaactctagaagctccagggtgctcacagtagtattggacgaggttggccaagcttggtcgtcgacgacggcgttcggaacggctcggcgacggcgctccttctccatgaacggcgtcggcttgactcactacaagaactgccatgcatgcgtgtctctcatgttatagtggtcgtaggaaatctatgtgtgcatggaatcgacttggagctcaccggagaaggaggaatcaaagatggagctcggcggccggagttggagaagaatagctcgatatctctcctcggtgctcggatcttggggattcttgagggcatttggagaggacctcgaggggaagattttggcgcgacggctcggccggattcgctccacagcagccgggacagcgacgaggtcgtggcggcggcgctccgggcgcgctctgaagctcccgtgggcacgatggcgttcccgtcgctgcagtggatgaaatgagatggtgtcaaaaggaaacttgttcggcatgaagattagaatacggaacgggaaagagttagagttggcaaagtcttgacgatgtgttgcggcgtccttcttcctggcggccggcaacgaagaggagagggaagacgatagctggagctctccctctcggtttctttggctcacgggtggtgagtgatgtgtggagatgcaactgggaggaggagaaagctagagatgcagaactgggcgtcctcacgtctcggccacgcgtcgaccggcgcccagagcgtgtcccctcttctctctcgtgttcttggtcggttggagaggagagacagaggaagggagcctgccaagtgggtccagggcgaagggaacaagtctggagtgagagaggtgggtaggagattgggtgttaatcgattttggacgattttcaggatttgaatctctctcctctctttgttaatctatagtttaatttttgggcatgataaattcatgtggatttttctagaggtagatgaggatacctagtttccattttcttttgtttctcttaaaaagtttatgtggtttgctctcagaaaattcgagaagatgggctcggtagatcattgtttgaatttttaggagatttaaacagagtagataaattctggaaaaattctatttattcatgataaataacctagtatttgaataaattatttcccctatacacttttatgcagtttaatgcacattatggtgagggtatgttttagccgattaaggattataattagtctatcatttaattgatttgactgatttatttgaggtatcatcctaagtgttaaaatttgaataaaattacagtgaattgtatgtgttgagtagagactacatgaattttcccatgattttaccttgcacgaattattttcaataattcgcaagcatttatttatataagtgttctcactatataaatgcatctaaatgtttgtaaaaacttatattaggaattgacttgaactgagttgttattatttgacttcactttcatgtccttgtaattatgtcacaagaatgaccatgggtttgtctagtagtgttgtccttttattcatgttcatgaacccaacatgatatgcaaccaaaatccaaatgcacataaaagacacaaatcaaactaatgctaaatgcatatgcatgtacacatttttgtttgcatttttgtcctaggctgaaaatggaaaggatttaatttgttctcaaatttttacttaagtacaagttaagttgacctcacctaggttaaagtagcaatttttggctcccaaaattggaaatgttagtttctaattattttgataagaaaattttaagacctagaattctggtatgtcacagttggtgtcatcggctcgtcccctaaacacgagagcgcgaaggttgcaggcataatgtttgcaccaacagtaagattataaagatttttcaccatggacctctctcacgagtcaaggaatggttaaggacggggagctaatccgaattgcttcactcatgatggtagtcagatgaggctggatccattggaaagaggactccgagagctttacatcaagtactcacggaccgaaaatggagttcatatgcatatttggctgccgttcgaagtcaacaatgtagtaggaagccgaataagattgcagcatgtcacaccctaaaaatcctaaatatataaattgttgtttaactggaattattaaaatttattttaaaagtctagaaaagaagatctaattttaaataataaattccaatataaaatagggctagataaaatttcattaaatactttacttaattctataattcctagatttttctgggatttatttgagctaaggaagtatttttaataaatagaattgcatttcatgaataatttaaattgaaaaaggtttttaaaatcctcttttggctttgggccgaaagtcggcccaaaaccttctctctctctctccctcggcccagtcggcccagtcagcccacagccgcccgcgcgagcgccctcggccgctgacaggtgggtcccacctatcggactcgtcgtcctcctcgcgccatcgcccggccggaaccctagccgagccacgccgccatctccttccaaattcgctcgcgcctttccttctccggtgaaatcaattgaggggaaatgtttcctgagatctcctctaccttttctctcttggaatcgtcggctaaatcgtttggaaatccgtggattcgagttcgattcggatcgatctctctcctccgaaccctaaaatttccttcgcgtcgccggtcaccgtgggccttcgccgccgcctccttgcccctataaaaggacccccaagcccgccgctacctgccgccaccctcgccttcgcctctcgccacccgtagcgccctagccccgtgtagcctagcgccgccgtcgtcgccgttcgtccagccgtgcgccgccgccgatcccgtcgtcgtcgtcgctcgagaaagtcaccgtcgtggtcgccgtcgcgtcgccgtcctcgtcctcgggaaagctattaatattttgagtgcaaaaaataataagtgtgagaagatctatagaaaacaggagtttatcattgaatctcttaattctgaaattgctagattaaaatctcttattcctaatgatgatgattgctcaaactgtgaggttttaatgaatgagatttcaaaaattagaaatctcattcattaatttttttttcaaaaattagagatgtaaaggcactatgtttagccacgtcatcaaaatagtttgaaccctctagaaagatggcgactctcttctctggcgacatccatggcgactctctctagaagatggtcatgccggcgccgcctactggatgggatttctccccggaggattccatccgcgatgaagtttggagccgttttggttcaccagtgcacttttcctctcattttagccgttctccgtttcgattagtggttgatgttcctcgttcttcgtttcgattgaccttgtcctcggtggtgaaaaacgtccggttttcatgtttaggggggtaattcatactcacccaatagttcaggggggtaattcgtactttttccttttccccctgaagaagaccttccccctgctggtccaaataatgatgaaaatcctgatggtaatgatgatgatgattgtaagcaagataatatttggcaatttggcccacatcctgtggttcttgcagaagaagaccaggcttggaatcaggctgctgtgggccatcaggccatggaccttgaacaagctgctcctgagaacatgggccagattgataacaaccatggctggaatctggttactaacagaagtttaattttcacccttgctgatgcttacaaagatgccttcaattcctggtctgccaactctctcgcaaattcagcccttaatcctacaaagcttaattttaatttgggaaatgaaattgtgccatatgattctatttcttttgaatcttctgctataatcctgagcccagaacctctagctgtcatccctccgcagtctgtgatgcctgttttgcctgaggatccttttggctcaatggaggaacattcttgtccttctactccaacaggcatggaaatagagattagtcttccaccttcccctaggaaaagagggaagaagagaacaccttttgttgactctcaagttagaaggagtggtagacttctggctcttagggatagtttcaagaatactctgcaagaggatccaaacatgggtgttggaaagccaagagggaaggcagttaaaaagctgaaacagttggctgaggcaagtggaattgttttcccatctgattctttatcttctactgatttaaatcctgatatatcttgtgagtctgaaagtgatcttacatctgttatacctgctgattgtgatatatcttttctccagaagattggatctaagatgtgtgggacttcccttgaggaggtttcaagcttggtggacttgggagaagctcaggtcatcaagccgaaagcaattggaccatccaatgatgaagcctagttctatcagacttttagggctgctagtggcactcttttggggcatgtgtttattcctttatcagcccttttattttgtgtttaagttatgtaaactctatgatggtactatgtgttggtgtgcttgggaactgcatggattattcctgcttgttatctttctctctttaagactagttgtcaaatgaattcggctatgagaaattggaatgtcctctgttggaatgttaggggtctgaattctgatgacaaatggttagccattagaaataaaattgaggaaagtggttgtgctgttttttgccttcaggaaacaaaaagatcttcttttgatcattcttacataaagaagtttgctcccaaacgttttgataagtttgctttctttccatctgttggagcttctggtggcattttagttggctagaacagttcagtttttgggggatcagatattataattgaaaggtttgctgttaagattactttcacctcaaatcattctggtttagtttggactttagtttcagtttacggtccctgcactgctcctgaaagagataacttcctgtcctggctccaccagttgaacattcttgatgatgacctctggctcatcttggagactttatcttctatagatcagttacaaatagaaataggccgggtgcagacatgaatgatattttcctgtttaatgcaatgatcagtgatctgggtctagttgagctgcccctcaagggaagggctttcacttggagtaacatgcagcatagtcctctactagagcaattggattggttttttacctctactgtttggaccttaaccttcccccataccttagtaaagccacttgctcggtctacttcagatcacacaccttgtgttgtgcaaattggaactgacatccccaaggctgacatcttcagatttgaaaatttttgggtagagcataatggtttctttgatttagttcaatccatttggcaaaatcatgggtatgaaggtaatgtagccaagaatatttttgttaaattgaaggctttgaggaaaggtttgaagaagtggagtaaatctctctctaaacttcaattgttgattaaaaattgtaatgctatcatagcttttttggactccattgaaaacttgagagatctcactgttcttgaatggaactttaaaattcttatcagaaacaagctactgttatacctgaagtataaacaaacttattggcaaaagaggtgtactatcagatgggccaagtttgggggtgagaatacaaaatttttccatgctatggctactgagtcttttagaagaaatgcaataccctctttggtagattcttctggtttagtttgtacaagacatgaggaaaaggctcacatagtgtggagtcctttctcttcaagaatgggttgttctcagtttgagttcatgccttttcagctgcaagaacttttccatgcaaatcaatctctagcttctttggatcaaccctttggtatttctgagttagacaaaattatacataatctgcctatagacagagccccttggcctgatgggtttaatgggatgtttgtgaagaaatgttggccaatcatttgtcaggattattatagacttgcagctgagttctactctagtacactggaccttgatcctttaaaccattcttttatcatcttggttccaaagaaatctgtgccagaaggtataaatgactataggccaatatcactcatgggaatctctcttaagattttaacaaaagtcctggttgatagactgcaaaaggtgatattggagataatcagtcagaatcaatatggattcataaaagggagaactatacaagactgtctagcatggaactttgaattccttcatcagtgccatcactccagaagggaaatagtccttctaaaattggactttgagaaggcttttgacactattgaacatgaagctattttgcttataatggaagccatgggttttagtgctacatggcttggatggataaggaagatcttttcttttgcttcttcttcagttctggtcaatgggatacctggaaaaaatttccactgcaagagaggagtaaggcaaggtgatcctttgtcacctttactctttgttttaggagctgaacttctccaggtcattctatcaaagccttttccatcagactttgacccaaattttcctattgtccaatatgctgatgacaccctgttttatttgaaagctagtagtaaagagctctttactctaaaggctttatggcaaaccttccagctgggaactggtttgaaggtaaattttaataaaacttgtctcatcccaataaatgttgatgaagggaaagctcagaatttagctgcagtttttggctgtcaattgggatctttgccatttacatatttgggtttaccacttggtactattaagccaaaggtaatagattttgcacctttagttgacagaatcgaaagaaggcttacaacaaatgcttcattcttgtcttatggagatagacttacactggttaattcagttttctcttcactacctacttattacatgtgtactttaatgttgccaaagacagtgattgataacattgacagagcaagaagacattgtctttggagaggctctgaggtcaattccaataaaagatcttttgcagcctgggataaagtttgtaagcctaagagaaaaggtggtttaggagtgctaaacgttactatccaaaatcatgctctgctcatcaaatttttggacaagttttacaataagaaagatttgccctgggtcaattttgtttagtctgcctattatggttactctgtccctcatctgacaaacttgaaggactcattctggtggaaagatatttgcaaactgatggatgtctttagaggtattgaaaagtgtaatctgaaaagtggaaatacctgctccttttggtatgatgtatgggatgatcaaccccctctttttcacactatgccaaggctttgttctttttctcaaaaccagaatgcatctgtctctgattttctgtccattgaggctgaagaaaattttacactatctttatctgctcaagcttttcaaaagtttcaagagctcacttcttcccttctagatatcgagctaattaatgaaaatgatgtttggtcttacatttggggaaatatgaaatattcttcacagaaattctatgcactgaatttcagagttattaagccaccagttcattttctatggttatggaagtgcaaagcagtttcaaaagtaaaggttttcgggtggctactcatgatgaatagattaaatactaagttcatgctagatcataagaattgtgctcctccggattgtgatctttcttgtgttctttgtcaatcggcagctgttgaagacctcatgcatctgttctttttatgcccatttgcccaaaattgttggagtcttctaggcattacatgggatactaatctatctttggaagcaatgtttataagggccaaattggattatcaggggagctgtttcatggagaaattcctttatgctacttggcatatatggaagcaaagaaatgggttcatttttgagcaaaagatcctctctttcatcacttggaggcaactcttaaagggtgacctctttcttctgttgtttagaatttctgcgagatatcacaatgtaatcataagttagattaatgggttgtaactttgttcttgttttcttaataaagtttttttaacagcgggggcctcccctgctgtgttctcttcaaaaaaaaatcagagatggtaatgctgcccatgatttcaaaaatagatcttctctagctcttaattttgctttgcacccaggcactttggatgagttgtttttaactaaaaagttgttgcaaaaatatcaaattgcttttcatgctagtttgatgtttaacatgatttgtgctaaaaagttaaaacaaccacatgatgttttggattgctcaacatgtactttgagtaagatgaaactaaaagatgctttaggtcgtgttgagtacatggaagatgttgtgaaaaacaatgaagtgctttcttgccccaagtgtcgtaaaagcaaaggtgtcatggtagattgtgaaaattgtgctaatttggaaaaagaggtttcttatttaaaaaattccttgcaaagattttctgatgctaaaaagaacctcaacatgattttggatcaatctaaggttagcacacataaccgtggtttaggttttaatccttatgctcatcatactagacatcctcctgttgtgttaggtgttggtgctagaagtggtgagattttggttaaacctaatactaataaaactgtgtttaaatctgctggtatcatgtctaccttgagtgcaccttctttaaaatccaatgttgtgcatgcaaaacctcctattgttacttgtgttgctaaatcatctgattctactaatgtgtctaaacatcgtgaaaaatatacttgttcttgttgtggcaaagatggacatattgttggtttttgtttcagattagctcataaacaaaaaaggagagagagagattgcttttgcaaaatcaaagtggcaaaaatctggtttttcctcgaggaaactggtcagaccggctactgagcagcggtcagaccgggcaccggtcagaccggcccccggtcagaccgtcagtaccacctcggtcaaatcggcctcggagaaatttttcagaaaattctcaaatcgtttttgcacgtagatatatgcctattggatcttctggtcgtgtgtctcagtactggattcctaaatttttattatcatctaacccccagtactaaggctttggtggcaaggaaggagaacgtgtggatcgtggatcccggttgttcgcggcacatgaccggtgataaaaattggttctcctccctcaaaaagacatccaaaactgaatcgattatctttggtgatgcgtctacaagtgccgttctggctacaggtttggttaaggtaaatgaaaaatttgaattgaagaatgtagctttggttgaggacttaaagtacaatttgctttcagtttcacaaattgttgatgaagattttgaggttcattttaagaaaactggaagtaaagtttttgattcttgtggtgattctgtgctgaatatttctcgatatggaagagtgtttaaagctgattttgataatcctgtttcacctgtgataacttgtttggttgctaagtttgataaagatgtaatgttttggcatcgtagacttagacatgttggttttggtcatgtcactaggttaagtggtttggatcttgttcatggtttgcctaaacttaagaaagatcttgatttggtttgtacactgtgtcgtcatgctaagatggttgcttcctcacatgctcctattatttctgtgatgacggatacaccaggacagctattacatatggacactgttggtccagctagagtgcaatctgttggggaaagtggtatgtgttggttattgttgacgatttttctcgatattcttgggtttttttcattgcaactaaggacgaagcttttcaacactttcgtggtttgtttcttcgattggatcttgaatttcctagttctttgaaaataattcgaagtgataatggtggtgagtttaaaaatgcttcgtttgaacaattttgcaacgaaagagatcttgaacatgaattttcttctcctcgtgttccacaacaaaacggtgttgttgaaaggaaaaatcgtgtattggttgagatggctagaacgatgttggatgagtataaaactcctagaaaattttgggctgaggcgattaacactgcatgctatatttcaaatcgcgttttcttgagatcaaaacttggaaaaactttgatttggacgtcaacccaaagtttcacatttgcgtgtttttggttgaaagtgctttgtcttgaaatctgaaaatttggataagtttgaggcacgttct

SEQ ID NO: 67161 - DNA, 29387 bp, Oryza sativa
accattttacatttaacctttcattaaacaatttaacaaaagatactcccaccatgtattgtgaaacaaaattccctcattttattagtgtctagttagctttggcatcacagctacacaactatcaaaataggtaagcaacaccttgctaatcacatcatatgtgactcttgtgctgttggggtgacatctccatgtccagcccaacctatgccccaaggtccaaaactgttttgataaccttgtcaagtaaaccaataatctccgcatatagatgtccgacatctatcctattttatcatgataaaaagtgacactttgctatggcaaacccatcacttatgatcacaaccgtaataggtgcaattattggaagagcataaattacagttaatttttctgagggaatctatcctaccatgttatatcaaatatacaacaacaataaagtaagatagatataaaaaccccaagcgaaatctaaggggcaacgcacacggcggtcacgggatacatagatcacatctacgattcgccatgtaaaaaccttaacggcataaacaaattatgccgaaaccgagtcaatctcattggctcatttttctcattggcgtgcggttccagtggacatcggactatctgatgaacacaatcgcgctcggccttgttgagtactagacattccagtgaagtcaccaacacatataccgattgatctcatcaacccatgcgtctgtcggttcatctcatgttccgatcacctaagaactcatatacaacataatagatctcatccactacatccgcatatcaattatatgcaatgatctagatcataagctatacaaggcggctctgataccactgttgggatacgcgtaggctacgatagcataaatcaaaattttctatcgcgtaaaccaggaaccatgcaagtattagatcatagatcgttaccactcgatgcgttgtgcaacggaagaagacgctgagaagtcgaaggaactctcgcgaagtaacgcgcgtcgatgtagaggaagtaatcgatcgcacctactcgaccttctcctcctcgtgcattctcctcgctgtactcccacgctgattagcaccgcaaaccagcggcgcctttaccggtatccacacgtacagagacagaacgccacaacagatattctagcacccgcgcgcggctagggttttgctcgggagggaagtgacggctagggtttctcacgtgatgcaatgcctccgccggtcacacccctcacgaatatataggatccatcactcgggcctccaaggcccgtaggactcctattcggatccctatccgaattaagctcatattggatctctatcaaatccccttattctggcccattaagcgtgtgaccctgtagattcatatatactcgaccgtaacccgaaaactccttttcggtccacgcgtaaacagcggcccctagcagaacgtattgacccaccgggcatacataaagatcatatcggctgaacctctagtgtatacttgtatgaacccttttgcctcacgatatcgattaagctcaatgctagatatatgccatcctctaatagctcaatcattcactcgaacctgttgatagattatataacttgtgattgactcctcaatcacctttggcatggtcatgcccttccataatctacaacatcgaggggcccaaagatatctctccatcttgattattcatatcccactacatgtttcataacatacccgaaaactacttttatagctacccatttacggagtagcgtttagcggtccctaagtaagctactacatatgttgagaaccatgataatctcaagtctaaggattcaacaccaacactaaatgagattactgatgacacaacacatatagctcttgcagtgtctcgtgttgcgtctatccaacaacatgtgcaccaacatgtgtccacattattaatttgatatctctataccatgatccatgagacatgatcatcaattaatacatatgctgatcagataaacatatttgttccacatatgatatttgatcagggatcctttagaaatagtaacaaacaacataaagagtctcatgaaaggatcacatattcattaaccaataaggagttatctatttcaaggaacaatgtcggataaatatgtaaaaatagtatgtgatacaatcatctctatgattgcctctagggcatatcactaacatatattgtgattagaaacaatggaggggacatggagacacttggagaaggacgtagagccatggaggatcatcgaggacgtccaactcaaggtggaggctcaaactaattcgacctcgggttcaattcggagtccaggaccagtctgcacgaaaacgggcgcccaggtcgcatacgtgctcggattggggtgttctttatatggatggaaagctaagaagataacctttccaatggttctagtcccacatccaaattctttccgagtcaatgggaatcgatcgaacaaattgacatccagaatctgtcctggtgctgcatcaccgtatttgggcttttgggccatgtatcgtgttggaacccattagggttgcgtcgagagggggttgcacgaccctaaactctatatataagtaccaccgccatctttaggtctttgggttttgcttagattaatctgtcaagaacagtttcgccgctagatcggtttgtaagaccacaactcgtgagcttaattattcatctgcaattttggttgttttctatctcgttcttgtttgtcttcttcgattggcaaacagggattagccttctcagcgagatcatccctgtttcgacacgggtgataactagaggagacgtggtgttgcgattgcggggctcaagagcgtgcgcgttcaagaaaccggatcgatttgtgtcgcgactccgcccaaatcgttgtttatcagaacctttcagaagatcgggaaccctagtgcacaacccaatcagactcgcgagcatctgatgcaggcgggttcaaaggggaggcggcagcatcccgggctcagtcgactgtcctgaggttgaagaagaacagtgccgagggaagcattgtagacttttagagaaaaggaaaaagaaaagaaaagaaaagaaaggaatggagtagcaggctggcatggctagcagcccgagagaggctttatgggccaaaaatgaccaacggcctagagaaaggttttaaaacttttccttctttgaataatccgtgaaatgctatttcattgattaaaaatacttcccttgctcaaataattcctagaaaaatctagaaaatagataatcaaacaaagtatttaatgaaattttatctaactcagttttatgttgcgatttttcctagattattagagtttaacttgtaagcttttaaaataatttctaaaaatgcattaaagaatgaattattaaattaggtgatttttcgggcgtgacaatcaccatctccgatactcagattaccaaatttggttgttaacagtggttttactagcgtcttccaataacgattcctaggcattgttgttttcttctctaggaaattctgcatgaatttcaccaggctgtccgtcttgggtggctccacttcgacctcttgaatattctgtgggttcggcccgtactttattctgaccatggagcattgttccgtcctcggttgaaactcaaacttctcttccttgccgatgatgtggaaacggatacttcctgttcccacgttaatgttggctcccgcggtgctaaggaacgggcatcccaggatgagcggtgtcttttttcccgtgtccatatccagcaccacgaagtcatccgggatgaaaaaatcccgtatcttgactggcacatcttccgctatccctgccgggtaacggactgacgaatgagccagttgaaggtgcattggtgttggtgccaacactgttaagttgagcttgtcgaagatgtcttttggcatgaccctgacactaactccaaggttgcacaatgcctggtcgaactattgtgccccgatcaagcaggtgatcataggacaccccggatctttcttcttgtctgggagcttgtggagtatcaggttgctgcattgttccgtcagcttgaccacctccgttgttgggagcggtctcttgttgttgaatacgtccttgagataactggcgtatgttggcacttgcatggcgtccaacaacggcacgttgatgtggatcttctggattacttcaacaaaacgagtgaattgctcgtccactgacggtttcctactccgttgagggaacagcagcaatcatgtgtcgcagtactcttgcggcactgtcttttttggctgaacttccttgtcagtcgagccattagatggcgcttcttttgatatcccattagttcctacagggttaggatacggcgaatcacgagtggacttacctcccctcgtcatgatcgccttgacattctcaatggaggagtcgggttgccccgaaatcctcccagtttcatttgcagggactaaggatgccaactgagctagctgggtttctatcattttgttaaagctcagctgattttgaaaagcggaagcaaagccatctaacttgacatttatgttttctaggaccttgtcattggctgcaagctttttgcttaacgcatcagtggttttagcttgcgcaaaaacaagatccttcaaggagagctggttagaaaagttaccgttgttgttacctccttgataatatgggcatggttggttccacccctcacctccttgtggacgatacctgttgttgttgttgccaatgtacatcgcctcctcacgggtttccgggcagtcattcccagaatgacccgtgttgccgtagacctcacatgtgatgtgagagtccaaggccttgacggtgccttgtggtcgtttcttgtggtcgtccaatcgcttcatgagaaggtccagcttggcagcaagtaactccgtctccttattggtgtgcatgcctcgctgacgggtctggagtcgttcctcactccaacccatattggagaccatcttctctattaaatcagcggctccttgaaccgttttagagaagaaagcccctccagctgccgcgtccaggtgatcgtgggacatcgagtgagtccattataaaagttctgcaggatcagccagttgtccatcccatgatgaggacaggcgggcacgtactcctgcagacgctcccatgcttctagaatagactcatctcttgtctgttggaaactagaaatccttcgactaagggcattggttttgcctatcgggaagaatttcgagaggaatgccgtagagcatttatcctaggtgttgacagcagcacgattggcatagaaccactgcttcgctctcccaagaagggagaacggaaacaatcgcagcctaacggctttgggactgacgcccttgatggtgtacgtgctacatatctccaggaactgtttttttttactgaaagtactgccagggctttgcccagcagtttaaattttataaaatataaatatgtacaaagttacaaagggaaggcaaaacaaatatgctacaaagtttgtatccaatcagaaagagattgcttgagtggatctttcattctacacatatgtagaagaacttctttaacaaacatagatttccatgattgaagtgatggctgaacagtttgaaagattaatccattcctttgcttccaaatatgtcatgctgccatgaaaaaaacatcaaggaaaccctttcgagcaaatctgattctcgccaagacaagcatttggaaaaactccaagttataattctaggaaatgcccatctgctgctaacaagccacactgaagggacatgtaaaaaacagatggagcctagtctctctttgatgtgtgttgcataaggcacatgtgaggtcatcgtcctcttttgcacaatgtcttctgtcaaagcatgtcccttgtgttgagtctatcacaaaacaagagccatgcaaagacctttatcttcatgacacatttggtcttccacagccaaatcatgggcctgggaggatgtagtgtggagaaattgagcttataaaatcttttcgctgtgtacacatctgaaccccaaatgaaactccaaacatcacctctttctggctgaagctgcagatgatttaactcctctcgtaactgcaagaactctccataagcaacatctgagaggggcaagataaaagaatcttccagtggccgtgagcacatgtcctaaactgaatcatttctgaataaagtcatgttgaagagattagggtagcttgtgcacctaaaatcatcattccataagtcattccaaaatagaacagatttccctgactgaactgtgcacttagctacacctctgaagatatcagatagggaaacattgtctctccaccagaaagaacctttgttcaggaccagatgtggcactctggattcataataggtttgagagatgagcctgaccgatggcaggtcagctccattataaaacttgaccaaatgctttaaaagcaaagcagtgttctgaactctcaagctgatcacacccattcctcccttgtctttgggcatacatactctatcccatgaagctagagattttctagttgaggatggattgttacctctccagagtcaattctttcttgctgtatcaattgccttgatgacagtgactggaagttgcagacagcgcatataatatgttgggatggaggaaagaactgagttgatcaaagttaatcttcccccttgaggcaaaaacatagaacttgctgtcagcctcctttccactctatccaccaatggagcaaaatcaaccactctgggtctagtagtaccaaggggcaatcccaaataagtaaaaggcagggaaccaatggggcatcccaaaataccagccaataatgatgctttgtcctgagatagattcaaaggatataaacttgacttgctaaaatttacctttaggcatgtggactgagcaaacatatttatgatggctttcaaacataagacttccttttgagaggctttaagcagaatgagtgtgtcatcagcatattgaattattgggaacccactaccatcattctcatttattggcttagagatcaaacccaactaaaaagctttattcacaactctttgtaacagctcagctccaagaacaaaaagaagtggtgagagaggatctccttgtcttaccccccctcttgcatttaaaagattttcctggaacactatttagcaagacagcagaagaagcagaagagaacaccattttcacccattctatccatttttcaggaaagcccatgtgttgaagaactgcaagaatagctgagtgctcaatagtatcaaaagctttctgaaaatccagtttcaaaaagaacaatttccctcttagattgctgacattgatggatgtactcaaaagaccaagcaaggcaatctagtattgtctttcctttgataaaaccatactgattctcacttactagcttaaggattatgccttgaagtctgtctgccaatagcttagttaagaacttcagagaaagccccattagagatataggtctataatcattgacagtctctggtgaattcttctttggaaccaaggttatataagagctattcaagattttcaagttagtgcactctgcatgaaaatatgctgctagtctgtaatagtcctgagctattatatgccaacattttttcataaaaaaaccattaaaaccatctgtaccaggggctttatctgtcgggataacagaaacaagactgtcaatttcctgtgtggaaaatatgtccaccaaacattctaggtctgtatgtcttgggaagagtgtactcaagtcaaaaaccattttagggtcccttgcaactcccattctattcttaaaacactgaagaaaaagagaggccttttgctcatgtaaatgcacaaactgcccattttgatcaagaacctgagacgttgtgttgattctatatctctctgttgcaatagactagaaaaatttgtattttcctcaccaagtaacatccatctattagtacacccctttttccaatatatctttctgaattccaataacttgaggatttgcattttcacaatttccctgaaattccattcaaagattgaaagacatcttgtttcttctaccagatccaaaaaatctatcactttgttatagttagtcaaaagtaacaacagctttgacagatttttcctccatgcaagaagccttttccttaacactttcagcttaaaacaaatgcatttagcagggtcttcaaaacctggatctgtgtgcgaaacctgctgaacaatgtcaaaaaatccctccatctccacccaatagttttcaaatctaaaaataggggactttggaatttttgtgtcaatcttcactacacagggcacttgatcagaaatatttctagtaagggggacaactgttgtgtttggaaaatccaaagtccaaggagctgatgtaaagacccaatccaaccttccaaggaggggattatgctgcatgttgctccatgtgaactttctacctttaagtgggatatcaagcaagccaagagagctaataatgtcattaaaaatgaagatatcattcatgtcagcaccagctttgtttctatcatgcacatacctataaaaattgaaatcacccaggaaaagccaattttgttgatcaccaatcactaaattctgaaccaattgacaaaatcagatcgctctgggccacttgagggccataaacacaagtaagggaccaagtttgagcagtatgtctggaagtgaaatcaacagtcacagagagcaaatttacttgaaccacagttccaacaaacattcttaaggaccagaccaccagaattcctcctgatgcaccactagagggtgcaaaagcaaacgaatcaaaccgttttgggacaaacttcttgatatcagagatatcaaaatgttccttttttgtctcctgaatacagaaaacctaacatgcacagttatcaattttttgtcttaaggagagcaatttttgctctgcattcattcccctaatattccagtgcacattccaagacttgtaattactcatgaataaaataggattgaaacaacaaccaaacagagctagtataactagcctataatgtcatagccaacatagtgctaacaactgaatcaatatatgacaaagtctcaaaaccacttgaccaaacacagacccttatagaattaactaaaaagaaacacaggtctgacaaaaactgtcagaacattaaaatcattttccctccatgtcaggcctgggcaccttctttcttcttgcaccccccaggctggattcagctacctcctcaggagctaggctgcacatatccactcccatcttttgcaacaaagagatagaacagtcagatggtgaggaatcagagtgattatcatcaggggcatattcagcaaaatcagactctttaatgttaccatcatcaaggatttttgctatacctgcaagctctttcaatttatttgcaaattttccccttggcttaccaatgcccattataggattcacttgtagttgtacttcctccttgctctgctgcaaccttgcactctgcctcctgtaaggattatagagtaaggtcttgccatctctttttttcactggagccttaggtagcacaggaagagctagtgcttgaccaacaaggctagaggaaggctgaacagacaaaggcatgacttccagcacttccatagcatcttgggcctgggaattcatggtatcatcatcagtcttagtgggaaccagggcccaatcctttatctcttgtcacgtccagaaattcactaataatttccgaacttatttgtgcataaaatcttcgtccaggaaacagccgaggtacacaaactgacaatttaaaatacaaatccatcctaataatagcgttacatacttacaaaagaaaagaaaaaacaacagaggaattaacggcctagcgatggcttcagctccactcccacaggcagctcaactggggtataagctaaacgtcttctccttctggatcctttttcttcaactgaggttgattgattattgcaaggtgagtacatggaatactctgcaagccacacaacaaatatgcaagtgcataaggataccaaaggatggcataatataggttcatttgcaaaaacatcatttagcaagcatttaagagtagtaaaacagtagagtaaataatcatcaattttaatcaacactgcacaacacacccatcctgcacaggcccaaccatcctgaacaaccatacccggctgtacagatctaactccaaaccaggagctaaacaaattattaccagttatagcatcaataattactgtgagaggtgtgagactaatcacgaaaaacattgctcaacccgcccatgaccgcgggcacggctattcgaatagttttactctggccagaggtgtaccactgtacccacaagacacaacctcaacatcatgtctaccatgcatcgcgatactggaaagtacccgaatagaggctgtgacaataccctctacacaacacaactcaccacagtgcaccgttcctggatcataatcaccccctctacaaccagaggcatggactccccagcgacacccatggacttctcgccgcttctcagtctgggaccccataatgaaccgtgctatacaaaaggtaaagccgttgcccacgctggcttgtggttggtacggttaatgtctgacaacagtagctcgcgaaccggtccttaattgtcatgagcacgaccttcaaaaccatgtgctcacaacccaccattgacaagttttaattatcaattaattatcataacatgattaaccatcgtgagctaccattaaatataatcataaataataatgtagtaagattcatcccattaatgagctaatgtttctaagcatggctaagcaattatatatatagcatttaactgaaccaaaccaatatataaggttcaagctaatcaatttattacccaaggtatcaaggaatagggtattcaatgcaaattggccataacaaaggaataggttcacaccacccggtgacattcgaaaataaatgcacagttgaaataaatagagaatttaaatatatgatcaatatgcacaaaggattgtgtttaggatctgtgtgacttgccttgcaagaatcggacttcaattagtcttcttgaacacttccgatgcactcatgaaccttcgcaacgacggaaatgacaagctaacacgcaaaacaaaaaaaaagactaataaaaaccaaataaacagtacataaaagtaaacaaacatgtagatcatgattttagatgaatttagagacttgaaccacttaattccgacttcatatgaattagttatgtactttacaagataaatctgattttagacttatacagaaagggattaacgatgtcatgacgacatcactgccggcgttggagggtttgggcggccaaaccgagggcaccagaagaaagaacatgacgaggggaactcactgaggggcggcacgacgaagaacgacgacgggagacggccagcgacgagctccgaagggcggcgaggtactggtcgacggcgacagcggctttctggcgatctttagcggaggaaaattagcggacgggcttcaccttggcgctgcgatgccgaagaaggcgacgacgacgtccagcaaccactgagtcgacggcgaggctcggccggaggtgaagtagatcggattcacgccgacgaggagcttccagcgggttacggcaaaaaggaaccggtggccgggcttcttctcctccttgcgaacccggtggtgacggcggcgtccagaggcgacgatggacggtgacgagcggcacggctggagcggctgccggcgacggagagagaagatggctaaggcacgggagctcgagcaaggggtttaaaacgaaagaggagagcctggggtttctatttataggcaaaggtggaggagattagctcggacccgagaggagagaatggcgccggatcgggaagaacagtggctctggtggtagaagatgacactgttgtgacagggaggaagtagagtttttgcttggcggaaaagaaaagaagagagggactagaattagacttttctgggaaagaaggagacaggaaacagagacaggcaaagaggaaggatgggctgaggatgagtagacttttccagtttcagcccgaaaaggaaaaggggaatttcaattacttttccaattaaattaatcactgaaatgatctttgaattgttaaaaatatttccaatgctcaaataatttcaagaaaaatcctgaaagtacttgaacactataagtatttaacaaaattataatcagaccatttaatgattaatttaatatgtggataattactgaaatgttgtttgtattattaaaattaggagttgagcttcgaaaaatccaagaaaatttcagagagtatgattaaccatggagaatttaataaaaattaaatccagccatgctttatatttaggaaattttatttcccacatttaacttcacttgtaaattaatgaacatttaatataaattctaataataatttattaaataatttataaatcctgaaacgaaaatcaggttgtgacatctcttgacccaccaaaggagcaaaatcaaacattgtcgttttgggaaggacaagtgtggtaaaaggattggttgcatgtatggcagcaggaacagaactggaggctaaaaactgatgcatagttcccttttctttgcgcagaagatcaatcttatcattcaggccagacattggataaaaaaatggatgcgcaggattttcacttctagcaattttgcccaacttagctaggaattcctgaacctttgggtcctggactgaaacttggaccttgtccttcctaacaagagaaacagctgtaggaacaggagcactgacatcaggaatagcaggtaccaaagctagcataccatcaggattaacctccattacttggcccattggatggtcttggctccatgcattgtccagctcagcatctgcagcttgttgacccgcaggaggctgacccatctgccaaatgttacctgcatcaagatcatcatcatcattatatgggtcatttggatcatgttgagggcccgcagggggcagatcttcattagggggcaagttgagaaaatccccttctaacaagaaaactgaaactgtccaagactctcctcccccacccatacctactgggtcgtgcagaacaattttgcgcggtacataatcgttgtctttaaacttaggccttatcagaactctccatttcatctcatccctttcaagctaaaaggaaagctgaccaaaagtgattgtagctaggtttagatgatcccaatcaacaaagtcaaggggaaaatccaagaaaagaaaccagccctccctattgtactgcgaggctctccaatttgttccctgatcatgctttacgaaagaaaccgagtgcacaccatcatagataaatggctcactatggaccagagcatctctatgcatagcagagcgaagttgatacatacccaccgcagaagcatgacgaaagctatttctgacctcaaaaagatgctcatcaagaatgtgatgcaggataagcatatggtggtgatcccaatcttactccggcactggcggctccaccaaagcaaggcagaactcctcatggcgatgaacaggcctttcagggaatgtgagatcaactcttgggacacgcaaatttcctcccaaatgcacaatgtgaccttgatggaggaaacgaagggggttagggttaagattcgccattggcaagggaatcggggtccggggaggcttgaacagtagtatcaacagtagattggaggagatgagggggttgcgtgataaccggcactatctctttaggtctccaaataaaattgccattaccccgggagtttaggactgcagtagaattaatgcggggggaaaaaaagactttgacaatttaaccatggagacaggcctagagctgcatgacccatattcatgcaggtgcggcaccggaaaggcccaacacaggcagacaaagaatgccccttctctaagcaacgtccacaaattaaatttgaatttaaaacttgcttaggaaacggatcccgattacctcgctcattttgaaatttgagactagccgccggctggatcaccggagctttggtcaccagaatggtggtcgctggagaaaccacgccatgcaccttcaagggctcctttaatctatcaaaaacactcttcaaaggaatatcactgtgaacagcttgagcgtaagaacgacccggttgtcccagagaaccagagatacgtttcttaggagccaccgaaatccattctttttcttgatcacgggtccaagcatcaaattcccattgccaattaggtccaccatttctccaaaggaagaagcgtagaacaaaatcatcacaagagaaagacctcaaacgataaatccataaacccactggcttggagcagaccaagaaagaataagaacgatctttaagaagggtaacagagagatccacaggagaaccaccaatcacagccctgagggctagagcaacagaagacgttgtcaaacgaaaatttgaacggggaatatccaccgctaaccggaaaggaggcgagctgaacttagcagagaaataaaccggcgatcgaaaacgatgccaagcttcatccctaattgcatcaccgggagagaaattccaccctcccagcggtgccggagtcaccatggaggatcactggaaatcgcccatcagagcacctccgtgaaaaccggatcgactagcttactcgtagcctcaactgctggtttatatgatactcctatctgatagatcatctgaggcgtttcaattgggggagtgcagatgagtattggcatcctcgttaggcttgccacagaacgggctagcatgcgccatcgtgatgagcctagacttcaagtcgaaatccacgtcccctatgttgacctacggcccaatggccacattgtcagcagagggagcagcgaactcacggagagtcttgttagccatagtcttgaaggttggtggcgctggtacggctggtttctctgtcggtagagttttctgcggagcagcgacttgcggcctgacgctccggaagaaagcttctggattttctttgaagttttccggcaagttgataccagtcatgcactaccctattttcacaacaaaagtgaaaacaaccaaggttagcctgcaaaggaaaatgattatacagaggcaaatataaaatattagttcaagtagtctctattatgaatcttccccggcaacggcgccataaatgcttattggtattcccagcaatggcgcagaaatacttctggtatattttggttacagagttcatccgcaagcgcacggatataccattgtagcatttcacccaagagtatttcaagggtatcgtatttattttatcctgtgggaagataatgtagagagaacttgactaataatttatatattacttgtgataatcatattctaagcaggggttaagataatccaagggtagagtgacacacaagcattaactactcattctcataatatattatctaagctaagtggatagaaaagagaaagataatctattcctatacttataaaatacatagtatacatacattctaggtaaccgatatactagctaataccctctatccgatgccctcctggtacatcgagaagccacccctgactgccgagttccttacgacagcccgtcatgaccatacaaccggggctaaatacggaggaataccctccccaaggaattaacttaggattatataccggcacggaggaatacccgtactgagctatcaccatcagcggcccacctcttatccgcaatatataaccccaaaaaatgatatctcgtaatctagacaccacgtctaaactactagatactactctaatatcatcgtcatgacatagagtaattgcataagcaaacactatacccgcaccaaagcatctcctagataagctagccgtatattcagtataacatgaacataatgtaaagtaagtactcatatactcggaaagtatttcaataccataaatgtatttagaagagtattctaataaaaatacaaggcttacaaaagagaagagaaaagctactatagccatacccgaactcttccaaaggcttccgtactcctgatttctactctattcctattccaccagctagatactactaaactaaacttgagagaaatgagagagctattgcttgaggtgtgtgagtgaagtgagaagaggaactccttttatagctgaactatgacggttgtgatggctggaatggtcggtaataccctccaaccgtcattggggcttcatctcaaccgtccagccaagacctggatccaacggaggcgagggagtttcggccgaaccccctagttcggctgaacctggggccggcccaactagcccatgctttggctggcggcctcctctgttgttcttctccgcagacagtgaattttggcccagtttgtcatgtcaattctgagttcttggcccattcatacataagtctggttctcgatatcgtccgattgatttatcgtctgagttgatgtcgattctcctccactttattgttattctctacaaaaggttagtagacctaatattagtgaaatattattattctaacatatttatgcattgcaagcatcactagttctcctctattttggtaatattaacggtcgaaactgatcgataatgaccgtcaacacctgccgttcttgtgagtagcgtcgtgattgttcgcgcacgtgagagagaacaacaaattagatcggtttgtttttttttggccactgtacgtttcacatcaaggcacatagaagagtccatctccaccttgaccagccactacacaagcccacctctctcaaacttgaccgaggctgttaccaccctccacctcatcacgaccatactgacctctccacttccgggtagcgggtatcgagtccgtagttttctctatatcatataattgttaagtagcggatttgagatatttttataaaaacgaaacctacgcgatgtgagcatttcatttttgagatgatctaattttagttttgcactttgcatttaagtccctgtaatattcatatttacatttgagtccctgctcgaggtcggtggttagttcttgttggaaaaaatagtaaaataatataaaaaagaaaaggcagaaaggtgcaaagaaaaagaaagaaaaagccacaccaaaaaaaagaagaaaaggcagaaaggtgcttaaaaaaggccgcaccaagaaagaaaaagataaaatattcatcctttgagtatgttttcagagtgtagagttgtgcaatgattcatatctagctcttagtgttgtcgggtgcctacttgagctagagttgagcctaggctaggccagcacattgactagtactttgaactattattcaactttgcattttctgattagcacaattgcgttcctttgctactatatattatgcctcccaagctccacatatatacttctggtcagcaccactttgatccttgcaatcgccacatcacgtccttgaaggtgtcacgaactagccaccggttgtaccgtccttagcattgctgataagacacttgtaagagcttgataaagtgctccattttcctgagttgttgagagacaccactacaccgtgtagctgattattagtgataaccttcactgtttgttgctgtttttgtgtttgcaatgacaggtatgggtggcgctcaaaatcagcgataccaacaaggtaacaataatcgcgtgcccgatgatccttgtgctaaggttatgtttaaaataccatctttttcgggttattatgatgctgagaaatattttgattgggagatgatagtagagcaaaaatttagtacccaccttgtgcctgagcaacatcgagttcgacaagctacttgtgagtttaaagattatgcttatatttggttggctgggttagttgcagagggagctttacctactagttgggaagaactgaatgtatctatgcgcaatagatttgttccaccatcttatcttagagaattaagcaagaaactgatgcatttagaacaagggataaaactgtacaggttactatggtgaactacaaaatggattgatgcgatgtagcatagtggagggaactgaggattctatttgtcgtttttactcgggattgaggcgcgaaatttaggacatagttgataataaggaatttaacactatcaaccagttatttcagtttgctatgcatgcagagaaggaattgtaggggcgtgatcaacaggttaagaacaaggcgagcacgtacacgccgcaggcgaagccatcatcaaggttgcccaagcctatctatttctgggcgtctccaccaaagagcaagcgaccggttacatctggagtttgtacagtgccgaaaccaccttccccacgacccgcagattcaggtaaaggttcttcgcacgtatccaccaagagtgccttgtctgtcgcttcgacgggatgcacgcataggattcagtgccaccgctaccatggatttggccatgtccagaaggtttgccctagtcaactggtatacgttgctacggatgatgactacatcagcacttccgatgttgaagatgatgaggaggaagagaagaaagacaaagagcaaaaagacctatctatagctccatgcatgcttgaggaatgtttaattgaccaagcgcctgtaatttctgaagatgagaaaaaaggtaatgataatggtgctacaactactcaaggtatgcatatttatgatgtgccaactatgtccactacttatgctacattatagcaacccgtagtggaaacaattgctgaaatacctttgtcacaaaacaatttgcttgatgtttcttgtgataaagaagagttgtgcgatgcttcacttatatccttgccacaactagtgaatgaacatgttagttccatagtagagctaccatgtgttgagtttaaacatgttattcacattgctagcgagaattatgagcttaaattgctatcttctttaaatacttggggttacattcaatttgatgatgtttgtccactcaactatttagagaagaaattatttgctagatttttattgccatgaccttcagatgtgattttttatgttattggcaattatggtagtaaaggagaatataatgtgcattgagtatatatttgtttgaatttgaccatacctccttttcatgatgaaatgaattgtctaggggactgcatgtgtagaagtaattctctatctagttgctttagttgtttaaatgagttacaggttggtttgcaagaaggggagtgttgtgattttgaccatcaaaaattttcctcaccagatgttgagatagataaagataagttcaatacactccatgacaagatgaaaccgaggacggtttccaatcaagaaggggaggataatgaggacacaactagctcggatataaccatgactatcttatatattaatcaaccaaaggtgcatatgttctatatgagatttacttgttatatatttgaacaaacgttgctacacaatgatcaaagtggtgctgaccagaagtatatttgtggagcttgggaggcacaatatatagtagcaaagagacacaattgtgctaatcagaaaatgcaaagttgaataatagttcaaagtactagtcaatgtgttggcctagcctagactcaattctagctcaagcaagcacccgacaacactaaggactagatattaataattgcacaactctgcactctcaaaacatattcaaaggatgaatgattttttttctttctcggtgtggcttttatttaaacacctttctgccttgtttttttcttttttaggtgcggctttttctttcttttttctttgcacctttcttccttttctttctttctttagtttttttttacttttttttcaacaagagctgaccactaacctcgaacagggactcatatgtaaatataaatattgcagggactcaaacacaaagtgcaaaactaaaattggataacctcaaaaatgtattgctcatatcatgtaggtttcgtttttacaaaaatatctcaaatccgcataaatatttgatatatggatgactacgaactcatacccaggttcggaggtggaaggtgggagtcgctcggttttctttctcacagcacacgcgcacatacgccacacatgaaaacctaacaaccaggcaactccaaaaccgctcgattaaaacttctccaaaccacaaaaacggaaacctgacaatgattagattcgatttttcaaggtcccggcaacaaccgacaatttacaaaattggacacaaaattgacgtacaactcacaccttgataaaccctagacccaaagtgttgaacagatgcattactcaaaactaaaaattaaatctaaaactaaaccatcactcgatacgacgatgcaatctagaattcaacaatgcaaaatctaatagaacaatgcaacaactaaaattgtctaggtaaagaataaatatttttgtgttgcaattttctggttatgggaagacaaattacctaataggcaaccgcgctctgataccaactgatgagaaagttaggtcccgatcttctgataagtattgataaacaatcaatttgggtggattcgctggacaactcgatccggcttctaaacgaacacgctactgagccccgcaatcgcagcaccacgtctcctctggttatcaaccatgccgaaacccggttgacctcaccgagaaggctaatccctgcatgcgaatcgaagaacacaagcaagaacaagatagattgcaacacaattgcatatgaatgattaagcactcgaatttggggttctacaaaccgatttagcagcaaaactgttcttaacagaataatctaagcaaaacccgactctaaacgatgacggctactgattaagtatgattagggatgtcctagggttaccctaagcctataagctttccaaatccatcttaaagtagactccataagctttccaacaagtactcatgggccccgaaattctttctagatcagcggctaggttcgtttgaagttgatgctatcaggaggcccaaatccgaattcaaaacgtgtagaactttatgtcttgtcttctatggaccaaaagtgacgtggtgagatggaagtgaacttggagaaggttttggtttggtccccaatcaacttctttaattatccatgaattccttacgctcgcctcttttctttcacccaagcaagtacctctgcaaacgaaaacacacaaaactcattgtgtagcaacgtttgttcaaatatataactagtaaatctaatatggaacatatgcacctttggttgattaatatataaggtagtaatggttatatccgagctagttgtgtcctcgtcaggaagattccaaaagcatattgtgatgccgaaagaatattcggaaccggtggggttctgattgaaggctagacaaacaacatgactgaaatatgtaaatcaaactagtgaaatagctttataatattatatagatatagaataccaaaagcctgatggctttgtcatcaatcaccaaaaagggggagatagaaagttcaagtgctaataatttggttttgatgatgactgataaattcaattatgtgagactaatttggatatgaaagtgctaggcaaagccctggcagttttcaaggtcaaaaaaatgtggatatgaaagtggagtgtgtgagagctgattcctagacttcatatgagttgagttgagatagaaacgttcattggtgatgcacctaaattacaaggatgaaatacatggagataaagctatatctatcactctctctccatgtacatattgatatgttcatatataatatttcgatgtgaataacattatacacatgagactaatgttttgtttgagcattttttgcttgtttagtctctttacattgagaacatgaagatgatgaaggtatacatttcttttaatgcgtatgtttgataaatgcattctattcttgtataggataagctcctaatgtttcattctttttaggaaaaagtacgaattacccccctcaacaattacggttgttcgatttttaaccctgaactccaataccagttatttttaaccctgaacattacaaaccggacgaattactcccctagatcgatccagggtggtttcggtcctacgtggacacacacgtggcagtccggtcagccaaaacaaaagaaacatatatgggacccacttgtcagccacaacaaataaagatggtggggcccactgtcagcccgagcctccacttctccccttcctctttgccccttcccttcgatctctacatctctagcgcatcaaggcaggtagcggagctcgccgttgatctcgccgcctccatggcgagctcgcagcggcggccaaccagcgcacatgctcgccacggaggaggaacacgagcatgcccagaatggaggcagagacgagagaggcgtcactgcgcacgcgctcatcgacggaggacatcgccgtgctggagacaggggtgggggagaagcgcggggccgaggacagagacggagcgagctcgggtgaccgacagtggcttccctatccccaacctcctcgccgttgaccgtggcgccacttgacctccaggtggtcggcggtagctcgggtggccggcggtggaggtggaggcagagcaagcctgggggcaggaggctgcggcggggcacgcaacgattagttgtggatggcgacgtgctagggcggatgcggcgagcgcagcgggcgggcgagaggctgcagcggggcgcgcagcgacgagcggtggacgacggcgcgcgggggtgggtgaggcgcgcgcctcatcctcggcctccgccacgaggaggctcacgagctcgccgaaggtcgtgatgttgacttgggcgtagggcctcatggcagcgacgcctgcacctgactgtcgtaggcgcggcgtgcgccactgccgttcatagcgccgacagggagagtcacggagggacctcaagacggcggcaggcagaactgcctcgcctcctctgccgtggcgctcacctccgccgccgcctcgcctcctccactaccagttaggatccgccgcctcatccttcctcagctctcccgacggcaccagacgagagagagagaacgaggaggagagagaacctcgccgccgcctcgcctcctccacgccgcgcgctgcccgccgtgccacatctcccgccggcccccgcacgccgaccgcccgtccacgcgccgccgatgccgcccactgctcgttcacgcacacccgagagagagaggagaggagagagggaagagtggtaatggcaggtgggcccaatattttattttatttcattttgttgattagatttccacgtcggcgccacgtgtatgccacataggagaaaaaccgctcaggattgagtcaggtggtaattcatccggtatcaatagttcgaggtgtaatatgtttggttttgtggttcaagggggtaattcatactgtcgcaataattcaggggggtaattcgtactttttccttctttttatgcatactattgcttcacacaaatattttgtatgcatacatttaggggaagcaaatcctataccttagttatgcatgtatttgatccaagttattcacttttatttaattcggatctttacagttgagcatatatttgagtatatgacacttatggtgttgattaatactcatgatttattcctatccttttatatgcgcgatcggtaaatcaacatgtagaggttgacaaccggatcattgagactaataatttcattgagttcaatgagaaaaataggtcccaaggattgaaaagatgttgatgctcaagtgatatgattacacctaaaataccaagaataacacagtagagatattgaagatgttggatatgaggtggctactatggcaagacggtgaaggggtcgcgatacaccatgcggcggtgaagggcaagcaaggggcatagcaccgaagaaccaaatccggtggtaaaggggaagtgacggtgttatcatgatggaccgtgcgagaccatttgaagctacaagtaaccgcataaatcatttgaagaatatatggtgaaacggttttggcgttgcggtcccttaagacaaaggaaggaagatggaaagaaggtattcctattagtataattctcttcctatttaaatttgagtacaggaatgtcgtactatcaagagtgatgcaacgtcgatgtgtttgtgtatgtgtcggtgctcaaagtgatctgtcatagtgctaccttgagagaaacccaagatttaacaaatcctttgagtgtttttagacgttttttggttgagttgggtagtcctctgagtcggctttccatagagtccaagattatcaaaaacagactcccaagcgaaatgttatggtcgtattactatgtgcttttcggaaattctgaaaaaactccgaaagtccgaaaaatatttcggaaagcccaaaattttttggaaattccaaaaatgactgcgaaattcatatagacttctgttaattttcgggcttgtccgaacaggcctttcggaaattccgaaagtcatagtcttgtccttcaatggctagttctgagaggctcgtgtatataaactcctccacccctgttgacggtcgttatcgaccaattttgaccatcaatattactcaattaatgaagactagctatgcctgcaatgcataatttccaaataaaatatctacctccactatatactatgctactaacatgtatataggagaagcacatataaatgcaggagaatcaatagaaaataaaagatcaatcaatcaaacattgtcgagatctagacttatggatgaatgggccaagaacacaagattgacacattcctctaggccatttggataagggaggagttaaggggggcacctgccgaaaatggaccagaatggcccaactcatggttcggccaaaccccccatctgcgccgttgattcttggttttggcgtggacgctccagatgatgtcctgatggcggttacggggcacaaaggacatgtcgcacacttataaccgtcataactgccctatataaggacttcactccctccacttcaacacacactcaagaagaagagctctctccctctctcaagtttagtagtatcttagtgctagtggagtaggaattagaatagtattctgaatcctcgggtcttcaggagaagtcgggtatggctctagtagctttccactcttcttttgtaagacttattgaattaacagaatattcttttttatacatttatggtattttattccatttatattatctaagtaccaactttcatttatacttatatcaatatagttctgtagctagcctaccagataggtgcaatggtgtgggtttagtgtccgattactcggttgctctatgtcatctcgggggatatagagtagtatttaataatatagacgtggtgtctagattattaagtatcattatctgggcatatatgctgcgggacagtagaggtgagccactgatagtgacaactcagtacgggtattcctccacgttagtataaattcataagacaaattcctggggagggtactactccatatttaaccccgttggaaggccatgacaggttgtcgtaaggaacttgacaacccagggtggtctctcaaaacaccaggagggcactgttaggggttattggttgcatggttgtgtactagcaagtgtagactaaatatgtatgtatactagaagtataggaatgaattcttttcttattattcctccacttagcttagattatattttagtgagagtatcctagttctttcttccgtgtgtcacataccctttgaattacttaacccttgcatagaccttgatgtatacaagtatataaactattagcatagtattctcttatcatatcttcccttgggattaaataaatacgataccttggaatactcctagatgaaatgctacaatggtatatccgcgcgcttgcggacatatctataaccataagtataccatgaaaatttctacgccattactgggatttatatttctagaaatatcgttaagaaatatcaacaatccctcctttgagtggctgttgttcttgggcattattagacacatccaaagctaaatagccttccccattatcctacctttgtggtgcctatttgtgagtgggatttgagaaggggagagacttggattgaatgattgtgaaattgagaactagtgagcttcacacaatactttgagctctcgagttcatagcaagaaaatcttcgattgagtttgttactcttggggactaaggtctcgtagatggctaggcatcgctggtgagcacccaaggttgaggtgtgtcgcggaaagtttatgaaggcatcgatttcgcctccgcaagggaagagtgaaatcgaggagagcatttgcgcaacctcgtaaggaaaaggttgaaatagacccacctttgtggcccccccaacggagacgtaggatccgcagatccgaacttcggaaaataaatcaacgtgtctgttctcttgggttgctcattcttgccattctcatattgtgcttgagcttgtttttacccaatctacttgtatgcttaattaatatagttggtgaccttatatcttgcttagataccttgtttgtcaccttttgattcatatacattttgtttgttcgagctacaaattcatagatagtgttttattctattaccactgaacttttcggttgagaccggaacttccaatcccataccggaaattccgatttgaaccgaaagttatcatcattataatatgctaatgaagttgtgataacttttaggaatacctattcactccccttctaagcaacatcaaggtcctttcaaacctgaatgacattcgatagtaagcatacattccattggatacgtgaacgttgtcttgctttgatcgtaggaatatatgggaattatatgataaccagaatacccatcaagaaaacaaaagaaggaatgatttgtctgccgctctaacatctcatcaatgtagggcagcagaaaatggtccttttttatagccttgttgagttttctataatcaatgcacatcctccatctaatgacagctcattccgggattaactcgttcttcaagttttcaactactgtcatgcctcccttcttaggcacaacctgaactgggttaacccattcgctatacgacataggatagacctctttttcacaacttctctcatcgtattgtttagcctctgttgtggctcccaagagagtgcgcaagaagggtctagggggatatgatgtgtgtagagagccggactaatccctttgagaacttgaagaaagtagcctagaatagagcaatgctttgctagcatggctatgagtcgggaggtcagatcatcactcagtttgtcacttatgtcgacgggcgactctgagtcaccatgtagaaaagcatgacgaaggcctgaaggaagaggtttgagcacaactatagaggtcgtgaatacggatcggttttgggtaactcaatcacctctccaagatcgtcctctttctcaacaaatgcagtggaaatcatcttcgaggagggattcaggggactcaaaaggagagacagccaacacttccacaattgtctcgaatttgggaatggggttccatcaaagagtttttttatcgtgagatctggacaaaaaacaccattttcccaagcttgatgtcgagaactccggttcttgcacattgaagaagaacttttctatgggatggccgacgtggagtttgaactcatagacttcgaacttgtggaaattaagaattttgttgtgctgaattggcactctggggataaccccgtacccttcgatgataggactagattaatcctgaaaggttttgtccgttggtgtcgtaggctctccggacctctcattatatttgagggatgaagtgaataattcaagccatcaaacaaacataatgaaacatccgacgcctcgagagaaggatattagagacattgatgggcctttagcctgccagtcaacttcagcctgagatgtgcccgtcaaaccacacgaaggcggcgaccagatgtatcacacattcaggagacttgacaaaatggctaaagatctacgatatctcaaatatccttaactcatactcatgtgaatctagttcccaggatgtgtactagattcacactttcatcttaagcatggttatgcatagcaaatacaaataagatgaaagcgattcaaatttacaactactttatagttacataggccgaccgacgaaatatagatagataacagagaacagcagaagcttgactacccaaccacaagcacaccgactaggggtttaccccattaagttcaagtcctagagagagcaaccgaaacccgcaccactcaagaagactaagtctaacatgcaagcaaaaggttattccagtagcaagagtcagtacattaatgtactggcaagccaaaaatcaatcctaacatactacatgtaaggcatatattcaaaggagggcaatatatagtttaatttcagcataaagcagttttggttcacaaatcttttgtaaaggagttgattcaattaacaaaacaaatttgtgagttcatcataattaacatcatatcatcatagataacatcatatcatcataagcatactcttgctggcttcatggcacaactattataatcatatgactcacacaactcaacacaatttttccacaagactatactcatgacaca

SEQ ID NO: 67162 - DNA, 711 bp, Oryza sativa
ttaacccacccatgtggaaaaagtttaacactaaagaggttgaagaaccagcccttaaaagagaaaattgttgaaagtagaaaccaacttaacatctctagcacccaagtaatgacgtggacctccaaaataaggataccagcatcacttaaaaatatgaccacaaaaagatagtgttaaatactctattgtgactatagtttacaagacaccgatggaagcatttaatctggctaccatttagttttttctttagggaaatatcgccgcagttaacctttaaattataggcagcacaaatcaagattagttaatttattcgatataccaccagtttgagctttattaaatttgtggtaaaagaacatgactcacacatgagctagtatttataagacacaacaggttgccagatattgaatatatattatatatgccacactgcagctgaaggtacctgactctgttctggagtctacaccctcgaatctggaaaaaaaggggaaaaatcaaacattaaacaggcagtatgtgccatattatcttgctacaaaattcatggtgcataaatattaacatacaacggtactagctgaataccagtgtcttgcaataatcaacaaatatatgttctaaactttaaagtcgtatatatttcttggaaaaaaaaacatatacaattcgcaatccaacatcaaccagaaattgaaa

SEQ ID NO: 67163 - DNA, 11857 bp, Oryza sativa
accccacaagtcttcattgtgtgttgtattgtggattaatcaccaagtagcagattcttcgttgtgtttttgtgtgtgtggaagtagggattaatcacttcgttcattgtgcttttgtatgtgtgccacttcattgtgtaagcacattttttattcaaatttctgtgttagtttttgtgtgcgcggaacacaatttgaaatttgtgttagttttttctttttgttggttcaaattgtgtgcggaacacaatctgaaaattgttggtctgtttgtggaacacaatttagaatcacggacagagcttgcccagtaacccgatcaagaaaattttttagctacaacttatgtattttcatcatatgtacacccctccaatccaaactcagacactcatatcagcctaaacttggtctaaagtagagtaaataaagtaagtgagagtagcacatctctccatttccttttagctcttggtctaaaatagagtaaagcaaacgagtagcacccctctctatttctagaatcgcaatccaaactcagcctaaacttggtttaaagtagagtgaagtaagcaagaatagcacctttctccatttccttttaactcttggtctaaaatagagtaagcaagcgagtagcacccctctctatttctagaatcgtgttgtagatctttgtattaatcactagtgccaaattattgtgtaacataatttgagaactgcttgacaatactttctaactaggaaaataatagtttcgatatgcctcaaaacaggtcaaattatcaatttgcggtatatcgttgaacattactgcgcgaagatatacttatcggcagatttattatgcatggaagaatacttcaacagatatttatcaacatttgtgcattgaactgacaaaaatctgcaacacactagcaatgtgagatccttgatctccggaagcaactagcaacaagaagtaacgaagtatgcctcaacaagaggcagatgtctgaatctagagtgaatcaagcatgttccataagcaagatgtacatgaataaaatgaatcacgaataaaagttatcaatggtgataaagttcagagacaaatcgcttctcccatgttcccatattacgcaaaaggggtagctatgagcaacaggtatccagcatggcaatggaatacacgattgaacccagcaattaattagagcctttctgagttgtcacttcactgattacaatcaatataaaacctttcactaaataaatgatgttaatgacataatacagctaaacactacattgtttaaaacatgctatctaccagccctgtcttacccaaaagtgggacagtaggctaaaaaagagtaacaaaaattaaatattccgttgtgcagatgctattctgaagccattagcactctcgggaggcggtggcttcttcttatagttcgcgaggctgcagtgggggcagatatattccaacccatctgtcttcgcatagtcctgttacagcagcagcccagatcaatgcacaacctaaataatgaaattattggaagggatataaaacgttagatacagatcaggaaatatttctaccttgaatgtgcctagcccttgccgtctatcacacccaaagtgcgcccattcaccgcacaacccacagttaacccaatcacctggagcactactggaaatagttggaaggaatatgttagattataccgacaggaaacagttgcaacagcaccatactaaaatcgtgtcctcgaacctgtggcagagtaagcagcattccccaccgacatcatcatgtgaaagttcgtattccaacaagtatgtctcgtaatgtctctttaacgtgtttccaacaccctattgcaacacatttagcacatcagaaacaggcaaatgaaatggcagctaacataccgtaaataaaagataacaaaaggaaacaaaaaagaataaatgtgttacagacactatgatttgtggttaaccgctcatagcaactatctgtacattaaccgcagaggctcgtgtacggcacaaaggactccaagatcaaggcttttcgtaacacccctaagccccatcactgcctaataggcccaccttttaattatttaaattaaatagaagaaacgaagatagcaaggtcattttcaaatatttctcattcagcgggcatattatttcagtgggcagagtgtctgctagcaaataccacgaatacatgggttgtgtggtttgaggaataagatggacaattgatgacatggttctaaatatgttatttgtttggaggaatggaatgtgtttgtccatcatcagctcatctctaaaagcacacactaggtagagaaatgaagaatggagtcactccaccaaatttaaggaataaccacatgatggatcaccaatcctagatggtctgaagcccattagagtgcgttctagccaagaccacatttagtgttccatagtgaattttgtcagcaaattattgcaggcaggcccagtggcagagagagggggaggcgcgagcaggagcttggcctacccataatttctgagattttcaatgctaaaagctgtatcttaagtgattttaaaatgaaattagcactcctgacccgtcgcttgacaaataaatcttaggattcctggctccacctgtgcagcaaattttccaggaatagaacgttcaaagctgactatgtgccaaaacatgtccctcttacaggctgacccatatagtagagtaaatctaagtagcataacaactgaagtgtgataaatggtaccacagaaaataaccaattcactgcagcaaatctaacaagattgaaacaaatatcaactacatgcataccgtcattttgtttgtaacagtatggttgctcatctttgaaaagacttgacctttccaatttatgccattgcctacataaaatccgcctctggataccacctgaatgatcaatcatcattttcatcagataaatgattaaatcagcatttctctctccatatttaaccccacaaggcgataagcccataattaatgcatgaaaatagcagcagtgaagaccaacctctttatacaagttatataaatcaaggcgttttgcatttagtactgcatcaggaaattcggctagtcctccttgaggaacaagtcgggtgtgccccctctgaagtagaaattgcatgacatcttttaagaagtcttcctgcaaaggacaaggggaaaatatgtttgaccttaactttagagagcatttcagcataaaaccataaaaaagaataggagagatggtaaatgagagtacttcagagcaaattccaataggcaaccgatcacacccatgtttcttcattggcagaggatttaacggaacagctggttcaacacgtgatgtcccagatgataattttctttgagttgttggagcaacaggtaatgcattatgccttaccggaggtgctggcaagctaggcttaacttgactagcatcatgaataaaggacggagggatacccacaaaagggtgcatctgccgcttcgaagagtgtggaataggcctcatttttgcagatttcagctttggtttgactactagggaagtccctttcattggatgtttctggtactctccaactccatttgcactaaaagtacttgattttgactctggagttcccttcagtctgtccttaacaagggatgctgaccatcttggcagatgagaatatagaccatttacaatagcttcatttttgcaaaagaaaagaagccgatccacatcttgtctatcaaacgaagaaactggagttccatttacacaagcaattccaagtggaaccaggcttttgtaagagatttccggagcaagatatttcaaaacctagacagtagaaaacaatcttcagttagtgatgaatgatccattgaacataaccatgtaaggaaagataattagaatccacaatggtataaaacaccatatggttgagttcacacattgaggtttgacttgtcaagaaagattggtgatacaattaaagagcataggggtcttggtagtcatattatgtattaaaatgtccaaaccacttctgtttcctgatacatgtgtttttagcccattttttttaacaaacaaaaggtgttcccagctttactgatgaaaccaaagtacagacaactgcagaggaagaacgagatacttgacaggatttatcgtccacaaaaggacaacatgatatccaaaaaaaatgacacaaaagaccatggggaaattagtgggtatttttttacacatattaccaagttgtgttcagcacactacttcaactttttgaagaaaacaaacctgtcctgcccacttaggtagggtcatccagacttcaaaagtagaagctccagaagccacagatatcgaagtcaaaggctcaactgaagatggtttgtcgtcctccctaactaagacagcacgaactaactggcccttctcaacaatttcctttttaatatggttctccaaaagctacaaaattccatgaagcagcatatgacactgtaaatatcaaactgaagactaaaaaatgctccataaatacagaaaccataccttgtcatcaaaacatgtttgcggactgccagaaacaagcaatgacacgtgtgaagaactgcatgttgtgatatcacaacgcattgtaaccaccccatgtggaagagtttcagcatgaagaggtggaggagcagcactgaaaagagaaaatgttgagagtagaaaccaactaaacatctctagcaaccaagtaatgacgtggaactacaaaataaggatagcagcatcacttaaaaatatgaccacaaaaagatagtgttaaatactctattgtgactatagtttacaagacaccgatggaagcatttaatctggctaccatttagttttttctttagggaaatatcgccgcagttaacctttaaattataggcagcacaaatcaagattagttaatttattcgatataccaccagtttgagctttattaaatttgtggtaaaagaacatgactcacacatgagctagtatttataagacacaacaggttgccagatattgaatatatattatatatgccacactgcagctgaaggtacctgactctgttctggagtctacaccctcgaatctggaaaaaaaggggaaaaatcaaacattaaacaggcagtatgtgccatattatcttgctacaaaattcatggtgcataaatattaacatacaacggtactagctgaataccagtgtcttgcaataatcaacaaatatatgttctaaactttaaagtcgtatatatttcttggaaaaaaaaacatatacaattcgcaatccaacatcaaccagaaattgaaattgacaaaccagaagatcctaccaactaaataggaggtgatgggatggcagactcaccagtcaccatcaccaccactaagtttttggtggattacccaatctacagctatttttatgtaaattgttttggtggattacccaatctacagctatttttatgtaaattgcgcataaaatacataacacaaagtgtataatgaaagaaaagatgtggaaaggacataaagcaaaaagaagatactaggtgggctgtcaaccagacagcccacttatatctccaaccctgccaatactattccttctccagaaaccatagagaacagtgatgccattcgtgactcaaccattgattgggatgatgaaccagatcaaccatgaaccacaaactgagatgatgaaccagggtcgtgggatgtggcggtgaaccacgaatccggtcaccataggatgtgcaacatactctagaatgcaaattcacaactcagaaaatgagattgcaaccaagctgtatcatcaatctactccatagccatggcactatggagtatggactttgggacccagccccaccagccagtataggttgcctacaagtcacaatacttgttggctgcaataatgcatacttataatccgtaagctaacagactcatagttcattactccaatcaactagcatttccatgaactagattgttggggtatactattcagaactcagcacttctatgcagaaataaagcaacacatggtaagtacaagaatggacccatacttcaatattgagcagagcattcaaaccatcctccagtgagcccaacaaactagcatcctgtaaaagagatggaagtattggttgggataagaaaaatgcaataatatataagaaaatattccaaatttaggcatgaccactaacgcttaccaagatgcatggtgctccacaaataagaagcttcatgttcacatcttcatcatatatctttatggctggaaaatgttcagagctaccttcttcctcaaccatttcattctcaggaaggaagatatttatctttggagcatcccctagtaaacgaggcccaagcttaacactttgcgcatcattatttcttgcacagtacagtcgaaaagaagcttgtgcaagctgaaatgcatcccatgtatggctgcaggagctacataaaggaacactcgattattggatgaaaaaacaaaactaaatgggacttacgatacatacaacaaagacatgatgaatatgatacctctgaacaactgatatcaaggcttggcgaaaatgagatgctgcatacgatgaaaatgaatttctccaatataatacatatggaatcccctgggaatgaaagtgtcaaaaacacaaattccaaaatcacaaataagattctgaagtaataggagagtaggaattgttgttgaaagaaaaaagctcagtaaaactgcaaaaaaaatttgtaaatgttagcaatcatcttgccgaaaaatgaatagcaattgctcatcttacaagcatataatgatataaacattccaacaatagaacaacacctatgctagacaaaataaactaaacaaatgcagtttgagtatagtaattgtttatggaaactaagctcatgctacacatcagagcaattttttttttaaaaaaaagtatgaggaatcatttggatatttacaagtatatatgcatcccaacaagcagattcacaactgtggcaaaaagacatatggaacaatccacaacctgttcacaaatttttttaaaaaaaactaattgaaaatatcacaaaacaaactacctttaactgaagagattgagcaagcttttccccagcaggaacttccaaataaacctgtataaaagcttagacagtaagataaatagatagaaggaagacgaccatggaaaaattggaaaagaaaaccgtttatgaaacaaaacagaaaaacaaggagcataaggttttaaaaaataaaatgttagtagctacaagtcagacaaatataagtggaatatgtaaatcaagttatgggcattaaaaaaacaaaatattggaatatcagttttaagaaccaagttggagctgttgtgttgcgtttgtgttgtgattacatgtttaagctgttgacggaatacgattgttaaattaattgtggagtgtttgaggaatcaaactgaggttagataaatcctactccctccaggttgataatacttgtcgttttggacaaggctattgtcaaactttaaaaactttgactataaataacatctaaaatatttgtcttagaagtatggtgaccatatatatagactgatcttaaaaagtacttcaataaaatcatatatttattgatatttctatatatatatatatatagtaataaaaaatagtggtcaaagttgtttttaaagaccgtgcccttgtccaaagcgacaagtattatcagtccaaagagagtattatacaacttctgattcatccacatttgttcatttttttgcctcttaagtacgtgaccaagcattgcttttgcctcttaagcatgccagcaccagtattgacatgcatctcaacagttaatgcaaggtattagaggaaaagaacccataaaaagtgtttcgggaaatatgtgtgtcccacaaattcttatagaagccctaagaaaattgcccaacattttctacggagggagtataaatgtctgtcacataaataaaatcgaacagcacaatgaaacggaagcttatggtagtatcagttatcatttaattgaaagctaagagcgctgaccaacattgttgctagctaagagtttggtgcttactatggtcggaaaaggtggactaatgagtgaactaaatatctgtggatcagatacatcagcatcgccccagacaagtgtaccaatttcttcctcattctcaagctgctgaccctggaggtacatcaagttgggctgcacagcctgttgcgctttccggaattgatcaactgtgggattgatcagcgtatgcacctgcatcccgagccggttcataacacaacaaaagaaatgcatcaccccagtaaacagcaaaagcctactaacctccaatctcccagacgagatcagctctgggaatggatatgaaagccgtggtcgcttcacctcgggcaccagaccaggtggcttctgctgtttgtctgtaaccttcccacatagcaccgcaagcagcgtgcagttcaccagtgagctgctttggatttgagccatggctgaaccggtaaaatcacatctccccaattcagctcactccaccattgaaccctgcaacaccactagcaacagcaaatcattcatgaaactgagatcacccgaaccagtgcgtggatcaaaaagcaaactgaacagcttaagagattgactgaaaggttaaatatttcgggtgactgagaactagcaattcctggtcgtctagttttcagtcacctgaaaatttaaaatgtgtcagtcacatttgcaacctttggatctgcacatccaatgatagcagtttgtccatgctatgttgaatcaaacaaaatggttacaattccaagtgggcccattacaaaataataaaaaaaaagaacagtttggtaagtagtttggtcttttgcttgtgtccagaggattggcttcctcgttctgtgggctttaaacaccggcttaatgtgtcaggaacatttccgctcttccggcgagatttaattgctgctagtttagcccaggaagaaagaatatatttgtgtaacacttttggttgttactccttcatacttctttcctaaaactgtatgggtaaatctgtgctagctgaacaaacattactttactgtgatagattgccaatcgcaaaatataacatgtgtatgtaattttcaatttacaactccaataccaccgtaaaatttgatacaagaaaaattaacatgcttctgcattcgacaaatgcaaactggaaccatctacaagagaagaatgaacatccaacagtacaataattgcattagcctgcagtggaaatagcactataatgtgcaattcaaaaatatcaacacaatgtgcaattttgaattgattatctttatttaccagggcataaaaaaatttcttttacctatggtttccctaataactgcatttggtttattttaaaattgcacaaacatataaactgcaagacataacgatgagcacttcgcgaagcatacaaactacaaatcgcaatcaactaactgacacctgaaccaaaatcgattcacatacaggcctcaccaacatactgcatggcacaatgggacaagtaaagatgttcatgaagctgagatcactaaaccagtgcacggaccaaaaagcaaaccgaacagcttaaaaaaatgactgaaaaaattgaatatttcaggtgactgaaaactgcaactcccttcacgaaatttccagccaaaatcagaacaaacaagcaccaaatcgaaccaagcgaaccgaaccgaatcgaatcgagcaaccataccaggagacccaaatcgacgagcgcagcccaaaaccccgcgactccgagccgctatgacaccggcggcaggatgcgctcgatttgtgcggcgacggctagggcaaaagcgtggaggcgagagagcatggaaccctaatttagccgccgcacaaatccccctcttcgaatcattaataatacagacagaacgagaggggaataaacgcgtggtgaatcgcacgcgagccgacccccatcccgtcaaaatcaaatccagtcaaccactccggaaaaaaagaatctatctgtctaaccaaaaaaaaggaaaaccactggaattttaacctaaatccaccaaccctcctccccgtcttaatccctccgcggattagcaatgcaaacccctcaaataataaataaccgagcaagtagcaatctccaggaaatattttgattggccgggacgaaccgctcgagccactggagatcgtagtcgtaccgtgcacggaagcggaatccacagctcctgcttgatccctcctgcgcttcctgttcccctcgtggcgaggatgatgatgatgatgatgacggcgacgacgaccgcggcgatgattcatttacctgcggagaggaataaaaacaaagagcacggattaaattagctttttttcttttcgcagcgggatcgcgaggaaaagttgggaggaaattatacgaattctttttctgcggtttttttttcctcttccttctctctgattctctgctgctgcacgagtgctttttagatttttttggcccacagcacagcctagttgcgatcgtatgttgttttggcgatttgggttggtttggttccggtggtgatcgaagaaagaaatttgggtgggggaaatcggggagcgtgcgacgcgacgccatgtggattgatgtggtgagattggtgcgtggagttcgtgctggttcgtcggcctctggataccgggggaagggtcagggcctcaggggacgggctgtccctgacttgtgagcccacagggctttgggagaataaaagcgagtaggctgtcctaaaataagtgcaatgacaagtattcataagtgcaatgacaaatattcgtatccaaagtttgactatcggtcttgtttaaaaaatttatgaaaaaaattaaaaaaaatagtttttatcatctaatgacaaaaaaatattaatcataaaaaaatttaaataagacaaatagtaaatgttgttaatgttgatcataaaaaaacttttaataagataaataataaacgttggatatgaacgtataaaactgtacttgtttttgagatggaaatctcaaaagagtattactatagggagattttttttttggaaaacagtggcgggaatatccccacggtagattttcatttcataaataaaagcataataaaaaatttggggagattatttgctatgtacaccctctgattcttttttacgatggcgtcatagattaaggatgtaggtagtacattgatttgattatattactttcttactcaaagttgtacgtacgatgtaatattgatgtgattcaacgagttcctgtctaatagagaaaaataagagatattcccttctcccaaaatatattcactccgttctaaaatagattatctaaaatataataatctaggggcctcatcggatggctgtttgggccaaggcttttcagccaaagcccatcgtcttacttattgggctgagagctttcagccaaatataggtagggcccgcaaggatgttggagcatacaatactcatcaatccatttaagccaaataagccaatcaatggattttctttagctgaattgaaaaagccaactttggcttatc

SEQ ID NO: 67164 - DNA, 8401 bp, Oryza sativa
gggggcttttgcggcgaatacaagattttgcattggacggttccggatagcctcaccagtagggtaagtcattgtggacttttaaaatgggagggggagggggctcgccggggggcctcgctgacgccgttaactctttccgattagccggcgaggcgggcagcggcgcggtggggtggtggcggcggtggatcacgcgtgggacgggaggaggagggtggcgacgtgatctggaatggggggaggaggagaggagttaggttaagtggtctgcatgaatcttgaagcatatccaatggtctaaaattcgaatgataggaggtgggattttctgtcacaagatgtatagacaaccccttttcaaaatgtagaatttcagcatgcaccatgattgttcattttgcatttggatgcttcacaaggggaaaatacaggatctgaagagagttaaatacaacaatttttttataagttccaatacgatgtcagaattcttaatatatatattaacatattggatttgatgaagaataggaatttaatggttagtcataaactttatagtgctatgagagagtgtgcaaaaggtattatagaagaaattacaacataaaaaataaactagggaactgaagtccaactcatctcatctatactttctatatagttggtacccactaacaattattagaagctaaagctcaacatacatgcatgctacatcatcacccactagcaattatattattctagcccatttaaaatcccatgcaagtatgccacatcttctctcactagcaattactattctatcatattttaaatcctatgtaagcattgacacatcatctataatactccctccgtttctaaatatttgacaccgttgactttttagcatatgtttgaccgttcgtcttattcaaaaacttttgtgaaatatgtaaaactatatatatacatataagtatgtttaacaatgaatcaaatgatagaaaaagaattaataattacttaaattttttgaataagacgaacggtcaaacatatttaaaaaagtcaacggcgtcaaatatttagaaacggagtattatattatagagatcaacaagtatgtgtcaaatcatcttcctcacattattttctcaacattttaactttcatcatttcgataatatttatcatattcatgaatcccgcagcaaagcgtggggcatcacctagtttagagaatgcatgtccgccgaaaaaagatttaaaagcatactgcttgttataaatataaaatgcctacgaaatcatgtgcacaacccattatttcacattttttttactaaatatattcatattttatgacaaaatagagaatattatctttaccatatacgcaggtgaccaaattgccatacgaggtaaaaaagaatataccatatggaataatatgatttggtctttaatctgccagaaaccttatagggtttcaatttaaatagatcaaaggctattacccacaagtcaaggataagttaacccataaaaatggtcgatacatcatcccgtacttgttgtactgccaacttaattaaccccttaatatggtcaaacactaatgcaaggtctgttaaataggttacttgtttgtcacgcccagaaattcacgaaccagaatttctaagctgaatatgtattaaacccctgtccaggaccagccagggtacacaaacgacaattgttgacatacagatccacgtcttacaaaaatataaaggattacaaatgcagcggaaaaggtaaaagcgagctaagcctgaagacttgactcctgcagcgggcgattccattcctcaggcaacccttgacggcagcgacgaaaccaatctcttcaagacatctccaactgagaagaacttcaactctggtgtgtgggaaaagagcaagactgagtactacccactgtaatcagcaagtcataccggaggaggaggtatgatgcaggatataaccaacggaggctacggggttcatttgcataaagcaggcatttaaaaccagtagttgaaaacagaaaaaaacagttgtagtaattaagcaatattaaccagtcactgtccaacgctacgccacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacccacaagacatagccccacgacacgttcccgtgcgccgacatgccaccacgacataccggaaagaggccgtgacaggacccttcgcataaccctctctaacgatcgcaccacaccttagggtccgcccccgtccccagcaggcaacgggcagcccccctttcatgccgcggtgaatccggaagccgatcaaccggacaccccggccgacccaactccatcacgcccaccctcgcctgggtacgtcggttagagaaaagctacactacaagcccagctgttgcccacgctggcttgtggtaagtacaataagttcttccagggcatcccgcgaaccggtccttaatcgccatgggcacgactagcaaaaccatgcacccacagcccaccatgtagtgtattttaattaaccaaccctattgcggtggcactattccaaaactattgctaataatcaaagcctatgctttagtgtgatccccttttgtgcactagttgaactaagcatggctaagcatctcctaaaccaacatctagtcattttaatacccaagttatcaatggcgtaagggaaacaacatatagctgagtaataggaccaatcccacatgatattgtaaaacagtgcaatatttaatagaaatgcgggacatttgtaaattgggtacaatatgatcaattgcaatgtatgacttgccttgctctcgcactgatggaaccacagcaacgtcttcgagaaaccacgaatcgacgaaacgggcgaaatctacgcgacaaacaaagcacacaagcaaaacatgctataagactactgaaacaggaaacaaaaccattttttatggattctatacatttttatgaatttactgagacttgaatggacttaatcggagctcggatgaattagttatgatttttagaagattatctgtgtttttactaataaagaaaaagccttaatgcatttattgcgcaatattgccccagggctgacgtcagcacaaggaggggtggcgctgacacgcgggacccgcgggtcagtgactcaaggagagagaggggcggctggcaagcgggccccaccgagcggcggctcaaggggaggaggagacgcccggtcggctcggctcggcctcaaaccggccgaccggttatggcgagggcggtggcgcgcacgcacggtcgccggcgacggcaaccggaggcgcgggaagcggcggcggatgacggcggcgcgaaggcggcgacacacagccgaagcggcggctcggcccggcacggcgctaggagggagagaaaggggaaaagagggggaggggcgcctcaccgcgagttggccggcgtgggggaaagacgacggcgaacggcgacggcgagcgaccggggaacggcgacgataggcggacgagctccgagacctcatagggaacaagatgggagggattagagggagaggggtggttaacggcgagcggattcgccggtcgaaggcggcgtccatgggggtactcaccggcacgcgaggagaagcaagctccggcggcgagattgaccggggaaacggcggacggggtggcgcacaagcttgcgaacccggcggcgtcgacggcgcggtgcggcgacggctctagcggtggcggagtgcggccggagcttggcggcgagcggcggatggcgggatgagaggcgcgggagcgatggagagctcgggagggctcggccgagaaaggaaaaagagagaggaaggtgcgggcgtgcttaaataggaggggggcggcgagttgtggccgggaacggcgcaattttgccggagtagtggaggaggtggaggaggagagagagagagaggcgggattcaaatttgaatcccggccatctcgcgggcgcggggtgattggagtggggcgtgggcgcggggagggcggggcgcgcgggggagtgggcgacgtggcccggggcgcggagtggggcgcggaaggcgggcggcgatgggtggtggtttcggcggcggttggcgcgggcgtgggcggccggaggttagggaaagggctgacaggtgggccccacctgtcagtgcccgagagggagaaagaggccaggtgaacttcgggagtaggagggaggagcgggccggcgcgggaggaaatgggccggcggcccaagaaaaggaaaaaggagggaaaagaaaagataaaaaggaaaaaggattttcccagggatttaatattgcactttgcttattttaattgattaaaattatttccaaggctctgaaaattccactaaaaatcctgttagtgaattttgacatgtagaactcaagaaaaattccacatgccaattccgattattatttgcatttattaattagggattcatctctaggttaaattaaacaatttcttcggatgatttattttatgaatttagagcaagggaggggaacttcagggcgtgacattgttgaacacaaaatctgagttaatttatcatatttggtttaagctggttattctaaccccaaactgaactcatcttagatctttggtacaaagtggaggcaaatagtataacgacaaatctacaatcatcacaactgataaaggtagtttgagaaataaataaaatgttacagttctttcttttgcttctaaaggtaatactctatccatttctttatatttatcacagttgactggtactgttacaactttaaccactaaaaaaatttaaatgaaatcttaatatttatgtttattatgctatacattttgacaatatgacatctatttaagtatgtagaatttctttttgcaaaaagaaagatggtcaaagtttaaatgtgaatattgcttggtgataaatataagggaacggaggaagtagtatcaagagttagtatttgatgaggacttaattgggtttagatgatatttttatgagagaatctactcaaagacattgagtttgttctaatttaataatttttcattgacattatcttttcctataattaccattattttaaaatgtaccactggggtcggtcttttttttttctaacagacctattacccgtaagatgcaaggctaatatttatctcattagaagtttcaaaataatatatgaattttttatgtagcctccttatacaatatagaaatttgcatataagttccatttttcatttttattttttaaaagttatttttgtgcggtatatgaaattgtttacgcaaaagataatgtcacacaaatattttgtgtacaatataaaagatgatttacattaaaaacaacaactggaaaattctatttatatatatatatatatatagcatctaacaaataaattacattttaaaaaagaaatgcaaaaatcttttatacatatcaccctatgctaatgtttagcctaccaattcatgactaaacattagctctcaaaattagccatgggctaatcttttaaacatggccttattcatgtatgaaagatacacaaaacaattatttgttcatgaaaggaaatgaaaggaaaccatgatcattctagaatgattgaaagaaatccagaaggcatcaaatatgctcatacgctttaaaaagttgtaacaacatcaataaaaagaatgtagaataaatatgttttgacaaaattaatcgattggagctcatgtcctcgagctacatcacctggtgagtggcgactgcaacacaaaattatagtctgcttacgacaatgaagcatacgcaaagatatcctatctaaaccaacgtactgaaatttgtctcctttttataaaaaggattatcaaaatttacttctttaaagggaaaacatcaataaatcgtgacaacgaagtcgatgaaagaaaatcgtgaaagaaaaccacccaagcgtctctttcacacgcctgtgagatgaggtagccggaggcggcaagaaaaaaaaagaagcaaataaccaaaaagccgaggaaaagaacagaaacaaacaacacccaatcaagaaaaatgaaaatgaaaagaaagaagaaaaaacaaaagaattatctgcctgaaaaaagatttgaaaaaacccggagacgcgttggtttaatccatctccccccctccccttttctatccctctcctcgtgaatcctcgcctctccagccgtcccgtgctccgctccactggcgcccttctggaaccctcaccccctcctaaatccaaccaaatttccctcttctcttagcccaaatcacttccccttgttccaaatcccgcttcgatccagcagccgcggtcgggttcgtggcgaggttggagtgctcctgccgaattcgggcggttttgctgggggcaccgagagttgctgccatctgtggtgatctgatccggcggcgcgcggcgggagtggtggtggtctccgttggttctggaagtggtggtaagagctatgtggattgaggcgtcgccggattgagcatgaggggtggggttgctggtggtggtggtggtggtggcgcgccgccggtgtgcgtggcttggatgatggatcaccgagggcggttagtggagctgtttggcgcggtgaagtcgtggatgccgcggcggggagatcactctccgcctccgccgctgccgccgccgccggcgtcgcaggtgggtgctgggggtggtggtggcgcggcatcgccgcagccgcatgatttgtcgagggacttctggatgccggaccagagctgccgcgtgtgctacgactgcgacgcgcagttcaccatcctgaaccggcgccaccactgccgccactgcggccgcgtgttctgtgcccggtgcacggccaactccgtgccgcgcgcgccgggggacgccgcgcgtgaggacggcgagcggatcagggtctgcaattactgcttcaggcgctggctggaggaggaggcggcggctcggagggacgtggcgcagccatcgagcccggtgctgagcccgtcggcgtctgccgtgagcatcgggagcgacaagtccagttcgactgcgcgtagcagcgccgggacgaacggccagatgtcgtcttacacgaatgttagctacactgacttcccatctatggcagtcgagggccagggtgagtgctgcgagagggaaggttgtgcagagaagcagctgcctgcaatggagccggctgggggcgtggagcctgcgacttatgtggacaacacatcggatccatacaattttggcataaataggtatgcctttatgagctttttgctttgctcaataagaaaatgaagcctaactagttgtactgccatctaggaagtaagatcacatatatgcatggttgtctgatattctgataggaacttgcattcagcttctgagaacattgctgcatatcatgttggattttgttaaaaggcattggacaaaaggtagctgctaatttgttcaaaatatttttgttttccttctggatgcttggacttgaaaatccatgtagttgcgctttgatattttatattggagagcttgcccgctgacattgcttttgatacatgcgcacaaatgctatctcaaacttagagtatactcgttgctttcatttggtgttcattatagggtgccatcaaattagtctcaaatctatgccttatggtgctcatttatgtttgttcatggtagtgtaatataagcaattaaaattaagcataggttatgggctggctggtggttagccaacaagtgtgattggaactagttacacgattttgctcttaatcatcagcattgaaacagttgtctggaaggtgcagacgggaaagtatggtcacatgctattttccatttttcaatactccaattgtgtggtactacctccatttcaggttataagactttctagcattgcccacattaatatagatgtgaatgaatctaggcacacatatatttttagattcattaatatattttttgaatgggggcaatgctataaagttttttaacatgaaatggaggaagttttctttttttaattcatagcataaaggattactcagctttttttagaaggcttagtgccttattacttttaattgcaaatcgttaactcaatatggtgaaattacgttttg

SEQ ID NO: 67165 - DNA, 34719 bp, Oryza sativa
  unsure (1)..(34719): unsure at all n locations
cgtcgtgctatccgaatataagagccaggtggtgtttttaaggccattttgtcagggaaagaaaatacccaagtttcgcttattaaaaaataagattgtggggaggaacgtaaaaagttttgaatgagaacttctggatgatagatcctaagtaggtaaattgatgtagataaacttgttaatgtataagacaaaattttaacttcaaaaatgatttattttgacatggaggaaatgccaggaagcataggatatatgtcacatcgaatccggtggggtagagaccaaatcatttctaattggagtatgataggcagaaatcagaaataatgtggacggttgtcagttggtcgttacacaacaataaaatgattcctgggcttatcccctaaaaagtaacgcaagaaattagttgggtgcgctgcagtactaccctagatattgggttgattgctgctgcatatatcatggtgtgggcaatgctagaaagtcttataatatgaaacggaggaagtattttttttttcaattcatagacataaagatttacccagctttatttagtaagcttagtgccttataacttccaactgacaattgtttaactcattatggtgacattctgttttgcttttcctgctgatatcaacatgtttcacactctgtgccaatttttattgtctaattggcatagctgccaatctgttattgctcatctgtgccaaaaaccatgtcaaattgttgcatattctgtagtccttttttttaatgagatgccacaaagttacttgataatcagtaacccagtttttgcactagtttagcattagcacttaatttcatgataattagtaccccagtttttgcactagtttagcattagtacttaatttcatgctttattctctggaaatatcttgcacatgaatcaacaaatgaaaggaagatatgcattattaaggttcaaggagcattattttgacaatccaacacctgttttgtgccaggagtgatgatgaggatgatgattatgcagttttccactcagattcaaaaacacaacacttgcaaaattctgatgagtacttcaaaactgtgtgttttgatgctcatcaagttgattgtagtcatgtaaaagaatctgtttctccgatgcaagatacggaaaattttattggttctgtgggagtagataagactggagatcacatcatggataatactgaggaatgcaatactcgatcttcttccttgtatagcatggaaatgctagaaaatgagcctgtagattttgaaaacaatagctcactctggctgcctcctgaacctgaggatgaagaggacgaccatgatggtgctttatgtgatgaggatgatggggaggatgccacaggagagtggggatatctacgctcaaacagttttggcagcggacattgtcgaagtagagataagtcagctgaggaacacaagagagccatgaaagacattgttgatgggcattttcgggcattggttgctcaacttcttcaggcggaaaaggtacagttggttgataaatctggcaaacagagttggctagatatagttacttctctgtcttgggaagctgcatctattctaaaaccagataccagcaaagggggacggatggaccctggtggctatgtgaaggtgaaatgcttggcttgtggtcgtccaagtgataggtaaacaaatttacccttctgcagattatggtcaaactgttatgattttatatctgtctgctttggagtattcattttccttatagttaaaaaaatatgaatacgacagtgactcagccttttgtaattcaaattcatgatgcaaacttgctggcaattttgttttatcaagttattggcctttgaaatttcacactttattactttttcgtatcttattagtgctccatgtaagagcttcattttggttctttatttccagttttgttgtaaaaggagttgtttgtaagaagaatgttgctcatcggcgcatggcgtcacggaaagaaaagccacgcatcctgatccttggtggtgcacttgaatatcagcgcatatcgaatttgctttcaagttttgatactttactgcagcaggtattgccattaatatctttttatgcatatgttgtaaagccgaagttcattttaagggcggtatagattgaatgttatgttgctattggtgatgcgttgtcatgtcctttttgctccaggaaacagattatttgaaaatggcagttgcaaagatcaaagcccaccaaccaagtgtagtgttggtagagaaatctgtgtctcgatatgctcaggatttattcttggagaaaaacatttcacttgttctgaatatcaaaaggccacttctggaaaggatatcacgttgcactggtgctcatatagttccgtcaattgattacgtgtcatcccaaaagcttgggcattgtgatctattccatgtggagaaatatgttgaagagcatgggactgctggagaaggtggaaagaaaatgctgaagacccttatgttttttgaaggctgcccaaagcccttgggttgtacagtaagtattcagttgctaactcagtatctcagttataacacttaccatttgtcatatgttgcagctcctttgctttatctatttaatccttagtctgtgaagcattcctttaaaccataccgtactttattttttcctccctaaaccctaatatgagtattcagctgaaatataacaatggaaagggggaaaaaacaaatcaatgcatttcaaggatacagtgaaggttgaggttgaatcaaatcaatacattgaaaaataacctgcaagtgatcatgtattaatttctgtgcaatatgatttgttaagaacctattccttcacaaacaactaatatcatttggtattaccctggcgtggatgtttgctccttgaagagtgtagcgcttcacgatcaacgttaatacttactctagtactttacgaaagaattgaataataaaattgaagtcaatttcatgtgctaactattcctaatctgtagatattgctcaaaggagctaatggcgatgagctgaaaaaagtgaagcatgttgtgcaatatggagtctttgcagcctatcacttggctctggaaacatcttttcttgtggatgaaggtgcaacacttccagaactccctcttaagtcaccaattattgttgctttgccagataagccttctagtgccgatagatccatttcaactatacctattttacaaatgcctactgcttcatcaccaaacgatagcttgcaagcatttgatgtgcaaacggatggttcaacatttaatggttttcaaacaatggaccaaacaatggtaatgtgctctcctgagtataaaagctgcaaaaaactgggagctggttctgcccaaaccgaatctgcccatttcaatggccaggataaaaatattgcctgtttgcatggtatggttccttggtcatctactgatcccttggttcagcaatcggccagttcactttgtcattgtccttcttgttctagagatgtagttaataaaaagcattttgaagaacgtcaacctgaaacatctggacataccctggataatgatttcaatgcgttgtctgcacatcgaacaaatttggagtctgttgagagcggtcacttatttgcctataattctgagaatggtgacaagataagagctaaactgtctgttcctctcaatgtgcaaatttctcttgatgatgacagttcaaaggatgattcagtaataaaaaaagatgaaattccggcatctcctgctgacaaccagagtatattggtttctctgtcttcccgttgtgtttggaaagaaactgtttgtcagcggccacaccttctccgcataaagtattatggcaactttgacaagcctttaggaagatttctgcgtgaccagctctttgatcaggttagattgtcattctcgaattcaatttatagaaactttatatactgcttaactttgacattttgtttcagaacaataattgtatctcttgtgagttgccaccggaggcccatgtttattgctatgtccacccgcaaggcagcttaacaatttcagtgaggaaacttgcagtgaagttgcctggtgaacatgatggtaaaatatggatgtggcatagatgcttacgatgtcctcgtgttattgggctccctccagcgactaaaagagtagtgatgtctgatgctgcctggggcttgtcctttggaaaatttctggaacttagcttctcaaatcatgcggcagctagtagggtagccagttgtggccattctcttcacagggattgccttcgtttttacgggtatcccctcactcctcttcaatttcattaaattggtaaatactatggcttacatgtttgtattttagctttggtgaaatggttgcttgcttccgatatgcatcgatcaaggttcattcagtgtatttgccaccaccgaaacttgatttcacttctcagcaccaggaatgggtagagcaagaagcaaatgaggtaggctgtttaattttgtgagcaattatgtgataatttctggttgacgctaattgtctatgattcaggtggttgactcagctgaacttctgttcactgaagtactgaatgcactccaccaaatttcagagggaaggccaattacaggttcttttgatggcaacatgaaaatcctcgagttaagaaggaacatcatggagctggaagagatcctgcaaatagagaaagcagattttacggtaaattattatttttatttatgttttgttatggagccatggctccatttggctctgttcaaaaaaatgacacattattaaagttgtatgctaattattggagcattcacctttaggaatcattgaagaatctactgaacaaggagatcagaaaggggaagccattcattgatattcttgaggttaacaaactaaggaggcagctactgtttctgtgttacctgtgggatcagcggctaatctttatagcaaattcaggtggcaagtactgtgacacactaggaggtttacgggttgggagtaggagttctgactctaacgataaatcagttgataccaatgcaactacaaaactagagaagagctcaaagggctccgaagttctttcaaatgctaaggaaggatccttgaagcagagccaaagtccacttcatgctaatgacaaggagcccaaccaacctgatcaatctaatggaaatagttcaaggattggtgcagggttgaatggcatggaagatgcgattgccaaaatcaatcattctaacagcgcagatgttaaggataacctggatcatcaagaatccagtattggtgttcgtagggttctttctgatggtcagtttccagtaaatgctgatatttcagacacattggatgcaaaatggagaggtgaaaatggaacagttcctgatacaagtatcctgaaaccattagctctgctagaaggttcagctgatcttaaaaaccaagctaaggcagtgccaaccaatgcttctttatctgtcaggtctggagatacagtagaagacttatcaagctggctcaaaatgccatacatgacattctatgactccttaaacacaaattctgggacagcaccgagatttggggccctggctgactacaatcctgtgtacattacattgttccgtgagttatcacagcaaggtggagcaagactttttctgccaactggagctaatgatgttgttattccagtatttgatgatgaaccgaccagtataatttcttatgcacttgtttcacccatgtactgtcaccaaatgttggatgagaacagcaagaacaaagatggtccagattcttcacttccattgcctgtatatgattctggaaattttaatccttttcatttatttgaggatttcggatccgctgatgatcttgcttcgtcaatatctggaaccagagggtcatttgttcccgatctagttcacctaagagttccctttgaggatggtggcccactcgggaaggtgaaatacacagtgacgtgctactatgcgaaaagctttgaagctcttagaaggtcttgctgtccatctgaacttgactttttaagatctatcagtcgatgcaagaaatggggagcacaaggtggcaaaagcaatgtgttttttgcaaaatctctggatgatagatttataataaagcaggtcacaaaaacagaacttgaatcattccttaagtttggactagattattttaaatatttatcagagtctataagcaccggaagccctacatcccttgcaaagattctgggaatctatcaggtatatccctttgaccttctgttttctgttttattgatcactttggttctaagaagaaacttaattcttttgattcaagagaaaaatagctaggggcatttggctatcaagcagagcctcgattttaaatgtagctctgtctgtcactcatgagtagtgacaaatctttgggccacagccaaattgtacagcaggtggaagaaataataaaatgtttctttccatccaagcaacttatgtgatactcatatgttgttaacttacttgtgggttaacttatgtactagttcctattttacagggaaaaagcaaaacctgacttttctagaaaaaaaaaccacatttatgtgatactattcgagttatcagattaaaatagtagcatttgtaggaaatctcactaaagttctatgttttatgtgtctgatattttctggtgtttaggagcacagtttttatttcttatccaattatccactttacaatcatattttaagtttaacatggtacaagttgtaactggaagggatatgtatttattctgtttacatttgcttgtttaagttacattcagctctatttctttatctttaaacatgatcaattgcaaatttcattaaatatatgtaagaactgcgatctatacaggttttggaggtctatttttttcgtacaacttgttaggcgactacctgcaattgcttaatttgatctagtatgtgttccattaaacgctccttcagaaatctcaacccataacccagtatttggaggaagtattgcaactttggaccgatggacctatttttctctctctcagaagctcctggattaatcaagagcaataatccatgatttatatagtcatagcattatgcatgctgtattgatgatagatgctcacatttattggctggaatggccttgctgaagtatctgataggtagattttccactatgaagcttacttatactaaaaggtctatgtttttgcttaggttacaattaagcatgtgaagggtggcaaggagtcaaaaatggatttacttgtgatggaaaatcttttatttggacggaatattacaaggctctatgatctcaagggatcttcgaggtcaaggtataatgctgattccagcagcaacaaggttcttcttgaccagaacttgattgaggcaatgccaacgtcaccaattttcgttgggaacaaggcaaagaggcttctggaaagagctgtttggaatgatacttcctttctggcagtaagttcagattctgatagtgagaattatctcattcatacatgaatccttgagctaagacttaaaaattattcaatattttcaaatcttcacctttaactttggcctcttacagtcactacctaaggtgctctttttttttttttcagtcttcatcttgatttatgtctaaaagttgcttacaatttataagagggtagggaatgttgcacagtttccttaaagatctttatttttcactcacaaaaaaaatctttatttccttgcaaattattcgttttcccttactagtatgaaaataatcaggagaggagccactgcccgggctcagtggcaaaaacaccattaaatttatatgttgttgaatgaatttaatgttcattcaacaataatcttgtgttgttttgtcagacaatatatttaggatttagtgttctcatgcttgaagccttgaagatcatcctgtcttcaggcctgttcactttgatgtcattttcaacattactaaattttggtaaaattgtcaaaaaaagtggctgcatttagtttgctgccaaattttggtaactatataagaaatcctgcaaaaattttggcaacttgccaaaattttggcaactaactatgccaaaatttcggcaatgccaaaatttggtaaggttttttttggcatcaaagtgaacaggcctttcgatgttttggctgtagcacctgaagctaaggtttataagttcctagcagaggcatatagaatgtttttttttttttttcaagaaagaggcatatacaatgttaacttcatacttgccgctgttgtctatttccttaatgtttttcattctcttcaattttggtagggtttatgagacaggctgataagatttattgcaggccagtagcagcattcgatatatcttctcatatgactcattaatgaagtcttgtcctcttgtagggaattgatgtgatggattactcattgcttgtgggagttgacgaggagaaacatgaattggttctgggaataattgattttatgaggcagtatacatgggacaagcacctcgagacatgggtcaaatcgtccggtattctcggcgggccgaagaatgcccctccaactgtgatttcacccatgcagtataagaagcggtttagaaaagctatgtctgcttattttattgtaattccggagcaatggatgcctgcaataatcaatccgagcaaatcatcatcaaatctttgccaagaagatcctcaaaatgcttcacaagagtagtacaatattcagttcattatgccaggcagagagcacctggttttttgtcttgatccaatcaaaagcgccaaacgatcagtctggatgctgcggcatcaatgtggtattacgactgcaattatcaaaatgcttggactctcatttgcacagatccgattgcagtggagtcgtcttggctcaagaatcatcgggtgtatatatccttgaaactgtaattatgcattagtttttttattttctttttgatttattatgtaataatataatgtcgtcgcttctctctagttcccattccattttggttggatgtaaacaatagaagtggggcattttttttttgtaagtgctcgttgtatattattatatatatatgccatgttatttatttgggggggctattgccgtctgtaataacaaaaataagagtagttcatgcaaatgtcctgcgtccaaactcttctggcaggagaatgttgaggtctggaataagaaacagaaactgccataaaagagaggccagaaagctccttctgtgtgcataacagctactgttccgcttatgtgcatatgtttggaaacaatggctatatggcttgcctaatttcgcgctctgaagaataataacttcttttgcaagacaaacgatactgaattggctagactggtcgaatcagaggtttgaagacttcagatatagtattccacaaaaataaggtttggataatttcactatcctccaccgactttatagtacaattatacatgatgggattgaggttgaaagacaatatgaacattttcatgtgtgttaccggaaaagttcatttcaattccacctgcctccatattgattcgaattgaaatttggaagtaagctattcatttttctctagcaaccagtaaccctctcccgatccttctttatgccattagataggccggtagtgccatatattggaaatccatccggttttgggttgatttatttcctccaattatcccatccactttctttctatcaagatttcaatccactttctttctatacatttctctgattcgtgtagtttatactatattaacagcagcttttgtgtttccaaaaaaaaaaaaagtagtattgggttcagcttaaccccatgcctccacacgttaactccgcccctgccgggatagtttgagcaagatggcggcggacggcggcgacggcagcggcggcggcaggaagacgccgtggacgcaggaggaggacgaggcgctgcgtcgcgcggtgcgcgagcaccggcggcagaactgggcggagatcgcgctggcgctgccccggcgcgggcccaagtcgtgccggctgcggtggtgccagcacctgtcgccggagctggacagccgggtcttcaccgccgaggaggacgcgatcatcctcgcgcagcagcgcgtgcacggcaacaagtgggccaccatcgcgcgctgcctccccggccgctacgacaacgccgtcaagaaccggtggaactcggcgctccgcaagctgctgcaagtgcaacacgccagcggcgccggctccccgccggccgctgccgccgccgccgccggagacgaccgggacgatgccccagtctgcctccagctgttccccgcgagggccgggggcgtgaaggaggctggcttattcgccggtgagaaggatgtggaggaggaggacgtggcgaccagcctgacgctggggttgccggtgctgtgcgaggcggagctggagctcaggctggggcctgcgtggccggccaccgcgtgaacccgtttcgtggctggccattgcgaccggcgtcgaaccgtgcatctagctagaagtttaaaggtttactatggttcaatttggggacatttgtgcgagtgcaattcatttttaattcccaaagctaggagaaatcccaaaattagctcttccaccgtgccacgtcaactactttctggaaaatgtcaccggatccacctcctgattcggccggggtaaaattctagcgtcgcaccaaggctaaaatgcagcccagtagcccaccaaggccatgtttagtatgggccaaaccatgtcgatcctcccgagagaaggcccggaattttgaactaaataattcggcctatgccaaacaaggccgaagtgaagcctcaggtccattatggaagcccataatctttagtccactcctattacaggccgaaatctaaaaccacaatgggccgaagatgtgggctgccgaaacaggccttacaaactggtatggtaagcccataaatgtaagcccgtacgtggcccacacaacacgtgaagttgggcccaagtcccaaaattccatttgacacaaccaaaacaggccctacgtttctcgctcttccagtctttctcctctttctctctctctcgcaagtctcgattactaccgggaaggccattcccagtgctccgaccgccgcgccaatcaaccgccgtcagccaccggacagccggccgccgccgccgcgcgtcccacttggcccgcatcgcaacgccaccaggggacgcgaccgccgcctccccacccctccggcaacgcccgcccggggccgcggccgcatcagccgcccgccgccggggacgcccatggcgacgacgccggagacgctgcccaactcggaggccgtctcccacgcctacaagttcgcctccacctgggagaaggtcggtttcctcgcttcgctgcgcgtcgggtgggtgtgtgatccagtggtagcactggtggatctgatctgatggacttgggctttcgctgctgcagaacgcgccgctcacggagcagcagaatgccgcgatcgccgcgctctcccgcgccgtgtccgagcggccgttcccggccaacctggtgaggcgccacatctcgggattgtgtgcgatggtttgatccataggccctgttgcttgcgatgactaaatgttgtgatctgatgctaccatggtttggtttagtttagtttgccgtgctatgctcgggatagactagcccgtcaattgtacttgaaggatttgagatatttcattagttgcaacacagcatacatactccatttggtagttcagcggtagcggttagtttggtttataattgacagtacatgagtcaggtgaatttgcagttctgtttcgttggtgatgtttctgtgccactattagctcactctccacaattcaatactctagctagtgctggatttgtgatgatgtttgatgtttcaattgggtatcaaatgggtttataagtgcgttgtttttatggtcttgttatgttatttcattggagggttgctttttttaatttgatagaaggctgtattttgaggtctatttcccttccggctttatattattgcttgacattaaaacatattgctgggtgttacatcaggagaaaagtttagtgaaggatgggggtgtggttgtgccagaaaaagaggctgcattagaggagggtgcaatggatgcagtcttggtgaatacgcatcaggttagtttcataatcttgttgatatatcacttgtatgattgatcagagaatttcggtattctatctattcaaccttaagttgtgtcaggatagaaggtaaactatttctgcaggttgagctaatacctttattacctcctgtagttctacaaatggttttctgaactggaatcagctatgaaatctgaggtttgtgcatgttcatttcttttgttagtgatggcaacttgtggtaaaacaatgattttacccctctagtttatttgacagacggaagaaaagtatcgtctctacgagagtacattagaggaacgtgttaaaacatgtgatggtattcttcaacaagtaggtttatgaacccttttgtttgttaatatttgcaaaatcttttaaggaacatggatgctcttatccttttcaatataacatatttaaaatatgtccattcaggtggatgacacactgaacttatttgaagaactgcaatcgttgcatttgagtgttgccacaaagacaaaaactttgcacgatgcttgcgaccaacttgtatgcacccttttctctaagattctaaatacttgcacttttgctattctttctgttatttttttggcattttgtcagattagttatttatagtgaaacttccactctaaaggactgttactctgccatgtgcacataaaccacttttaagaatgtattcaatattagtgaaacttaacagatcgcctgccttgtattgtgcagctttggtaaatttacaatatggcattttaggtgcccaaaggaaaaactcattggcctgtttgtcatcttggacctcatgttaatgatcttattagtgatatattttgtatagctcttatctactcttttagtttgaacagaattacaaaattctttgatgcagtttcaacacatatagatttaacattacaaaactgttgcattaataaaaacaaatcattctagtaatcttttgtttgtaggaactgtattatgatctacaagcatgcttcatttcatatacccctgtttgagataattttttgaccagattattgctaaggattatctactttaaaagcagggaaaaaggaaatattttgagaaataaacttaacaaacagcttagaacaagtgatctaagcaatgcagtagttttttttttggaaaacgtatttttcgaagcatgaagcaaataatccgtttcaacaatctggtgaataatctgaaaagaacagggcctaaatgaacacatgagttaccttttaactacccttttttgtgtagtattctcttagtttattcatgtcgtaaatgcaaatatatattctcattttgccatattgctggtccctcttccgtttttttaatgaagtgtttcagtcaatggactatcatttctaaattcgaatgtaatgcagttgttggagaaacaaaggctgattgagtttgcagaagcacttcgaagtaggttgaactactttgatgaattggaaaatgtaaggtttggcatccctagtttgtctattgagcattagattaataaatttgattaaattaatgcctctcctacaagttctacatctcacacaagcataatgaattctgccatacatctactttgaaatttaattgttgaacttatgtgaaaccttattcaaaatttccaacgttatctactacatcctaatgcttgcatccttgatcattttgttagttggagaggtcagcatggtctccgtggttcatttgttccagaaaatgtttattccatgtttcggaggatatatactttagatttgatcccaatggatgtcttagatctgaattttgagctgattcgtattgtcaccttgtggttagtgctaacttgtacatgatgatgagtggcttgtatttttgaagatcccactgtttgctactgttctagtatattctgtagctgcataatcttgaacatttctggccactaaccacacttattcaattctaccatccaagtacacaatgtatcctgatgatctcattcatacattatctgtaatgttgattacacaatctgttttttttaaaatcctattttttctctggttaacctgcttcatatggtttaaaatactgtctccattttgcaggtctctactagcttttattctcaaactatgaacatcggaaatgaacaatttcttccacttttgaaacggctcgatgattgtatttcgtaagtagtaatagacaatgctctgtgtgtagttttagggtgctgagatttaaggagttcatgctgtatcctgtttgggtgcttataggtatgttgaaaataatccacaatatgctgaatctgcggtgtacttggttaagtttcgccaacttcaggtaaaggtctacttgaattgaactacatggatagtcatcacaggttagatactttgacctgataattatatgcttcttttattgcagtctcgtgcattaggtatgattcggtcacatgtcctgtcaatacttaaagccgcttcatcccaggtgattttcagttgaactttggtaggtaaatgcgatatgactactaaataccagataatagcttgattttatttcaggttcaagcggcgattcgaggtaatggttcagcaaaaaatgttgttacagagggtgtggaagcatcccttatctatgttcgcttcaaggcagctgctagtgaggtataccttttcatcaaatgatctacagttatatagaaaggcttaaacaaactgtagctatgtgatctatataccagtaacacctcaaagttataactctgctgcctctggttcttgttttccagcttaaaccaatcttaggtgagattgaaagtagatcttctaggaaagaatacacgcagattctttcagaatgtcacagcttgttctgcgaacagaggttatacttggtaagatcaaacaattattggttttatattttccttttttggcatggacctgattatttcttatcacttgttatgcaactaaagatacgaggcatggtgcagcaacgaatttctgaatttgctagaaaagaagctttgccttctctaacaagatctggatgtgcctatctgatggaggtaactgcatgtttaatactttctagttttcttattttcatctgtgttgtaggtttctctttccatattcagaaagttacatcttacagttgtacacgatagcattctgtaatgtagaagaattgagcaacacattgtatatttagtttcctaatattacgtgctctgcttactcctcatgctgagtatgatgcacttatcattattatttttggcatatttattctaaagcattgaaagttcttgatttttagttttatacaactgaaagtctcggggttcacttattagtatctcaaggtcacccaattcctcattttaccatttccatccttttgaggccaatagaagttagttatgatggcttcccctcaacctgggactttcaatgtcataaaactgaattctgagcctttgacggcacataaccaattttatctaatctccagtattcatgcttttatttttctctcctcttataatattcagctgattttgactgcaagacatattttactacttttcctgttgcttctcaggcatgccaatttgagcaccagctttttgctcactttttcccggcatctgcatcagatgtttcaagtattgctcctttaatggacccactgtaagcttttagtccctctggttcttatactgcaatgtaagcatctgtaatttgttctgcaaattcgctaaaacctgactttagacttgcataagtttttttattagctaaccaacaatcaaggaataggctttagaataaataggattttcaggaactagaaattatctggatcttaatataagaccccccaaaaattcctcaggcctataccagcttcctattagtgggctagtcaagtataaatgtgtaatcgaaccttaaattcctatgttaagatgagtttacagaagatttcatcaacttaagaaatagatagaagttcctttcctaaacaagagagatgattattgaagttctgtcatacaaaaagtttagaacctatagatatgttgacattgtaaatatattttcttgttaaaacatatggaacacagattatttggttagtttctgcaacacccttgttgtatgattcaaatttatattgacgtgtgtattgtgtagcgttcatacttttatgttatcaacttttcatctaaggtgattaactgaatatctgatatgcctttgtattcaggtgcacgtacttgtatgatactctgaggcctagactgatttatgagggaagcattgattctctgtgtgaactcgttgacattctgaaggtcgaagtgctaggggaacaactaagtagacgaggagaatcagtagctgggcttcgacccatattgcaaaggatacttgcagacgttcatgagcggttggccttttgtgctcggactcatattcgtgaggaggtactatttaaaatatgccccttattggtgacttcatgtttttttttcagtcagcatgttctcgtttgagtacgtggtgcatatttcgttcatttgttcgcaaataatgtatggttccaatgttgagaacagctgtcatgtggacttatgtcaagtttgttgtagaaccggcaatgcttttggggaaaacttgatggttaaatggcacttaaaataatatattagttatttgaagtgcttgacgttcttcactggtgatctgaatgagattcttttatgagcattgctggatgttgcatgccaattacaagggaaatggttgattattgtgtcatttgaagtttttgatagtgaacatattgttagcaatgtctgcagaactagaatgaactagccatgaattgaaaactgaacttgaagatcccctgacttttagttattatttagacaatcttgagctcaggaatgaaggagacttttcttatatattgtttaatctatttcatctttttttttttgttaattttgttttcttactattgttcagattgcaaacttccgcccttctgatgaagatctggattatcctggaaagcttgagagatccgtagatgcaactacaagttctaatgttagttttgttcttagtttaatgaaagttcatttcaatttaactcttcatggtcctagtcattcaataaaaatctgtcctaacagttggttcacacacagttttactggctcagatgtgtgcttaagatggtactatcagttttatagattttgtaatttcttcactcccttatgtgctaacatcatttttctccatgctgtcatctgatgttaaacaaagcacatgttgcttataactgaatccagttttaatcacgagcattatgaattatcagtgtagttaaagcattaatctaatttcttatgtttcaatctgtaggttagtggcaactcggacatatatgtgacatggtatagaccactggagaaaacagtgtcttgtctgtcaaagctatatcaccgcttagaacctacagtttttactggattagcccaggtattggacctcttaaagcttaagatattttctgttgttcattgttcatttcttgatcgaggccatggcatcgaacttgacatataatttcgattttcaccaggaagctgtagaagtttgctccacatctcttcaagtctgtattctccttcccttattgttcatgtcttaacaagatctaaagaacatgttttatgtgttgaactgcactctttgatattcagagcgtatctgtttgatcctgtgaacagaatgcaagcaaggtcattgcaaaaaaagcaactgcaatggatggacagcttttcctaattaagcaccttcttattttaagagaacaggtgatacaatttgtacagtatgtcaagtcaaaattttatagcatgcataagtccatcgggcaactcatgtggtactatacatgttttcagattgctccatttgatattgagttttctgtcacgcataaggagctggatttctcccatttgctggtatgtgcaactttgttcttttcattttgagtatgaactgcttacccgttgcataaccatgtgtaccattttttacatgaagcttgatgtttgaggaagttatggattggttttgcttgtattacatgtatactgttcatgctttttacggaaactgtttcacatgttcacctttttttataagaaaaggagtattcacttgttacatgcatggaaagatgtcgttaaaactattttactgatatataaaaaatgccagtatatttgataactcttgtcgccatgaaaccagacttctaatagaccatctggcaacaaacaaattacttgcgttttttattgctttcatcagctgtttcatatttgtggtaagaacacaaagaatcattagtactagatgtctccgtagacaaattcttattgttattttctcttgcgcccatataacaaatggcatttgctttcttttctcttgcccattcaccagatgaataagttgagagatttctttttgcctgtagtaagatataaagtaggaaaaaaagtaaaatgacctccctggctcatcagctgagacaaagatattaatgtctattgcattctatcaaattaaactcatgggttggtcagctgaacttagcaaacataaggtgctatccctgaaatataggtgtcaagtactggtgtgcggtcttgtcctcataaatgatacgttgacaagatcaactgttacattctagactttatttagagaactttctaattgtattgatgtttgtcagaaatctttgtaaaatgtctgaagattctaattaggttgccttgtttcgtgatgaaccatttgaactatctaatattctttgaattaattacctgaaaatcctcagtagaaaggttatgttttatttgctagttacacttgtgctcccataaaaatgcataccgtgcacatggtttgtatccaattaactaattgctgcatataacaatgtttctttttacaggatcacttaagaaggatcctcagggggcaggtctcgttatttgattggtcaaggtcaacatcacttgctaggacgttttctccccgtgttctggagaaccaaattgatgccagaaaagtaaccatcttgaactgatagctgatagttatttctttttggcctaaaagtaaaaaaaaatgtttatgttaatttctcattagttgatctcataaattcagtccacattgtgaaaattaaaataagtccaaacgtgatgcggctgttcatacataggacttgcacgtgcaacttcacatgcataaaataaggcagcagtctaatgtgattgctttgtagatgcccatatcctcgattttttaatattttttcagctaattttgttactactattttttcaggaattggaaaaaagcctcaaatctacctgtgaagagtttataatgtccattacaaaattagtagtggatccaatgctttcttttgttactaaggtatggaattgacctcttttcaagtgagaaagggggaagcctttgcagtagttgactcacttctcaatccattttttcttttttctctttttctgggaaaggctcagttctcactttaaggcctcacttgccattggcagttggcaccctttccccgtgaatggataataagggttttagttcaaaataccagtccacgtatggggattggctgggatttggcccatgccaaatgaggccaaaacctcttttgattctttcagtttgtccatgcagtattagggttcaattccttaatgcaatgtttcacagttctcctgcgatttcgagaacagaagtattagggtccaattctaacatccctttttgggatttcgaaaatttcagattatgaacctgcattctagtattcttttcaaaaccgaaaagtagtttattctaatggagatgaacatgattgtctgggccaggtaacggctgtcaaagttgtactgtcctcgggtagccagggtcagaaattggattctgttctggctaaaccccttaagactcaagcatttgcttctcctgataaggttgcggagctggttcaaaaggtattttccaagatgatgcaagtcagatcatgcttctttttccatgtatttcataaaaatccctttttgtaggttgggactgctattcagcaagatttacccaaagtaatgaccatgatgaggttgtatttgcaaaatccatctacgcggttgattttattcaaaccaatcaagtaagtatttacatctccacagcatctacaaacctatcttttgttcacgtctgctttttacataatatcctggtgtgatggcttaataaataatgttatttcaaaaacaatatctcaaattaagttcattttgccagagtgatcaatcagtacaatttgttgcctataagaaatcttatacataaataattcatgtaaccctatcccttaaaccatacgaggtgaaagagaaagctatcatgggcaagctatcaccagttggtcactaataattttttaacctagagtgcattatgatgaatgtgtatacatagcatgtctgatttctctagttgacttcttgaaggatggacttaaatatcactgggggcattttcatcttttaactaccacaaactttttccctctcaagtccttttagttgagcaagctttaaccttttagttgagcaagctttaaacttaaaatcccactacttttacaaattaatgtagttctatatttcagccttgtcaattcttttggtacattttatgtgtaagttatgtttagcgtcagaatcttttatctgagttcctcattgatcaatttatcaattcagtgaacgtataactatcatttggtgttattcttctttacttctaatgatttggggtgtaaaaaattgaactttgtacttttgaagaaacattaatccctctgaaatggattagaactaagctgtacttagatgtgtgcggaactaaagaaaatgttcaggcatttctgtacttgcaaaaatattgctcttctctgtatttgttctaattccatgtttgtctcaggacaaatatagttgaggctcatatacagctacactcccttctgaagtcagaatacacagctgacgaaatccaatcaattggtatgttgcctatacccgacctccagtctcagctcgacgctcttttgtaaccgttatcaagatgcaaatgcgaccctacgttttgttcgttgagacggtaaatggtatcctgaagtacagtaaccccgttgtaccagagtgatcagtgatgttgtaaaaatgtactatgttactgtggaatggagcatcattcttgtgtggaggtcagtgtgcacaatgccatgcttgacgtgatgttcccactgggccagcaatggcgggtccgtgattgcgtcttttcagctaacaagttactgtacacaagtggttccgtttggccgaggataaagtgctggaccaccacccccaacccctgcagttgtatcgtgtgatcacactttaatttcttcccttttaatacacctgagattgctctgtcttgtgattttgtgaggcctgccgattagcgttgcagttcgcgaatttctccggccagaacacctacggcggccggcggcgtcggccattttcgccggtgtgggcgagcaccggcgagccggccggagaagaagcagaagcaggggcatgggtattctagccgctgcaacggaccagcctcgaacccatccgttaccacgcaatcgggaccctacctcttggctcttgtcgcaatccagctcgctctcttttcagcgcgacgcacgctgggttgctccctcttgctgtcaaccgagctggccaggatatgcgatagaactgagcacgttacatgctcgatatatcagcttcgagggcagcaaaactaatcgcatcacatcacatcgcattcattatgtgtgatctgtgtgccagcttagatgctaagccctctgttctaaaaaaaaaactcaacttaggacaactcaacatagaacaacgaatcctccatcccatagaaaaccatctttcgaggatgaatctaaagaagtatctgtctaagttcttctctgaaagttgattctttttggaacggagggtgtaagcgtacaaccattagcttcatctctgaaagttgattctttttggaacagagggtgtaagcgtacaaccattagctaatcattcccgataagacatctttcattttgagcaatggcttgctcactaatccctcatattaaaatatacatttcaaaccttttgttttttaaatgttaaggatgaaagaaataaggggtgtctaaagaacgggaggataatagggggtaagattaagtgaaaattaaataaaggatgattggtatagactgggcagtaacaagttagatttggacacattttagcatggtgttgtgatggtgctaggttgctatattctggaacggagagattagttgttagcaagttggtgttgtaagctttcttcagttggcgctgtttgaagtgctcggcgaggtttctgttgttgatgtggtggtttgttttttctttttcttgtcactggtctcggtttttacttttacttattaaaatataattggtagttcccttccggtttattatattatgggacggatggagtagtaaaagcaatttgttgtaaaaacttgtccgcaccaacagtagatggatgtatttgcagaaatggaactttactctttgccacggtcacttgcttcgagattaatagctcacttgttaacaacttatcataaataggttccgtttcattagcatacttttcaaactgctaaacggtatatttagtgaaaaaattcctatatgattttttttaaaaatcaaataaatccatttttcaagtttaaaataactaaaactaaattaattatgcgctaataagtttctcgttttgtgtgtcagtacttgatagtcttcgaacggggccatatacgttataagcccataaatattaccaaaataaaaatttataccttcatctgatctccggtatctgaggggagttcagaggaagggtggtaattgatcggattaaacgtacgtagcatggtgacttgtgtggctcgtatggatttgaatatacgatagatatttttccggtgaggacagagagtgacaagctcagagaattcgctagctggaccaccctatatgttaatgcatcgatcgcatgagatgaaatgattaaatgaaatagtttgaaaactttcgtcgttcaaaacttaaaaaggcaaaatagccccatggatggatactgctgggaaggtgactggcttgtggccccacgtaaccagcgactagtgtgccctacaggagaaaaacgaaatgctggcacggtcgacgtagcaaatcgaagctttgcttggctaagaacgcatcaaccatctaatccaagtcgccctcgatccgtttaataagagtattgagaccaaggaaaaatttttgtttcggaaaagtttatagattttaccttgatatatagattagtatatgttgaatttgatggtgcatattcaggcgcatattcattttagcctggaaaaagaaacttagcctgcaggtcagattctatttaattttgtatgggtttgtgtacattttcaccaatttattgtgattctatatgggatcgggatttaaagggaagtctgaggcctgtcttaattaatctatgattagtatgtagtgtgacatgaaaagtatcacaatgtcggctttaatatacagggtgattgtgttagcgattcttatgtccaacaaaaaagagatcagcaaatgtacatatatgggtgaatttttttacttaggaatattctaaagtattgaatccatgagaaacgcaagtgcacttctccgatcaatccttcggtattttgaagttttcttaaacaaggtaagagatagttttgtaaaaatacaggtttaacatcaatttagtccaaaacttgaacgttaataactcaaacataacatgaggatttgaatcccaaaatctatagttttataataattttattattagatttgtagttttgcgatacttagtcttaaacctatagttttatgataaatttattattaaatctatacttttataattcatcaccttaaatatatagtttgtgataatttgatcaaattatctgtagtctttttaggaaaaaaactacaaataatttactcccttatttatgaaatattttgtgaaagttaccggagttttgtgaaatttactttcttatttatgatctaactttacaaaacatgttaaattaacaaaactcctgaaaatacgagtttaaggaaagaatgtcaggataacatgttgtcttctctttatttattaaaattttgacagacgaattaggatttaacacaaccgccaacacacaccatgttgaaccaaggttgtcagtatcccgattcgtattctagtatcttacgatactacgatcctatcaagccgaaacgataccgatcccacctagtatcctaattttcatagtatctcgatcctactattaattactacacgatcctacggaatcttaggtggtatcccgattctacgatccctacgatactacaaaatattatttaaaataacatggtttgaaaataatgtaactaaatatgctcaaatttatatgaaaatcagttaaatatatcaaaatcaacgtggtttctctttaataaatgtctctatttgcatgacatataccattactacattattttatatagaatggctatatataattaatataaatattaattaaacttaaaaaaagaaaaatctcatagtatcccgatactacgatacgatcctacgatacgatattactttgagcaaaacgatactacctagtatcccgatcctgataaccttgcactgaacattgcttgtcccgagcaaagctaaatgacaagggtaaaataatattaatacattcatagggataagatgtgaatcttacctcctatcaaatgattaccgaaataaattatttcttgttttttgcatttgttctccacttattgtttgatcacgttgactaatccagagaactactgacactgtaacctgaactttaaattggtggacaaaagtacatgttcacctgtaaatcatggtcttgccgtttgcagccattggctcaacaggtgaagattattgaagagtggcatccacttggggggcacgacacgaggttcttgagtttgcttactgctgagcacagaaccaaatcaaccaaaaagaaaggaagatattgaaaatgcttgtttgtacgacttttttgacctagcttggtgtcaaaagcactaagctaggcaagagagaatcagataactaatacacaaaggacctttttttcttatcacctacttgcattaagcatgtaagagtactaaccagtagccagtagaccttgctcaaggcttgtttggggagcttaagattctgagaagtagctggttggtagtcaacttttaaaaatctagaaaagctgggtttcccagcttttagcttcgagtgatcattagaagctccccaaacatgccctcaacagctgaagcggcatcactgatcaagaattggtttgccaatttggcttcttgtatgcacttactactactgctgtgtacgactgtacgattgaatatgcatgtctttttttggcttcgcgtattggaattatttactcatgatctaatagcttagtttaacacaatatcaccaattctaagattaatgtggaatttcgatgattaaaactgactggttgaattgaagccatgatcaacttattttgtttttccttcttgattcacctgcgcggaagtgaattgcattacgaaccccttccagtgctatgagatcaatcaggctctctttagagtttcgggatttagcataggaattagtcatcacttgttctcaacgccttctccttcttttatatgcgctggtgagggcttgggggcaatccggataggattatgatttgttaccatctatgattgtaacattttatctcttatctcttatttcttatttgtttcttccctgttagagatgaaaacattggaattatctcctccctaattatatcagtagggaccgataaaatcaaccaacatcatgtagaacatgttgttggcttgtttgacaaggctggcagcacttcacacttatcaacacatatataatacttaatcaacaagctataaaaaatgtacatgcatagggttatatatttaccatatagtataggctaatttacataattcttccactccgttatttctctctactcatcgacatgtaaaatagggacaacatgtaccacattcaacaggaaatcccccccttctgccccaatttcaatcaggttttggatggctcggaccattttaagattcgtgttgctctagtaaaccctttcttctcaccctaatgcctctcctccccgatgtgtgcgtgcttgtgtaaaatgtcgttgccacctcctcctttcaccccagcatccaccttgttagtgacctaaaggcacaaatgacaccgatgagacccgccataccggccacctctctttcctctttctccccctccccacctttcctcctcaagctagacgtcggtgagatgcctccgccctaccatacttcccgtttccaatggctcccttgccgtccccgccttataattcctttcttttccttcgtccccgcttgtgatgctagcccgctaccctccttcattccagtggcttcagtgttgctaccggcgcctcgctgacgcccattgccaggccggcgtctttcttaggcgccatccctttaagtctagggaaactccctgttccccctccttctacctacattccaccctcacctcaacttaagaccctaactagctagcgttatcgtcgccgatcatcggagttggaggagaaacctgccgaagcaagaatcgtgaagcggatctaaaggctagaaatttataaaactttattttcatttttctgtcgagtatgatttagcaattcagtataaaatatgcacagagacccctctctcgttccctccgcgtgttaacatcgtcctcaacgactgtacaacttttctttagcaaggctagctattatcactttatccgtgttcaactgttcatgcatagagcatcatcatcagcagtggccagttgcatgtgctgcaggtacaaagcatcttcgtgttctacagtggccagtgtacttacaggaaataataagacagacgtgttttctcatcattgtacctatgtgttgcgcatgcatagattgcatgacatgcatgtgaatggatcgatgcttcacatatgtgcatatggcacgtccactgttaatttctagctaggctataaaaataacaacacaaattggaacagtcgccatggaatcaatttatgaatcgcgtgtactgcttgatcgagcgcatcttaatttcctttagtttgatctttcctacactttacaccagatctggtacttccaatattcccttgagaatatatggaggccaatatataaaaaaagagtagtctaattaacacatgcaaaaattaagctacattgagaatgattgaaactataagataaggtctagcaactatataataaattaaaaagtaattaatcgtagctcgatcaactagttagatatctagtagaggaacctattcatttgggttgaagttctagacatgatacgagtgctcgtatttataattaattgttctttcagtacccatcgacacgacatcgaggcgtctacgatgactttacaaatctcaatatatcactagtacataaccccctgtagctgccgtttgggaactggctataggggtgtcggtttcccagtcggtacctttgcctcattcttatcggtgccggttctaaaaccggcacatatactattaaaaaataaaaaaaaacgatggcacctacactaccggcgggcttttncaccggcgccaccaccaccttgttcggccttcacgccaccacctagccgtgcccgccttcgcactgccacctcgccacgtcggcctccgtgccggcggccgccacccaacgccgcactggaagaggggggaggtcccctgggagagaaggggccggcgagatccagcgaccgcgccgctacctcgccgcgtcggccatcaccccacgccgtgctagagggggagaagggaaagggggcgaggtccctcgggagaggaggccggcgagatccaggcctactccaccaccaccgtcgtcaccgccacctcgccacaccagcctttgcggcggcctccaccttacccacgccaccgcgaggagaggaaggcaagaggggcgagcctccgggatggatggatagagctctcgatggtaaaaatagccggctcggttctattaaaaaaccggcacctataatataataatataggtgccggtttttttaatagaaccgtcacctatagtgtttaaattttttttttatcgtgcggaggtgagaaaagactcataggtgtcggttttaaattatccgacacctataagattggtccctatgaggtttttttagtagtgtatgttggtctttagaggtgctttcataggagtagagtgtgcgtgtgtatgtttatagaggtaagtgtgcatgtgtttatgtgagtgtatgtatgtgtatcgtgttttgaaaaaacaacttataattgattagtttgttttgttgacggcacgtattaccagcgatggttcatgctcatgcatgcaaacacgatcgatatattgttgattcgtgcaaacaatcataaggaactttgtctgcccgtttcggaacatatcctgagagcttttccatatatatctctgaatgccaattcaagatattgctttgcatgggcagcaacagcaaggatgccctccttgtgagtttccccctagaaaacgacatttcgtatctttacatttgtcatatattgctctaaagtgaaaaatatatatataatattgtctccatctctcacatacgtagagatagttttttttttatttttgaaaaaaaaagatcttagagataagttggaaatatgtagtaacaaacaaaataactccattttgaaagggaaaagcgtacgcacgatgctttttgtgcaaccatgtctccatttttcatggtgaaaaagacatccacaattattgagattccctcttttatgtattgtacacgagcaggaaacacgttgcttgaggacaaaatattatcgttgctgaaatattttactaagcttgggccctcttggaccactttgatctgacctcaatattttcatctactcctatctcacactcaacacacggttttattcatagggtctcttttcatgtgcacttttgctttggttgaactttttcccttggtaataacccattttttctctgttttcaaaaaggtttcacttgtgatttaataaataatagttcagagaggtgaacctaacacatcaaattgtgaaccaattaactaaatatatgcacatctgatagagttaaatcctctatacaaaaaataatgttaccatcgtatcaaaggaaaaaaaaacttgataggttttagagagttgagagatatccgctaccgcgaaagcgattttcgtagatcccctccccttaatttcgctggtggcataaattggcaatgtatgcagtacatatcatttgtacctttcaccatattttcagaaaagataatcagttaataaatgttgagagcataaactaactactactaacctaagtagcaaaactatagacaaagagtatttaatagaatcgcaaattgtttctgtccaagattcaagtttgtgcgtttagctttcttttaaatgtcaggtcaatgaataatttgtttccaaaaaaatcacgcgaatagagctgatcagtttctgaaatttacccaaattaattaactcagtcaattcaatgcaattatgcaaatcattactgtgggtatgttgggtctactagaggtaaacagcataaaaaaaatcaatatgtaatcatttttcctacaagaagacacaatggtcctcatttttcttgtacacgtcaatctttatcagtagtacgaactccaatttagacattctttgcaatatatacaacatttttataggatattcataattcaattcaattacaataggaatatatcaagaaaatttctcacgttccaaagaagccccgaagaggataaggattccaatgaatgacataatatgttcatccaaaagtgttcgacatattttattatttggtttcttcaaaaattaagatggtcatatttgtagtttctatgtgcaaattagttgttgaccgaaacccaaaattttttttatacccattgattacaatgcatacgtaaagtttctttgttttattaattcctccttaaactttttttttaaaattacacagtacaacgcagacactcacaacgcacgcgcactcacccctatgaacgcacgcacgtaaaccctacccctatgagcatcttcgaagactggaccggcaaatcttggagagattgacgaagtcaccacaggcgcctcgctatcgacgggtacatcgcctaccactgaaagcacaacatcgttaaatcctggaaaattcctccttaaacttgatgactccttatatggacagttttagagagagcatattacaaccttataccatatattgggccccaatctcaatagaagattcttcttctatagatcagctactattgagtcatatggaagcagtgaacacaaaataaaaaaaaaacatattttgtggacatggggtggttttaaatatccatcactcctctccccttcacttcccctcatccttccctctcatctcctaccgccacaaggggcgcctagctattcggctccaagcgtggtggtctcaccgcctcacctgaggtgaggtgattccacccgccgccgccggcagccatgcttccaagaagccagagcatcttccacctcggcgaggagggtggcgtcgtccactgccaccgcggcggtaaccacctcgtcgcggcgtccatggggatgggcggcgccggtggacactacggctccggcacgcgcggcggcggccgccgcgcgcgcgagcgcgagcgcctcgtcgtcgggctccagatcatcgtgcacagccagcaccaccacggtcggcacgcgcacgcgcacgcggcgagcgtagtgctcaagcagatggtccggccgcgcgccgctgccgccgccgccgcagggcgccacggcgccgtctcgtgcagcttcctcaaggcctgctccctgtgccggcgtgagctcagccctaccaaggatgtctacatgtataggtaccaaaaacctaacaaacctcaagaagacatttatcatgcatatgcatccatgcatgaacatgagaaaaatgttttcatcctcgagaaaatatcccttcgatttttacatgtcatctaaatagttattaatttttttttaaaaaaataagataggttaatataaaatatatcactctcatgtacatatatgataatctcgtgtacatgtagaggtgaccaagggttctgcagcgaggagtgccggtggcagcagatcgccgtcgacgaggcgcgggagcgggaggcggtggcggccgcgggccggccggagcggcgaggtctggctcgccaccacagccctcaccgtgcggcggcgcccgtccgtggcaggccaaggaagacactagccgtagcctagagttattactatgtagtgttaaagtacttactgagaagaggagcacgtactactactgttcatggagaactttgagaggaagttattagccaggtatgtcaataacagaaggactttgcatatgtgtatgcatgcataagaagaagaagatgtgataagagagttaatttgagtggtaatgaagagaggttaatcatggagtagtagaaaggggttgatcagaatattgggtcagtattttttgtttctattttttgcgtgttgtaatcctagaagggatatgcaacttgttgttagatctgtgtgtttgtttgttatacacgtacgatccgatatggttgattaattatattctggaaggttgcatgcaagaaagttaagtggagaacaataagagattctgtgtgcttgactgcttgttgctgtgtgattcgttaggtttcagttgtgtccaacgtgtaggttctccctgtaaacactagtggttaaaaagggtgccgaatttgatgcctcgctatggaattggggaacaaaggatggacaattctgtggcatccaaacaacttgatgggaagaatcaatgtgcaggcgaaaatgggtttctttttcagatagtacaaactacaaaatgtgagcagaatatcacatatatgcgttcgtggaagtgaattgttcggaatgttggaagaaactagaacgacgattaggcccattgttatatttcatcaaatacctatacaatcgagactcggccaaacatctttagcggtgtgcatagtaagatgaaattggggaacaaggatcgatggacgattcggtggcatatccaaacaacttgatgtgaagaatctccgaaaatggccgggtttctttttcagatagttaaaaaactacaaaatgtgagcaagatagcacatgtgcgttcatgaaaagcgaattattctgaattggaagaaactagagacgattaggcccattgttatatttcgtcaaatatctttagcggtgcagtaaaatatgcaaatatttttcattgggattaccaaactatatccctactggaattagatttattatcatcgatctatcgcggttcttaaattataaacacggatcattaatatacgacttgctaaaaacgtcatatgttaatgacctaagggagtataagcgtataacttagagcatctccaacgtacatatcgatttatctcacagacaaccatactcaaattaatactatataatggtgggacccgtgaaacccacactcagcaaccatgagtattttccggtggaatccaacagtgagctcctttgcatttgtatttaagtaatggatccatgattttttttatctcttctgttcgaatcaagaagcctgttcgattttatgtgtcagcatgattagcatgttgcagtgttatggttcgattttttagcacactgtagatgcttttagccccatttccctcttaaaattggactaagagcatctgcggtgtgtcagaaagggattttatcatcttccatatcactgcccactcccaactacattcctttgtgccacttctttttcccatcttgttggcacctataatattgtatatgtgtatcctcttgttgtcctgtactaacattggtttgggcttgcaatccaatccactagtggttccaagttccaacaccatatgcttggctgcttgcttggccatccccaccaacattgtagtaggattttacctcaacaccaaaacaaaataagctgatgaggtcaccaccatgtcattgtcgccaaacaataaaatttgccaagcatgagttttggagcaaattcaaagcgagtacatgttatcaattaccattttttaaaaaatctttccagaccatctagcattttttttcaaacttttacaaaacattatattatactcccttcgtctcgaaatataagccgtataagatttttatatggtcttcacgattatattttgaccattagttcctttcataatatatcaacaagtattataactatgcaaagcactttcaaaatcgaatctaatgataccttatgcatctattagtaaggcccaattcacaatccaaggcccacctcgagtttagccggccctttgtgcttgaatgcttgtgctccaagtcgattcggatgatgcgccgcattgttcgtctccgactcg

SEQ ID NO: 67166 - DNA, 62010 bp, Oryza sativa
gggagtggaagggtgtggggtggaggagaagcggcgctggcagaggtggaggagaagcggcgccggtagagtgcgccagagattggggaaacgcggcgcggcgatgacgcgatctcgatccaggagaggaagcgagggcgtcagcggcgggcccgcgcctggcacgcgcgcgatggaggaagcaagggcgttcggcggcgggcccgcgctggcgcgcgcgcgatggggagagggggagaggaagcgagcacgcgcgatggggagaggaagcagcacgcgcgcgcgatggggagacccggcggcggcggggacaacaaatcggtggcggagggatgtgcgtgatggattgcgatccaacggctgatgaggattcgatcgaacggctgaaaaaaaaagagtgacgtggcttaaccacagctcaggaaaatccctaataactacactaagtggggatcaattgtatagtattataggataggataagttgtgtaactacttggaaaagaggattttaaaggtattgggtgtttatccattcgcatactgtaaaaataaatatggtgacacgtggcaggccacacccagaaatatgggttataaatgcctaatgggcctcagcccaaagagagctattcaacgaaacccgtaaaataatcaccaaaaccgcttcatcatcttcctcgccgctttagcttccaaattttccctttcacgctcctgttcaccgtcgtcgccgccagaacttgggcaaagcttcccctcacatccagccatcaaagcgctccagattctgcgaaaatccaagtgctctagattccgcgaaaatccaacgcgggcttcctcctttcatctcccatccccaagttcagagccaaaaaattctattccaagttctcctccatttcattcatggcggaagagagagaattccccttcgatcaatagggcatctctgtgaaggaatcaactctgaaggatatggtgaaggaaggcgtgatcccagcgaaggaaattatcgggtggtgcccagccttcggctatgagttcccaacattgaacactggcaaaatcgtggtatttactcctttcttctacaacggttttggtcttcccacttctaaattcttccgaggtcttctggatttttatgggatttagatttatcatctgaacttaactccatcttgcaccttgccatcatcattcatctttgtgaagctttccatggaatacgacctcatttcaatttactttgtcgaatgctttatcttaaagcccaactgactaaagaaaatccttgtgccatcagcaactctggtttctagctgtacggagctctccgcaaggattatttttcacttcctttaaaatcttcaaataaaagttggcactcagattggttttacatctcgaatctagctcctagccttcccgactttatcggtcttgcacccatccaccagtctcactggaattcctcgcctgaggaccaagagctgactaaggtcaatatcttgttataaaaaatcctcgatttgaataaaaccggtttgctaggtgaacaagtcactcggcatttcctcaaatgctgactgcctcctataaaagagatgtccaagccaacctttgagtatgaagaccaaactgatcccaatcgtgaagatcccaggtcgttagattacaaaatcatgtgctcgaggttgttcaaggtcttctcttctaggatagttatcgattactcccacaagttgccagttactccatacaatctgcatggaccacacttgcagcaagtagatctaagctctgctgattcctttttgtttactggatttagctaataactacatgcttgcgaattttctattgtgaaataggataaatgcttttcttgtctcgaacccgcatgctgttgttctattaacataacacacggatatggcctacctcctatctttagtcggaaaaactgtctgtgcgagtatatggtatgcatagtctccacggtgcgtctttgcttgatgatactgctgccgcctgccggatatggatttcagcgagccagcgaagcacaggcgctagtgcgtacaagatgaaatcttacgctgacagatattctacacgaatcattactgacccatctgatatgggttctaatataagcctgattgtgagctgacttttttttctgtcttgaggttgaattgcattggaatactgagaattgtgtggctcattaaaataatgtgatctattgacttcaggcataatgcatagatctatgatgacatcttttcctacattttcatataagattgaaaatctaggttgaaacaaattgaagctcaaaacaataattgtgagatgcatggtacaaaattgacgccttccaattgacttatgggcctaatgtaaatgtttgcagagggatgatacacaaaatccttcctcctgtgaatttctctcgcagcttattttcttcatgggttcccttacattttcgtttaactcacattttgctcgcttagttgcatcccttacatttctgtgttatttttttttcgtgtcaacgttttgcaaaggacatagcgctgcgtttcaggaaagggtgttttgattccaaaatgcagagggcgaggcagagcataaacaccctggcaaactactattacgatatactctcagcataaaagttgctgctgcaaggagatcatatcactaaacaacctaaaccatctaattaacaagttgtcaacctgctaagggtgcaaccttagcagagagatcatccgcagaacgtacaaaacatcatgttctctctttcaggagcaagagcaaatccgaccaaggtagaaaaataaatacatatcttaaaatacagatccttaatgttctaatttgacaatttacaaatgaaaaaaggaaaaatgtgaaagtaaatatcacatgttgttatatgtggtttattaatcctcggatgttgattcattcttgcgcaaattaggcacaacccacacgcagttaagtggctctatgacaccatagaaagatggagagtacgtcttcttgttcatatcatagaacaccggctttccatccttcgaatatctaggaaagtatatcctatttccattgccaccatctggcgatgctacaccatatgatgatctgtaatcaagaaacaaggcaccgccaccaatgtcctctacttcaacccatgaaatctctgtacggttaagtttgaacactcgaggcaactcattagcattacgcaagaatacagatatcaactccccatccatatcaaccaaatagcagaactctcttcctatgtggtcttcttcaaagagatccatctctacatggataggctctggcttatcaagaattctccaagtattgcttgttggatcaaagacaccaaggttgcccttcctcccgagacaatagaacttcccatcgaacatgacaggattattgtaccctactgggaacgacacattgtactcgaactcttgctcaatccaatgaggctctccatgctgccatgtaaaagtactgagaaatttaccactgtcactgctgttgattccaaaaaaggcacaatctaaacacattggatttgacgatgagaacgacacaccgttgtagttatataaaaacgcaagcatagggggctccacaatctcctctgtgaaaggatttatgatgaatatatcgttgccatagatcccggctgatgctagtacccaaccatccttggaggagcgaaaaatgtgtcgatcttcatttgtgtcaaatattgtaacttgtatgttgtaattctcactgcgtagaggatcgaacaacttgcatgtcccatcctgctttgagatgtgcattagccaaggccaaacttttgcttgctctattgggttcaacacctcactccatgccttacaaacagttggaaatcgtatgcgatctaccaaggataagtttgagacaattaactctagcaattccacagggaggtgatcccatggccgcagtgaattttcttgtccgtcctctttgtgttcatcaaaatcattgggtggattatcctttgatggctagaaaagaagtaaaaacaagaggtttagttacaatttgctagctagtacaacgtgaataatattttggattgtaacatgctttgcatggatttacaaacctttctccatagaagattattaggaatggttgattcttgtggcattgaaattgattgggtgctgtaattggatattaggaacaattatacatgaatcagtaaagcatggttcgctggaaacaaaaattaactactgcaagcttgaatgctaaaaattagcaatgtgagcatagattggaaataaaattagcgatgcaagcatatattagaaatataactcaccttgccggaatagcccaaaatgctcgggaccaggattttgtaggttgaggaagaatttgatggaagctaatggtcatgtcatccaagcagaacttataaagcctctcactgtcgcagcttgaccatacaagataaacacagtttccttgcaatacaccttctattgaaggacatgagaaggcataagttccagagatgagaaatgcacggtcgttgccaataccctccaccctctcccatgacaatgtctcaagattcaagcaaaacacacggatggcggtgagtaagccgtcatcataaaagcacccgagatcatctatccacaatagaaataactttccacaggactcgatgatatggtaacggccacatctacggctatcttcttcttcgtccttgatggtacccaactgttgtagctcgatcttgccatcaatcacgtctatcgctatgagattagaagcgaaatcataaatctttcctccatagttgcgcataagagatgagaaactgatgtcgtcatacggggacacagatttggtccacatctcatcgccagggtggcagtgaagaaggtagcattcttcttctgcctctgtcgagctggcaactagtattgtgcagttcgcgctctccggagactcgagcatctcgtatgtggataggaacagcggaggctggtgcaacggcggcaactgaatcttggtccgcgggttggtggtgatgcggaggaggaagcagtcggcggtagactcgtccagcatcagcagccagtcgccgtgcatgcagcccaagcacgtcttccctcgaacctcaggaacaacggtctcgtgcaggctgaggtctgacacatcgacgaaagtcagcgtgtcgccgcgtgatccctgcaccagccatggcctcgtgccgaagcccggcggcagcgaattgtcgtcggatttcgcggccatatgtgtttgtttttctggttttcttttactctccaggtgtattgatccttctgtcttggtggttggctggttgcgttttatgcagcagggagccaagagatctagcaatcgctagtccctttcagtttcaggaatcagagtcgtggtctatcgtgattgcgctttatacagcagggatttcgctcgatctggaaacggatttgattcagaaatccgagttggtttcgtccgtttgctgatcagaagcgtgtgctggccggaggctttgatcgggcgctgggactgggtgggacggcggctgacgtccacgtcgccgcctcagatcgcaaaggcctctcccgcgtcgctgccgccggattactgcctctgccgcgagccttgagctgtctcgtttgggagtccgaattgaagtagaattgtaccctctctttttttttttgtctatagatcgactgaatcggagtccaatcaggatttgtacacaaaatttgactgcttaaatttgagtatggtaattccccctcctatctaattgtccgatcagaattgtacctcttttgcctagcaaactttattactgcatctgaatccaatcagtatttgtgcacaagatttggctaggcttatttttctacaaagtagtgctgctctaagttttgctcgcggctgggcgccgacgtcgcgatcggaagagctagcgcggtcgtgcactgtgtccttcgtatgtttgcctctcaggtgtattctactttggactcctgttcggttcgataataagctataagcagaagaaatccttaagaaaaaaggataaaacaaacagaagatattaggagaatacacggttgatccctcggatataggagtatttgccttcgacgttcattggcaagctcgagattgggagtctatcgtgtgctaaaagtcctatggagtgcaacaacggaggaaaatattgctatgcggtggaaaccacgtatatgtagtgaaaacttagaaactaccgttggatcgaaaaatggacggccgagattcatccacgttattttacctgtgatgacgtggacaaatctcgtacgtctatttttcaatccaacagtactttccaaatttccaccacatatttccctgaacaacggtgttgcaggtgaagagtcctcgttgtcacgtggctaattcggcacgaggaatttggcccaggaaaggtttttccttcttttctaaaacgttattcttttttttcctactatacagttcaagaaatgcacagaataaaccaatttttttgaaaatttatatacaaataggttatatagatatcatactatttatattattttatttgatttttccttttttataaattctaatttgaatttggatgaaacctatcgaaattccaaacggcttctcttttgagccacgtcgaaacctcggttttccgtggaattcaaccagtttttgtcggaattgtgaaccctactctgaactcccgaagcctgctgctggactcccgagtcccaatgcccactacccctccttgcacgcccgacatctggtttcacccttcacgatgccgatcaacgttcgacgcccctccgccgctgcgatgactactcaactaaggttgtgttcttcccccagttttcccgactcatctctcgttttctgcacgcacgattttcaaactgctaaacggtgtgttttttgcaaaataaatttctatacgaagttgttttagaaaaatcatattaatccattttagtacttaattaatcatgtaataataagtgttttgttttccgtgccggggtcctgctgaacatagcctaagggcacccacaatggttatctataggctctctacaagagatccatgtcagcatattttcctacttggaaggtattaaatgaagagagagagcaaagctatctactaacttagagatagtctatagagaaaaacgaggcaatgcatgagagagctatagataccaatgtagacatactattaaggtggtttactattaatcaagtctattgctgagatgtacatgttttatagatagcaccttactttaccattgcgggtgctctaagagcaagtataatagtgagctataagcctactataagtttaggtggaggagagagatagtgaaaaatcaaaggtgttgactctcatgcaagagctagattatcacaaacttcaagacaaatacattaaatgtataagtgaaaaataaaaagaagagaagaaaattatagccaaccttatagctaatctattatatattatatatgttgacttttaagataagctaataataggaaagtgagctaagcaatcatctatcttgtgggctgtgtccatataacaagccgctgttgtcgcgcctaataatcagcagctcgccatgcatctctcccttctccctattggctctcgcagtcacatcttagagcaggtacaatagcaggctattagccagctataaatatattttaatgagataaacgatgagagagaagagcagcgggctacagatttgtagccagctgcagcacgggcttcaagacgcaatatgtatatgacaggtgggaccatatattaaagtatagtaagcaactattgtatgaattggctattagattgactatagatgaattggagctagtagtgggctatactattgaacttgctcttatagctcggcaccttgcagtccgaaatgactatttagcgactatatatataggacgtccgaatgggactccatggagtatgggctccaaagttgagatccgttggatgtagctggtcagtttgatcatttgagtgtatgagcttaatgggtatagacctgtttagagtgcgggatttaatagtgaatggattccatatatttgaatagattaaaaaaatgaattaatacatttatatgcatgcatgcagtgcggatgagagaatttccataattgtgtgtgcatttcaaaaatagaaacattaaatgctcatgaaattggaaataatatcttgtatggaaacttacgtgattgcacggtgaggtttgaataaatggtaatataatggtgaaaaatggaaactaagtatatggagaaatggactttttttaaaaaaaaaactaggtatgtaatactaaatactgatcattcgtatttggaaacatggaaactaattatttggaaatatatttggaaacatggatactatatattgcagcgcatttatatggtaatgtaactgtacctaatcattacattcatgacaccattaatttagctatttgagtcacaaaatatttaagtttagggtttagagtttagggtttaaggtttccggttgcctaaatccgaatccaaataaaacagcggtttgattcatccctacaacttataattcaaatcaaacaagaaaatccaaatagattttttggcaaccactttctgcattgatgcaatccatcagatcacacacattcatagttcatactgcatttatagttcacacacattcatccatcatatcatactgcatcacacacacatttttttgctgttcttaagtaaaaaccaatggttgatcatttgcaaaatcagaacaaggtgaaaaggcagaaaggggatggatggattgcaatcacgtactccctccgtcccaaaaaaaagacaaaccctagtttccgtgtccaatgtttgaccgtctgtcttatttgaaaaaataatgaaaaaaattaaaaagagaagtcacgtacaaagtattaatcatgttttatcatctaacaacaataaaaatacgaattataaaaaaaattcatataagacggacagtcaaagttggacacgtaaactcagggtttgcctttttttgggacggagggagtacgtagttaacgcacacgtctcctccactgccgccatagtcccttggccacccggctctatcgccgtcccctcccttggccaccgccgccaacccaccccgaccagatctacacggcaccggtgggagcctgatggagagggagaggaagaggtcgcccgtgggtagattgcccaccgcctcccttggccaccgttgccaccgccaacccaactaccccctccccagatttggctgcccccagtgagaccaacggagagggagaggaagagggggtcggatctgcgcctccccgtcacccgtggggaggtcaccggtcgcatgcgtcactgctcgccgaagggaaatggccgcctggctaggagaggggtggagggggagggaagtgcaacccgcccggctagaaaaggggggtcggaggggaaggaaagtagccgcccggctggctgggagaggggtcgaagaggaaggaaagtgggtaaaggggctgcaggtatgggggaggaaacagccgtctgagagagggcaaggggccgccgactgaagaggaaggaaaagaggaaggtggtggctggatggatcgagatcgatccttatctcctcacatgggccccgctagcttgatccgattggctcgttttgttgccggctcggctcgactattaggcgtcggttttttaagaaaaccggtacctgtaatatattattggtgtcggttattctttttaaaacatgtaccaatagtattggtgtcggttttttcttaaaaccgacacctatagttgtttaaaggtgttggttctttattttttaaaccgtgggaggtgggaaaaggttaataggtgtcggttttaaataaaccggtcctatgagggtttttgtagtagtgtttcatccaagttacctcttttttacataggtataataaagtcttcacatactttcttggactgccacaaatgttggatgctcgccggagacacctagttggctaggaggatgacctccaagattatcagctcaatgacgaagattggatgttgatccccaaatgctcaagatcaaaccctagatctcataagcacaaatccccaaacttcattcaaatttcacaagtgtagcactagatcctatgtgggttgagtgaaacaaccctagaaatgaataatatttgaaattaaactgttgaagtttttttttctcaggatttaaaaaataaaccgtcaccgcagttcgacagtgcgaaatcacgacgaaatagcaagactaacgcgcgatactgacgaaagcgtgatgaaactagcaaggcgaaaatgtgagacgaccggcctcggtgtcgctatttggctgagcgagaggactattgagcctcaggtctcgcttgtggcccagcgagatggccacactggctgctaataacgcaattaatcgtactaaatagtgagattaactaattactaatgatattaattaaagaaaattaattaatgaaagtaattggtgactccgctaatctcatgcatgaagcctgtcggcgcgaactcaccgaattttttttgggactgtctatgtaacaagcagctgaaaattttgggtttgtcagccgtttttttggctgaccgtgcgatccgcgcatagatgagcgatgcacgtgaaaaaaaaagtagcgtgactcgtgactctgtttctgttttttttgttgggccatagcccacctctttttgtgaagaaacaaaaggcccatcacaatttgtacacaaaaatacaacaaaaagcccactaagttcacatagcccatagcccgcaacacaccacatgagaaaaggaagtccactggttcgcgtgaccagagcccagagcccacatcccatcacgggaaaaaaaagcccaaatacaaagaaatcatgtacagcacgcaatgtcacctcaccaatcctgcgtgcctgccaaaaatagaaaaaatcgatcaacaacatcagcacaaagaattggtagtgtgtaaaaaaagattaaaatataacagtgaactaaaatggagaaggtaacattgaaccagtgtgtggcatacatgttcaatcctatgtaacaagagcttgccaagtcaatgagcttagctgaacttgacaaaaaatttctaacaaaagaaacacaaaacatgtactactagttggaatttggaattgtcgtttctcaaagtattttaaagctgaatacacagttacacttgccttttggttgcattgtcggccatggcccctatgctcctctttctctgaactcctactgagaaaaacaaatcagaaacttgagcaagaaagcggcacaaattggggaatggttccgagaaaggagatacagcagcaggaagtttgaggcgtacctggccgaggtggtggaggaggcccttgaggaggatggaggcgactacaatgaggacacagacggctgccatgacagggataaaaaactgtagatctttagattaaaatttgaggaaaatttgattttatagttgctatcatttagatagcacaccagcttgattaatatgtaggaaaattttaaaatctgacaaagacaaagacaaagacaaaatacaaacacaaatatgacaaaattttaaaattgtgagatgctgacaaaatatatataaaaaaatgacaaaatgcttaaaaatccgttcgccgccatcgatagcatcatggccacgtcgacgctagttactattatgaagatagagcattaatttgattaatatgtaggaaaattataaaagttgacaaagacaaatatgatagacaaaaacaaaataacaaaggaaaaacctacaaaattgacaaaactacatctacatatatatgaatgtgggtaatgatagaaagtcttataatatgtaacggatgaagtagctaacaaaattgacagaattaggtactgttagtagcataattagttttattgctggtaaaactaaataatgtaagtatatgacaaaaaaaaacttagaaaatttactactgatagaaattttaattcaaaactattttagtagaaattgtacttaattgaaccagagtaaataatctttcgtaaaatgtcaattaattgcaaatctaagacttaattgaactactcatcacaaaaactaaatgattgaaatttactttaaaaaactactcatttatagtgagaacaaaacaatttctctaatagtttcccccacatctggcaaagagtaattactagaagaaggaggccaaaaatacacacactagtatacaaactcgcacgctcaatagttgagagtcagaatttctccaaggataatgaaaaaagaagacaattttcctcatgtcaataaggagaagctggagcacatgattgtaccagctaaacactacactgctcagtgagccatctcctccctggcatatggtgggcaccccctaacactacttttgcgtgaagaaaagcaaagctttgcaaatcaaagagtacttcctagctagagagtctcctctcctctcctcctcgaccataaaaaagtaggtactcaggatcacatatctatgtaataacaaaacaaaatgcggttaaatagtagtatcagactagttgctcttacagtagcatgctaagaaaacttgctactcagatatggagtcactaagctctccttgtgaaaaaacataatgtattacaaaacttcaaaagttctgaagatttatgtaggtttgcgaagttctcttaacagaaagcatatatagatcaatacgtgtctatcaaaatttataagaaaaatccacaattattccttaaatctaatccaaaataaaacaaacaagccaccatcaattccagctgcataatcatgcactgcctccaccaccaattcccgactccaacttcttgcttttcatctacaactactgctattcactgaaaacataattctacccccctatacataagaccttttagctttggataactaaattgataacaatgcaagaaatatggatctacatggccacaaaatttttagaaatgcaaaatattattcacatattgaaccagatcagggcaccaaaaaaccagctatctgaaaaggcacacatatcataaaaactttctactcctccatggctccatccgttcatctactaccaaaattacaataaattgtttctagacaaaatatgcaacatattcaaaatagggaacaaatacaaaaatcatatagcatcgtgctaaaggtaagctcaccgtgtggagctgtgtggccttcgagttgctcgctgggtgagccattgcaggattccatgccgagatccaacagattggtcctattcggctctcctagtgacacaggaagcgttgaggctccatcgccattcccgacaaaaagctttgtagaaacacgctgacgaccatcggagctgtcgagattgcctcccctaccgccatccctgcctcgcagataagcgcaaccgcaggcggcgcgcgcgtccgttggagccgacaccaagctctagagctccacccgccggaggagacgacgatagcatcacacccacgatgcggcatcgccgccggtgagtacccccgcgttatccaatccccactctctctctgctcttcttgcgtgagtgaatgaggaaaaaaaatcgagtctgagtttcgcatggggtccacggtgaagacatgcaacgagccagtgagagcgacgggtccagcgcccggatgaatgtgtgggcctaaaactcctagcacgaatcttggaaacaaatccaacgccctcaaattcagctgatagaacaaaaattctcagcaggcagttgtctagcaattcccattttttatttataataataattaataatatttaaattaaataactagtactccatccatactcataaaggaagtcatttaggacaaagtttaagtcaaaccttgggaatataaatcatgaatctcaaattgttgagtttgaaaatgtaaaaattatatgaatagatttgtcttgaaaaatactttcataaaagtatgcatatatcattttacaataaatatttttatagaaacaagaagtcaaaattgcgttttggataccgtgtcgctatccaaaacgacttcctttacgagtacggagagagtaattctgtgggagaattaaccaaaatagaatggacgttgtttctaacagcgtccagagatggacactctttcaaacagtgtccagatctggatactagtagaaacagcgtccaccttccaggtgcagccagaccatcaatacgccaccaataagttaagagaagtattgaaacaagagttgttcgacctaactagggttagggatcaccgccgtcgtcgcatgcgcctgttcgccttcgatcgggggctgtaatccgtacgcttcaccctgcaaaccacatcgtcgctgtcaacgccggcgccttggatttgtccgttactcagcgccatcaatccagccacggcgtcttcagcgcggcaagttcgttttggctgctcgctggcaacaggtgaactgcaagagacatgtatgtctttcacattgatctgcatatgtctttcggtgggaggcaacaggtgcccatgcatacgtttaactaataattagcattgatcagctgctgtatacattgtgttcatacgtactttatatatcgtcaggctcaggtgcaccctgaccgtagcctgaggccgtcagcgtgctgcggttcgtggcgccgctgccgagcctcccggcaaagatgttagtttacacccaaatttagcatctatgaacgaaataggggaaaattgccaaagtttgaaaagtatctggttttcttcacaggaccggtcagaccgcaggtatgtgggcggtcagaccggctagtagggccggtcagaccgcaggtatgtggacggtcagactgttagggcctgagttcaagtttgttttcgtcgggtctcgggtttccttgctcaggaaggcatgttttgtgtttcctttagtttctatctcgagttggacgtggagaaggacctgtagagggcaagaccaacccctatttaaaggacaagaccggttcattgtaataccccgaatacaatatacttgaatcgttcttttaccatgttttctactttaccctagttttagtccatctttgtcgatttgcgctgtaaatcgtccgctgcagctacgagagtgcgacacctctttgtaggtttgtcctgaaaaccttccgttttgcctatgagactggtagttatcctcatatcgatctaaatcggcctagaggctgattttgatctctaaatcggctccgctagccggtttagctattttttctacaaaacccatcttgatttggctgtttggctagatcgaggtggttggcgactccatatcaccgcaagacgtttaggtgttgtgatcgtacttgtcaacttgtcaaaaaaattgccaacagatgccggtggcgagttcaggctgccggtgtccacagcgccggcggccagcagcattgatacctccacaggcgctacgatttccatggccgctgcaggccggctcaccgcatcagctactgtccaggtagctcgttcatattgatgaaatggcaaaccatggatgcaaatctcaatcgaattcactggtggataaaccatctttggtcggtccggcaaaatccacaatagtcccgaatccaaatagaaccgggagtaaagattatttttagtcctggttataaaaattttgatctttagtcccggttggtaacatggttcatcccctgtcagatgtatgtcagggggccgaggatctttagtcccggttggtgtaaataatcgggactaaagatcaccactttagtcacggttggtactaccaaccgggactaaagatcaagatgtaccaaccgggactaaaattaaacacatagtatataatccatatcccttatcctctcctccacagttacaacttaacagatcgaatctcaccccctctcctcatatctatcctctaactctccaactcctccccttcctcctctcctcccccttctctccccttcctcctccccttcccggccggcctccccttcccatccggcaggccggccgacggcggggccgcgcactacggcggcgggcggcggggccgcgcggcggcggtgggcgtggcggccgcagcggcggcgggcggtgggcggcggggctacgcccggcgaccggcagccggcggccagtggggccgcgcccgtagttcgtggcgaccggcgggcggcagcggcattctttttttttttaatttgtgatgattcactgagatgtatttgactgagaagttacaaatttgtgattcattgtttggatctgtgatgtatttgagtaatttcttaggatattgtgatgtatttgatttgtgatgtatttatttgtgtgtataagtaactttgatttgtgatatagatttgagatgttacttcgatttgtggattgggggtttgatttgggatatgtatcccacttgatttgggagaaaataaaaaagaaaaaaaaagaaaaaagggatcctctcactgccgcaaccctctctttagtcccggttggtactctctttaaacaccaaccgggactaaagattgatttttagtcccggttatttgaaccgggactaaagataacgatctttagtcccagattcgtagtcccggttggaaaaccgggactaaggggggttacgaaccgggactaaaaagcatttctccaccagtgattagcttattattcagttgtctcgaatctcgatgaatgcgtttgagtattagagatccagagttgtcttgggctcttggccgatgcgaaatttgaactcgaaggaatagttggataaaaacgtctgaatagaacgtactgaaaaatgagtttattccaggtgattaataccatatcatgagttggcaatgctgaaaatcttgtcatgttcttcggatattctgaattcagcatccgttcacctagttcgtgttacaaagctgcaaccatcgtgtaatcaacatgttttgtgtctgaatttctgtcatcaagtttcgatcgagatggaacacgagctgctagtgtcgtcgttgccgccggtagaatgaattagccgccagcgccgtacgtgggcgcgctcggatgacattcgcacggatcggacgcacggcggcctccagccgtccagcgccggcagtgccagctggatatcctccatccgccgccccacgtccccgctccctgccgcccgtcggtcgttgcgcctggagagagagagagaggaggggaaagagataaaaagaggggagatgagagagagagaggaggaagagaagagtgagaatgacatgtgaggcacacatgggcccccaccatttttaaattattcattttaagtataattggcatgtgggcctacgatttctattatttccaaatcaaattgccccactatttttaaattattctttttagtataattgacatgtgggcccacgatttctattatttccaaatcaaattgtcacataagcgtcatgtcaatgccacgtcagatgatgaccgagtcaaattagccacgtagacgccacatcagctgaaaccgacgtccaaactgtatactttgttttaaactgatttttatagttgatggacccattgtatttggtttttcagttaaagaacgaaaatcaaatcggatttgttgagaagttaaaaaggacctgagatgaacttaactctttgaaatacgttgaatgagctagcctggcctggcaggctctaactgcgcgaattccctcctctgatgggccacatggcgagtcaggtcccatccaagtcagtccggaccgggtacacgcagcccagcccgtatggcccgacgagagctcgcagttcaggacgtcatcggcgagaaaccctttcccccacacacacacaagccacccagagaagcagagctcgacgacgccgccgccgccgccaccgccctcctccagactccagtcctccccccgtcctccatcctcgtccgtctgaggtcagatctgatctccagcgatcagggcgtttccatagcaccttatatctgattgaatcggaagcgtaggactgaaaccctgaacactatgcttttgttttgcagcggagcaatggcgggaggcgacgcgccgcagcataagccaatcgagtgcccgaaatgccacggggtgttcaacacccggcgcgagttcgtgaatcataagtgctccaacactcgtctattcatgctcgcccaggccaagaaggccgctaagaaagcagtcctgaagcaggtaaaccatcccccaccctaaatcccctctcctatccaaacggtctttactgcccctccaaatcgtctgacgattaagatgtccaatcgatcgatgaaacaatttgcgatctaacgttgtgaactatggatgctggcatccacctgcatttacaaccccctttcatgcattttattaacttgctgtaagcatcatggaggctattactgtaacatagatcggccgtcgattggattctttatatattcgcttgaatgcagcaataataagtaaatagttataacattgaagatttgaagctgtcacataaacattatactacccgtgatgtcaaataaacattataatacccgtgatgtcaaaaatcaaaaagcattactttttcaagcaattaggatcctgaatttattgtgtacaccgagtttggattgggatcgaatggaactggaaggattcatctgcatttcaaatcaacctgcctgcatgtttgtactttgcactttagatatatgtgttggaagaaatgtttcggaaatgtgtatagaatatacaatgaaaatgtatggtagtgatatactggttacacgacagggatttgatgatacttgtgagatagtgatataccgattacactaaagggattttcggttcataaaatcccttgtgcttttgcactttacttgaatttgatttgcgtaaggatatgtttacatggaatgtgtaattgaggtttagtcaatgaagtttacagatcttgttctggttgggtagagaaaaggcaacactggaatatttattacaactaaaattgtaaggggcgctttctttcatggtagttcattgtggtaatttgcaaggatactcattgtacactaaattactaaataatacataaactgcaacatgtttcaatagataaaatgtactccctccggtttcattgtaattgacgttttggacaatgacacggtctacaagatatatctttgaccttattcttctattataatacatataataaataaatgcatgtttacttttattatagtactttaaaagacaaatctatatgttgttctagttcctttaaactaaatatttttaaagttattgatggtcaaagttataaaagtttgacctcaaccttgtccaaaacatcaattaatatggaaccggcgggagtagtggtacagcaaaaagacttccaacaatatatctgagtgggtgatttgcgcatgaaatggttaagtctctactactcaagtataaaacagttaggttagggaaaagtgttatacatattttatgttccttcttttacacacgaattaaggcttcaatatatacctgttgttatgcagccttcacagcttgtttttcttctccctcttcatctgtattgttattcctgaagcagaaatagacatgtatttattcaattagttgaattcgtgcaaagcatcaacatacctaccagaagaatgttgcattagctacaaagtcattctcatattgagcaatttcaaaaaaggagaatttaaaacacacacataatggtttccttactaaaaggaatgcttgtatccctaggtgtggttttacaccatgcagcaatgagaacgatgcattcatgtggattaaatataatttgcaaagaagaaacagagaatagcaataaactatctgcaatgacaccataggtcaaaatatccattgatgtgggcaataaactttagtatctgtgcatcttaaggttccgttgtgattttgagacaacatacttgcttaatattattctgattttttttgtttgaacagatccgcaacaagggcaacaagtttaactaaggtggtctacgtaaagagaagttctgatgataaggtattgttcttttctgattctgtgttttggatttttgtttgcacactacccaagctcctaaacagtgtgtttcgtgcaaaaagaatatatgtgtgatctaaaattttgttatataatttaataaagtaacttttgaactttatagtagttaatccattcatttatatcttcaaaaggctatcacataaatgacaagttctttaaataattgtctagtacttactgatggtattagtgtttactgatatatatttttatgacagatggaaaaatgcaagggtatctgaaagataactggacctgaaacgttaccttgtttgagagtatatgtgaacttctattatatatgtacctcttacttctattatataacctcctatgattttggggatttagatgggaatcatgacagtctgttttgtttggttcccttgcccaccattatagcattgctatccttttctacgattagtaatggtctgttttctttgcatgattcgatttttatcaaagactgagatcacttagtctatccagcaagtttaaaaggctggcactgctagcataagaaaacaatttgcatgcttttgacagggtcccaaagtagacctcctatcctagtagaggttttcgttgcccaaaccggtacaatgcctaatctttgagcttacaaaatcagaaaaacccaaattatctaacaaaaaccagaaactgaccagatgttgtatcacctggatttttttttaatataaatggcgcctattgcggtggtgagtacactaaggatattgatgggctacaactttcgaagttttcatggcatagcgtgtccaagtccaaccattaacgcaatacagatagtcgaggcaaacgatacagagatgatgagctgcaaatacgtacctgtgattggaaatgggtacttgaaatggcaacaggaaagattgggttaagaacatgtattgaatgaataactttgtccaaggcttgcagaggcgatatgtctctccactccagtgggtaactgggtatagcactcatctcgtttacttcacactcccctatagactattcaccttcaagcgatatatcataattgatttattaaaccaagtagaagaagcaagaccacaacaggcaaataaccagtagcaaaatcattttcaccatgtgctcggaacgctgtagtgattctaatcgttctagtagaagaagatccgagtagaagaggcaataggagaaaaaccagtagcataatcatatatatttccccatgtgctccgaatgcttgtggacgatctgggcaacacaaagaaaatacaaagtgggcaaatcaatggcaacacaaagaaaatacagactggacaaatcgaagcctacaaacgaattcattctttccgtataaactcgtacactgctaccagatcaggtagcacctgacaaaaatttcatagataattgtatcaccagcgtctgaatcctcaccatgcaaattcaagtgacggatcaaccaccaaataatcaggtcggtggcatctcgcatctctcggtcatccagagatcaaaagaaggacctagctcaagctcgtgctcctcgtcctgtctcagagaaacccaaacaccgccacgacgccgcggtcctcaagctcgtgctccccgtcatgtctcagagaaacccaaactccgccacgatgcgatgacagcttacgtgaaagagcgatatgacgaaatagaaacagcggtatgtcagatcctgtcagatctgaaaagctaccggtagaaacaagtatattggctaagtggctaacctcgttctgatgagaaaacccgcaaagacctcatcgccggaggataacctcgccggcatcggagctatttgccccctatatagcgacgctcgcgatgtgccggaccccttccggctgaacacaggtggcatcagccacggcggcgccatgatttcagccgacgaagttcggcggcgaaccataaccttcgcctttcctgacagaaaagggacgacgctagactaaagcctcggcttccttcgtccgtgcgccgacaaaggaggcgacggagcccggccccaggcagctcaagcctcgccggatagtgccagatctgtgcggcggcgccgtcgttgagaacgggaggttagggttggggaatcgattttggagataagagataaggatgggtgccaactatagaagtaactaattacagggagaggggtagacgaggctttctcacgtatagagagagaaaccgcatgcgaggcgttggaataggaataggaaccgccggtccggtgcgtcacgcgttttttttttcgttttcttttcctttcaatttatttatttattattatattacttgcaacaccgggtgcgtgtccagatctagcattggaaaaaagaaagggaatattaaaagttgtaccgtgcgaatattaaaagtcccatctcatcagtataaaggggaaatacacatactgtactaccgaaaaggccccagctcacacatggaataaaacaggttgacctaggggtaagctagtaaatttaagtgaagtaagcttgcttgctacagagcggccgcatggctgtcggtggctcactggctcggtggccgcaggaccactcgctcaacactcatcttttttaagctgtgagtgacatcacgtctagtagagggagtttggatccatcgctggtcctcgacatatcagatatttgatataaagtattaaacatcgactacttatataaaaactaattatataaaagagagctaattcatgagataattttttaagcctaattaatccataattagtacatatttactgtagcatcacataaaccaatcatggattaattaggctcaatagattcgtctcgcgaattagaccagggtatggaataggttttgttattaatctatgtttaatacatttaattaatgtccaaacatccgatgtgatagggattaaaaaattttagccccatctaaacagcccctaagagcaagtttaataatatagtccactatactagctctaaaatttaaaacatcatatatataatcaatctaatagctcgcttatataatagttagctgtagaaatattgggagtacgtcattaatgcataagggcatccacaatgtactttaaaaccagtccatagtcaataaaataatacattcagctacctaaccacattgaggaagtagtccataggagagaaatagcaaaagtcatccataagcatatgggctgcccatatagaataaaatatgtcatttgtctctatttcctctctcctcctcctactacttactaactatatacattgtgaatgttgcaatagttaaagtccacaaatataggtcccatctatatggactactttagctatatacattggtgttgccctaacctacccatctctctcacataggagtagtttattggaactcgtgctgcagctggctacgaatctatactagcccgcttttgttatctctcctccacacaagcacaaatctgatgtgtcaacttctatagcatgcttatgttaccttattgtactcgctctatattttaaaatgtacgacaccattgactttttgacccgcgtttaatcattcgtcttattcaaaaattttgtacaaatataaaaatatttatgtcatgcttaaagaaaatttaaggataaatcaggtcacaataaaataaatgataattacataaattttcttgaataagacgaatagtcaaacgttcatcaaaaagtcaatggcgtcatatattaaaatacggggggattagtaacttttaatatatttttaatactcaagctaagagtaaaaattataatagttattaacaacaaataaaattgatttttcaaactatgtttggagataaataaatttagtagacgttatacgagattgtagatgaaatatgatatcccgcactttgattatatatatgaatatatgttactccctgtcacaccctgaagttctccccccaagcctaaattgaatttataaatggtcccaagaaaatatcggtgtaaaagcgagagtaaaccctaatagatcaatgcaaataataatcggaattggcatgtggaatttttcttgagttctacatgtcgaaatttgctaacaagatttttagtgaaattttcagagccctagaaataattttaaccaattaaaatcgagcacatgcaattttaaatcccaggaaaaatcctttcttccttttctttttcttttccctcctttttcctcttcttgggccgtcggcccagtccgcccgccgccgcgcgcgcccttttcctccttgtgggtcggcccaagccgcccctccctctctctccgggacgccgacaggtgggccccacctgtcagggtcgtccccttcctccggccgcccgccccacgtcggcaaccgccgccgaaaccgccgcgcccacctcctccgcttctcccgcgcccacgccgcgccgccccgcgtcctccccacgtcgccgccctctttccccccccccccccgagtctcccgggccgcgcgcgcgctcgcaaggggcgggattcgcattttgaattccccccattctctctctctctcctccccacgtcactggcggaatcggaggccttcccggccacgttctcctctctcgagcctataaaatcgcttccccgagcctcctcttcccctttccgctctcgccgctccctcccgtgcttcctaccgagctcgcgccgctcgccgcccgcgccgccgcttgccaccgcactccggccgcgtgccgccgccgcgctaagccgccgccaccactagcttcgccgccgcaagatctttctcggccgccaccttgcgtcgccggaatcccaccgagaccccatttcccttgcgtcgccggtgagttccctctcccctccgactccggccggcatggatggccgccgtggggtttttcctccgccctaattcctctcctctcctcccctaggtgtcgccgtcgctcgtccgcacctcggcatcgccggtcttcgccgcctccctcgttttccgccgccggtcgtcgccgccccctccggtgaggactccctcacccttcctttccttccccttcccgcacgcgccgtcgctttaggccgcgccgctgcttcggctgtgcgccgccgccggtcgccgccggtggtcgtgcgcgccgccgcctctagccatggccggccggccggctttgaagccgagccgagcccggcggttgctccctgcaccgtccgatcggcccgaggccaatccggaccgtcggtcccgtggaccggcggtggaccacccgcgtcgtcccggtccacggtggaccggccgctttgtgccgctgatccatggggcccacgtgccagcgccccctccctctccccttgcgccgctgacatgcgggccccgcatgtcggcgctgcccgctccctttgatgacgtcagccctgggcatttattgcgcaataattcaattaaggatttttctgtttatagtaaaaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgtattgtttgctttgtatgtcgcttagattccggctcttccgacgctccggtgtacttcgagatagtcgccgaggttcctccagcagtagagcaaggcaagtcatggctgttacttgaacatgttgatcctatattgcaaatgttctaatgtttttcttcaaatactgcattgttttacaataatactatgggatgtttacctactgttacagccatgctattttggtaccatgctcctttgttagcttgggttataacatgactagacattggactagggattgcttagccatgcttagttcaactagcacacaatggggaaaatcctattaatgtatggactgtaggttctaatggtaatgttggattggtgccaccgcttcggtgttggttaattaaaataaatcacatggtgggctgtgggtgcatggttttgttggtcgcgcccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagtttggatgggccctgcgacggcctatgcggcttccggattcacctaggtacgagagaggactgtccgctgccttgcgaggagtggggggtgaaaccttaggtgtggtgtgcttggttagagggggttatgcgacgggtcctgtcacggcctctttccggtatgtcgtggtggcatgccggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtctaatgaaattggatagtataggtggatggttgggcctgttgcaacgtggtatagcgttggacagtggatgattaatattgattaattgttacaactgttttacttctctgaatttctgtttataaatgcccgttttatgcaaatgaaccgttatagctatcccttgataattccctgcatcataccccttttccggtatgacttgctgagtatagtggttagtactcagtcttgctctattttccccaaaccccagaatttgagtatgcgtcatatggtgatttctccgaggagtaggcttcgtccgtgccgtcgaggatgcctgtggagtggtgttcccgctgcagatcaagtcaaggcttagctccagttatcttttgtttttccgctgcatttatgtaagacttttataatgtttgtaagacgtggatctgtatatcaactttgtcgtttgtgtaccccggcctgtcctggatggggattttaatgcacattctgcttggaattctattcgggaatttctgagcgtgacactccctctgtcccaaaatataacaactcttagcccttcggatttgtcccaaaatataacaacttctccaccaacattctcttcccaaccaatcacaaccctccaccattcacttttctcacctacctccgctacttatccaatctcaaccctccaccatttacttctacctactttcttaataaccgtgtccaacaataaaacttcttatattctgggattgagggagtaagtatcataaaaatgaaggtagatgattatatattgatttgtataattcaatgaattgtaaatggtgttgtatgcttggatgagttttgtatgtaactattgctagtagatgagatgatatgtttgcacgttaagctttagaattagtgggttgtaactttataaatagtatagattgtggaggcaagtagagtagtagaagaagaggaaaggggcatattagtcctaaaaatcttcagccttgttaggttgagatgatttttgtaagaaaaaaatgtttcattagttcatttgaatgtgttgtaggctaagggagtgtttggatccaggactaaactttagtccctgtcacatcggatgtttggacataaatgagagctaattcatgtgacaatttttttaagcctaattaatccataattagcacatatttattgtagcatcacataggctaatcatggataaatgatgctcaatagattcgtctcgcgaattcgttcaaggttatggaatgggttttatcaatagtctaagcttaatacttctaattagtgtccaaacattcgatgtgacagggactaacaatttttagtcccatccaaatagctcctaaagattatcaccgatgtataaaacgagacaagttgttggcatatgattaattgagtattaactataataaacttaaagaatgtatttatttgattttttaagcctaattaatctataattaacacatatttattgtagcatcacataggctaatcatggattaattatgctcaatagattcgtctcgcgaattagttcaaggttatggaatgggttttatcagtaatctacgtttaatacttctaattagtgtccaaacattcgatgtgacagggactaacaatttttagtcccatccaaataacccctaaagattatcaccgatgtataaaacgagacaagttgttggcgtatgattaattgagtattaactataataaacttaaagaatgtatttatttgattttttaagtaacttttatacaaaaactttttgcacggaacatatcgtttgacagtttagaaacgtgataaaagaaaaacgatgaagatgccagaaaacaaacagcacattcaaactacccaaagtatagaataagtaataagaggtacaaagtctaaattgttctctatatagtggtggttcggtttacacctaaagtataaatccaggcatcatacccctttaaattctaaaattattttccaaaatataatgcaagccgaccgccgctgccctcctccctcatctacgctaacaaagacggcggcagggggctccttctccccctatgatgcagctatggttgggcaccaaggcaacctggatggtggtggtcgcgctgctcagatcctaacctccacgatcagattcggtgaggccagcgagcggcgcgccaacgatgtaggcgacagccggctgcaggcagctgtgggcgacggccaactacaggtgtggtgatggaggcggcagctgggtgacctcctgtgggggtgatggagatggtcatgaggcagggaagcgacaacggtgtggatcaggcgtcatgtggccaaattcagcgaagggagaactagtggcgtcccagacggtagtagatggaggtggggaggtggcggcaaggtggatctagcgtcccatggccaaatccgttggatctggtgagcgcgggccagctggcgtcccgtacgcgaacgttggcgcgagctgtccacatgtggtggcgatgacgcgagcagcgaggctttggcgcgagctccacgcaaccagaggtgtcgtggtgacaaggagctgacggtggggtttaggcgtaggcaaagctgcggtagttgagtgcgtgagcttgctacctttggcggtgtgcggggagatggtgacgacgatgtatggtcggctcgccggaggtcattgggctgccaaacttcgacacaaccgagagccgaggtgacggctctcgtgctggtcggttggcggtggggcgtcggtacgatggacacatgacgaaggtgttcaaaggatggcggctgacggagacaatggggatgcgacgcgttgtgagggtaggatgtgctttcggacgaaaactcggcctggtttccatgtcgacaacaacaatgtttcgaacaccgtttccccgttggtggcgttttcgtggcatcctcccctccttagtggaatccttcggtgaaaaaccaaaggcggtggcatctttggcgtggtgacctccttggaggcgtcgatttaaagttgcatttcctcctaaatctcttctacatgcgctttgtacttttgcagtgacacttgtatccagtacaagttggccacatccacagcactgtgcgggggaaagcagatcctttttctgtcgacctctctccctccaatccaaagacgtgaatggagatgagtgtgttcaggatgtcatactcttgtctgctagtcagtaaggtcttttgttgtaggcgcgtggtgtgacttggttttctttttccttgaccatagccttccagggttgtggtttgtaattttttttcctaccatatcatataaaacctcatactatcttatgttttttattaaatcttatgcaacatgatttggatggaagaaatattaacaaaagaaaacagtaagtttgggacattgcaacgttcaataataataatccctccatcccattttgatcatcccctaaagtttttgaggttttcccaaaaacaacatcatctaaatgtgcaatgagtaaatgtgcatcattgaatgtgtggtatgcaaccaatcaagattacttttcattggtgcaatatttaaaacatgagcagtccacgagacacgaagcgatgaagcatcataactgatgaggattaatttgagaatgctgaaaattttagtgtccttgatcttggtgtcatttagttaggagatgatcaaactagcacggagggagtatctactatctagcacaacagctatctagcacagttatattacagcctccttgcgaatggcgctcccacaacaattcagagtcgtgtgttcgttcgccgcgctatccacgtcaccccgaaagccacaagcagccggaatttgcgagtgagcgtacgtggggagcatcggctctggtcattttgcaaaaaaaaaaaaaagccattgatgtaactaataatttgtataggtccctcatcattcgttcctcacttttgtattcttacgcaccgaccttctaaaatgtaaaatattttatggtaagaagggaaaattaggaaaatataaccgcgctttggaaaacataaatattttatgtcagatgtgcgtcaatcgtgccaatactgaggcctgggagatctacttagctccagtataggaccgtagatcttaatttgatgaggtacgggcataccagttagtttgatcctacaagatgttgatatatcagcgattagccgataggttgaatgatcggttgttggagacttggagactcgaatgctgacgacgatcgcaggctcgaatctcaagtgttttggcatgccgatagctaatagccgatggcttggtgtagaatcggctgaaggatccagtgctagtactaatgctgaacgcctttggttgttgacatgaaaaaaaaattaacacagtaatgtaagggatgcaactaagcgaacaaaatgtgagttgttaaacgaaaatgtaagggaacccatgagaaaataagttgcgagagcaattgacaggacgcagggctttctgtatcatccctctgcaaacatttacattaggcccttaagtcaattggaaggcgtcaattttgtaccatgcatctcacaattattgttttgagcttcgatttgtttcaacctagattttcaatcttatatggaaatgtaggaaaagatatcatcatagatctatgcattatgcctgaagtcaatagatcacattattttaatgagccacacaattctcagtattccaatgcaattcagcctcaagacaaaaaaaaagtcagctcacagtcaggcttatattaaaacccatatcagatggatcagtaatgatttgtgtagaatatctgtcagcgtaagatttcatctcgtacgcacgagcgcctgtgtcgctggctggctaaaatccatctccagcaagcggcagcagtaccatcacgcaaagacgcaccttggagattatgtataccatacatccatacaaacaatttatccgactaaaaataggaggaggtgcgccatatccatgtgttacgttaatagaataacagcatgtggggttcgagacaagaaaagcattttcctatgtcacaatataaaatttgcaagcatgtaatatttctataagcgaacaaactttaaaaaccgatccaaacgcggatggcgtaccacaatactggtaaaaacatatttaattttaaaatcattagtagagattacgacgaaaacgttttgttctttttgtttttttaaggcattttttcttttttttatttttcttggtttttcgccctttttattttttggatggacttttttcacggatttttttggttttttcgactgccttttttaaacctttttacgtattttaggcctttttttttactttttatataaatcattgcatacaaatcccgattttttttccttacgaacgacttgttttcatcgttttaggggaatcagacttttcttttggtggacttttttcaccttttttttcattttttatggacggttttttcaccctttttacggggaatcggaatcggatttgttcgcccttttttttaattacgggcgacaaacacgttcccaattaattcgcgtggatgaaaatataaaattaaaaccgatttaaacatggatgacgtaccaaaattctaacaaaaacatctttaatttttatctctacctctatctctactacttaaaaaattgaagatgtttccttcatctgtccaaataaaaaaaaagcgaaaaaacaacctaaaataaaaaagtatgattctcctaagaagtggcagaaaaaaaaccgtagatccgattcccctataatttttgtccattttattttctttttgcgtttcttactcttttttttttctttcaccgttttttccttttccttttctctttcaccatttttttatttgcctccccatatgtttcctcctccaattcattgtaaaaaccgattcctcactactcattattttccccttgaattcccctttcaatttggctttaattcaccgaattgaatctccatttcatcgtcattattttttatctcgagttttgtggattgcttcaattttgataaaaaacggaaaaaagagatcgattagatcaaaatctctcaacaattttgatttgatggagaggatcaactccattatcatacgtgcacaggttatgcgagaacaattttggagatggagaaagattcaactggatttgaaggagaggatcggctccatcatcgtacgggcacgggactatgcgagattgagtggattaccagattttatgggaggatcggctccgtcatggtacgggactatgtgagctcgagcggattaccggatttgatgggaggatcagctccgtaatggtatgggtacgagactgttcgagctgggcctatagctccacttatgggttgagccgaagagaggtagaccaagcagagggaaggaatgagcgttcggtccaaaaccaagaaagcatctggtccaaaaccaaggaaccaagggagtataatgtataggataataaacgtttttacccgttgcaactcacgggcattttttctattatactctccgtttctaaatatttgacgccgttaacttttttaaatatgtttgaccgttcgtcttattcaataaatttaagtaattattaattcttttcctatcatttgattcattgttaaatatacttatatgtatacatatagttttacatatttcacaaaagtttttgaataagacgaacagtgaaatatgtgttaaaaagtcaacggtatcaaatatttagaaacggagggagtaatataatagtagagataagccagccaaaacttgtgcactaacttactgattggattcagatgcagtaacaaagtttactaggcaaaagagtagcacaattctgatcggacaaatacaaatttaccggacttaaaattaagaagtcaaattttgtgcacaaatcctgattggactccgattcattccgacaaaaaaaagctacaattctactccaattcggactcccaaacgagacagctcaaggctggcggcagaggcagtaatccggcggcagcgacgcgggagagaccttcgcgatctgaggcggcgacggggacgtcagccgccgtccctcccagacgtcccagcgcccgatcaaagcctccggccagcacacgcttctgatcagcaaacggacgaaaccaactctgatttctgaatcaaatctatttccagatcgagcgaaatccctgctgtataaagcgcaatgacaccacgactctgattcctgaaactgaaagggactagccgattgctagatctcttggttccctgctgcacaaaacccagccaccaagacagaaggatcaatacacctggagagtaaaagaaaaccagaaaaacaaacacatatggccgcgaaatccgacgaccactcgctgccgccgggcttcggcacgaggccatggctggtgcagggatcacgcggcgacacgctgactttcgtcgatgtgtcagacctcagcctgcacgagaccgttgttcctgaggttcgagggaagacgtgcttgggcggcatgcacggtgactggctgctgatgctgcacgagtctactgccgattgcttcctcctacgcatcagcaccaatccacggaccaagattcagttgccgccgttgcatcagcctctgaattttctatcaacaatcaagatgctcgagtcaccggatagcccgaagtgcaccatcttaattgccagctcaccggaggtggaagaagagagctaccttctatactgccgccccggtgaagacgagtggaccaaactggtttccccgttcaatgacatccatctctctgcttttatgtgcaactacgaaggaaagatctgttctgcttgttctaatctcgtagtgatagatatggtggatggtaagatacaactacagcgagtgggtaccatcaaggatgaagaaaaatatgcccgtggaagtggttgttaccatgttgtcgagtcatgtggaaagttgtttctcttgtggatagaagagctcgggtgctttgggaacgatggattgctcaccgccattgatgttttttgcttggatcttgagttgatgtcatgggagagggtggagagcattggcagcgaccgtacctttcttatctctgaaaattacactttctcatgtccttcaatagaaggtgtattgcaaggaaactgtgtttatcttgtatggtcaagctgcgacagtgagaggctttataagttctgcttggacgacatgaccattagcttccaacagattctttctcaacctacaaaaccctggtgtagagcattttggactgttccagcaaggtgagttgattcagcacacacgactattttttagcattgtctgcaatagttttttttttccaaaaagaccacattttactgaatcatgtatgagtatgactattgttaatatgcaactacagcatcgaatcaatcttgcccatggaaatatcagacaagccaaatagtcttctatcgacaaaggtttgtaaatccgtgcaagtatgttgcagtgaaaaactaattccctttatactagtaaatacggagtagtaactaaaactattcttttttcttctttttagctgtcaaaggatattctactcaatgaccttgatgagcacgatggactggggaattctttatgtctatgggaacatctaccagtagacttgctagagttaattgtctcaaacttatccttggtagaccgcatacgatttccaactgtttgcatggcatggagcaaggtgtcgaatccaatagagcaagcaaaagtttggccttggctaatgcacatctctaagcaagatgggatgtgtaggttgtttgaccctctacgcggtgaggtgtacaacatgcaagtctcaatatttgacactaatgaagatcgacacatttttcgctcctccaaagatggttgggtgttcacatcagctgggatctatggtcacgatatattcatcataaatcctttcactgaggatattgtggagcctcctatgttcgaacgtagataccactacaacggtgtatccttttcttcaccaaatccaatgtgtccaaactgttatttttttgggatcaacagtagtctcagcgggaagtttctcaacattcatacgtggcggcatgaagaaactgaatggatcgagcaacgctttgagtacgatgtgccattcccagtaggttacaataaccccgtcatgttttgtgggaagttctactgcctcggaaggaagggcaaccttggtgcctttgatccaacaagcaatacttgggagattcttgacaagccagagccgatccatgttgagatggatctcttacaaaatgatcataggggaagagagttctgctacttggttgatttagaaggagaactgatatctgtactcttgcataatgccagtgaggcgcctcgagtgttcaaacttgatttgacaaaaatgtcctgggttgaagtagaggacattggtggtggtgccttgtttcttgatcacaggacatcgcatggtgtaggatctcccgatggtggtcatggaaataggatatacttccctagatattctgtggatagaaaaccagtgttctatgatatggataacaagatgtactacccatcattttatggtcacattgagccattgaactgtgtgtgggttgtgcctaatctgcacaaaaatgaatcaacatccgaagattgacccaagcgtgtgtaattgagcatatagtgcttcttttttttcttttttttttttgcaaattgtcaaatatggaaccacgagtacctctatttgcctcaatcgtattgctccacaaatatggtttttacctgtttttacatgatctctgctagactgctacagtaagttgcaggttttacaattcatgtacggggtcaagtgtggtataattcttccttgatgatatgctataattggatctcgttgcagcagctatttttgtgctgttagagatattggagttactttaattattgtgtgcatggtgccacacgctgcacatattcaggcgttcttgaatggcgccacacgtttaggcgtagttgaatgatatgaagatttagcaaaactatcgatatcctacgatatttggatagtgataacttgctagttcttgtgggaatcaagcaatccatggtatgaaaattttgcttgaaccatcaagcaattaggaaaaactggggcaagatttcacaggttgtgaaatatattttgtcaaatcaggttttagagcaggaaatatatgagataaatctgtaggggcttgaaattgaaatgttgattgttcgccgtgattttacagcataagaaatataatgctgctagaaatttgatgaaaagtcagggattataactaccaagcaatcagaacaaggtcttgcaaattacatgcttgcttctcataaagtgtccatgattctcagatgggttatcacaaagagatttgctccggtccggcaaaaagtatctcaagatactggtacctcattgtactaaatcattttcggtcgttggatctagctgggtagaatgagaattgttaaatctaacagtcggaaacgaggtaccataaggtaccggtatttcgagatattttttttgttggaccggatcggagcaaacctctatcacgaaacatatactgttcaggtgaaccattgatgcactgcttttcttgaaaggaaactcccattttttttaactgaacttctcatcgatgcacaattatacttactcccgtttattacccgaacttgtcaatataccaactgagccataatccataaatataccggcgcccaattgatgcatatttttctccgttgcaatgcaccaacatccaagtagtaattcagtattccttgcagaaaaaatagtactccctctgtttcaggttataaaacgttttgactttagtccaagtcaaactactctaagtttgactaattttataaaaaaaaatataatatttttaacccaagataaatatattatgaacatttatttttattcaattatagatttaatgaaactatactggtgttgtaaatattactatttttttctataaaattagtcaaacttagagtagccatcttataacctgaaacggatggagtaattcagtattaaatatgaaggggatttttggagtacattaaagtggacactagctatttattgggttagatccaacggagatgctgtcctactgcacccggtagtagtgcagtagaattggtggaggggtaaatttgtactccatgtggtatgggtatgtttgtgttagattgatctctggccatcgagtcagagaattgctctaatgggcttggcccaccccaagcccacgcgcacctaacgttaaggaccgattccctcggtcccgaatacacgtcgctctttctagcgctatgatcggaagcgtttttttcctcaagaagaaatcgcccccgatccccttaatacgcatataaagggaaccttgactcacgggtacgagggtctactcacacactctaagccttcccaaaacccctaagattaccctcagactatcgatcttaaggcgtattggaggggagcgaagggcgaattcccatcgccgccaccgcacggtgatctccatcaccggctcctcacggcgactacaccaacgcatctaaggcgatcaatggcttcttcatccggttagtataccaccaaattccgcatatgagatattaggtgatcatgcatagcctaggtttatgaatttaagatttaagtacaatattgtggtatcagagccttcttaggcctttgcatgttccatcactccggtggtgaagccactaagccgcatcaagtctccctaagcgccggcttgttaaagttttagggtttatgttctgttaggttttgttcatgtcgcaattaagttcaattttgtgattcatgttctgttgatcgatattagactaagttttatgtttagattgctatccctactcagtttatggcttgggcagcaattggaaggaggggactcagatcggggttgagattaagaaaatccccaatttttttccccaagttcctaaaacccgaaaccctaatttctgaaatttccccaaattaagaacaaagcatgatgaattctcgaattagattgatcccgattggcaatttcccaaatcatgagaaaaccctaaggaattgggactcaccgatttggggctcaggtcgtcggagtctcgccgcgcgtggcatgagcaccgccgtgcgcgtgtgtctccgagctcctcactgtcttcatgcgaatggcgcatggcttcacgcgtcgccgtgcatccccttagccgccatctcggaccggcctcacgctcgcatcagtccatcgccgcgtgaggtcgaggctcgcctcggtgtggctccggccgcacctaggaggaggaccgaggcgggaggatgagacgacgtgcggcatcagcgtcgccgcacgtcgccatcaagcacgccgccgactggggcctccgcatcgccgctccaccggtgacccaccgccgttagcttgcacggattttgctccgccggtgcgccgtggttttgaccgccgcctaagccgtgcgtggcattagcttgccgcgcatgcgggggcctcagcgacgccgctccgccggcgagccacccgccgcccgtctcttcccaccagagccgtgcacggcattagagcgccgtgcacgggggcctcggcgtcgccgctctgccggtgagccgccgccccgctctcgcctcttcccaccggtgttcgtagatgtctcgacatcaccggaacagcatgtgggttgattcgtgttgccgcgaatcgcgtggaacggcggcgctactaccaaccactgccgcgacgccgtcaccgccgccgctgccccaacccaccccaccaccgtgccgccaccgccgccgccgccgtccccaccgttgtgctaccgtagagagttaggtttggggatggatccttttgaatcggggtcctgtgctgttgaacaatttgagggctgagatgctaaagtttgtcactaggcggggtgtttcctgaacatttcaacatggggtgacgtggacttatctggaacctacattttccatccaagtgtggtttctatgtttgcactggagatggtgtttccactatatatcttctcgaccaacgtggcctaaatcataaaggaagttggttggtgcgcatactcaaccgatgcatgcatccgaacctagctcggtcaactcgacaactcgacgctgggctgcggtgcgcgcgaccgaacatggcattaatggtcaggatttatttcacgcggcgagcggtagatgatcgagcggcttggcccgctcgtcagctgcacgcatatcatgcaccgtccacacgaatggaatcactagtacgagtcggcggccacgctcgcctgtgcagtttaaaaaaaaatgaacggaaaacagcactagagtgccttttcatctaagagcaggagaaaatacaaacccctaggggtaaaaggaaaacgaagaaccactatagctgtacactatacagagtgcgggattaactcacgcaaccgcttagctcctgctaaagcccaaaggctcgcctcctctttgattttcattagtaggaaattcgttgccacctctttgtgatcaaaaatccgccgatttctctctttccaaatttcctagacgactaacagaatgagcgatcgaagtccttttttcgggacactaggcgtgtttgcaatgttctcccaccactgtatgactgactgggcttcctcccattccgttgggtccatctgctgatagcccacccatgcagagacgaggtgccagatcctcttggtgtatctacaagtagcaacgaggtgcaatgccgtctcagtctcgcggcggcaaagagggcaacaaccattgttctgccatcccctggtcgcaagctggtctgaagtccagactctgttctgaatgatgagctaagcatgaaatttgcatttccccggcgcgcaggctttccaaatcaaggaattgagtactcggcgccccgcagcactgcgcatggtaggccgaggaggaggccgtgtaggcctgtgcagtttacagttacagttgggtggggggagcttttaattggctcacccaacacatcacatgcacgacgcgcacatgcgcgggcgcgtgatttttcggtgcttctctcctcgcccttccgatcgcgacgtcggcccagacgagctagacggacacgggggacgagccactgtgcgccgcagagatgcaaactgtcgcgtcggcgtcgaaccatatgcgccgcgtgtttaccgccgtctaccgcgaggggcctgtgcggctgtgcctgtacgcacgtgtcggtggtaagctgcagtgcaccgtacacgtacatactccatgacgtgccagatctgtttcatattataatagatttttaaccttttttaaatcaaagttcttaaaagtttaatcagattttaaaaaaacatagtaccatttacaatatcaattttatgttattaaatctaataccgaatatattttaatagtctctttgttacgttgaaaatagtattatattttcctctaaatttggttctaaacttgaagaaatttggctttaaaaaaatcaaaacgatttataatatgaaacgaatatagttacttttcgtaactttagctttttttttaacctcttgataggtttggtgagtgcaataaatcacaagtagatcggcccaaacaaatgggttttcaattagaataaatttaggctttaatcgcgccaaaatgtgtgtatacttccatcattaatgtgtcatgcgactcggcgaggggtgtgctagcacgaaattttttatttaaatttcaaaataaactttttaaaaacttaaataaaattttgaagtttttagtcatgtcaaaacaatattgtcacgccggtctaactagtgtggcaatattaatcacgttgtttctagttggcatggtagtggtcttattacatcattgtagctggtgtattaggataaaactgacatacccgttgcgggtggcgtgtcagtgttattttgtcacgctaagcgagttgcgcatgctaaaaattcagattttagaaatgagttttggaatggtttgtttttaaattaaaattaaaaaggttcgaaaaagaattctgccggcactaagaacatgcccagcagatcttccatccggccatccatcctatatttagcgtatggaggtgaaaaaataaggtccaccaaagtctccatcacacacgccatctttagatgtcatccaaaccgagctctctccatgccaaatttggtgtttctctcttctcacgctatcctccctctgacgaactcgcgccaccatccagactgtaccgtggggaatggagaggatggacataccgagtatgccgttggagtttgctgaagaggaggccccgccgtctgtgccgcccccatcgggactccacccatgccgctgctcctccgccgcgctgtcgcgatgcacgcggccaccataggcgtcctccgcctctcgcacgtctgtcggcggctgcctcatctccggccatccgcggccctcgcctgcccagttgctcgcctccacggccgccgcgtgcatcctcactgccagtcgcctatccggtcgtcgtccgccgctgcacctcgcccgcctagccaccgccgcccctcagctgcacgcccgccgccgcctatcgaccgccccgctacaaaccctgcagagaaaagtagtactagcagagaaggcataaaaggtagagaagaagcagttaaatgaggagagaaaatatagttatgttaattccttgggttatcattttaatatattaattaaaaactacccattaaaaatatatccattaaaatttactcatttcaaaatattatcgcaataaataacaccgttaaaatcaagtcgttcaaaatatatcccttaaaatacaaatgtaagattagttggaagatattactaaaatataggatgatgtaatatggatgatctgttggagctagaagggatatggatgatgaatttttttggatgataatctataagggtattcggaggatctgagctccaggggatgctctaagcaactgggctttactgaaaacagactctgatagcgcgctctccgctttaaagtctttttgcataagtacttgaagcacatggtggcacacaggcttgctgatcctgacttggataaaggacacctttcgatgggcctcaatcgattattccatgccgctgccattactgccttgactaccaggaaaagcagatttaatccatttagtgttttggttgtgagagtgagtgtcggtctggcatgaacaacttgtactatatccaatctactccagctcgaacaatgatgtgcattactgatgtttaatttggtcaattcacactcatgtgagtggatcagcgtatgtgtgttccaatgcaaagttgaagtagctaattgcactggtggatatatcttcgtttggttacctgacgaatactgtattccaaaacaactaacgccaatataaacacgaaaataactgacgaaacaatgaaacatcttggagacaatgagctgcattctgaaactgtgaggtgagcctgagccaggagcatcgatctccagttggtccatgtccaccgccggagagaatcctgagcacgaggcgcgtgtaccacagaaaagcagcgagcttcccgtgctttacacgaagaacgcagctatcacgtatgcataatttgcatatgcgtccaacgagccgcgtcggcgtcgctggcttggcccggtgctcgatcggtcgatgcttcatggctaagatcgaacatgagaacgttcagaaagagcaaaaacgcgttagtatcgactcgtagcacatggcagccacaacccttttgtatgaaagaacactttggcgttcccacacaaaaattttacaccatgtcacatcgaacgtttgaacacatgcatgaaatattaaatatagacttaaaaaataactaattgcacagattgtgactaatttgcgagacaaatcttttaagtctaattgctctatgatttgacaatgtggtgctgcagtaaatatttactaataatggattaattaagcttaataaattcatctcgttgtttactgacggatcatgtaattagttttttattagtgcctaaacatcacatgcgacaccttatataatacccgatatgacacgctaaaactttacaccctggatctaaaaacacccctttgtgttagctgatgcgcacacaataggatgcctgcctgctgcggcagagattctcgaagaatatgtcctgattagttctggtctactggtatgctgtttgcaaaagctaggatggatctgtgtataatgccggtcatttccttgtcccaaactggacggagctgcagtgccagcaaccgacgcccggcctcacgtgaaaaagcagatgttttgtgagttgtgagtttcattcctgtccaaactcttgaccttgcctgacccatctagcagcgagacgcaccaaactgtggttaccaactttactccacagtacctaccatagacaccacagaagcagaggccatcacgcatcactttcttctatcacatctaaagatcagagtctcccggagatctctctatgtccctgaccctcctgagacactctttttacaggccaaaagttccggtactatttgaattttatcaaatttgaaaagccattcaaaatacaaatgtgttattcaaaaaggtgtcggcccccctcagaattttccccgaacctgattatgactgtcagtgcatgagttcaaaaagagtgtcatgtgaaaccgatcaacttctctgtatataaacccttcagtccacggcccaaagcaaagcacacgtacagctacactttgtcactagctaagctagcaagtgcaactgtgcaagccatggcgtcgatgtgttcgaggtcgataccccagctcatcctcctcctctccctgaccgtcttcctcctcgccaatgcgcatcccatggccccgccatcgccgccgcggaaggcggccgcgcctccgacggcggcgaagggggtgaccggcatttcgccggtgctcgtctccacgctgcgcgagacgctggacgcgatcaagaacgtcgcgtccatcatctcgtcgttccccatcggcggcatcctcggtggcggcgacctccgcctctcctccgccatcgccgactgcctcgacctgctcgacctgtcctccgacgagctgtcctggtcgatgtccaccacgtcgtcgtcgtcctaccagcccaccaacgccggcgccgccacgtcgtcccacgtcggcaccggtgacgctcgctccgacctccggtcgtggctgggcggcgcgctgagcaaccaggacacctgcaaggagggcctcgacgacaccggctccgtgctcggctcgctcgtcggcaccgccctccagaccgtcacgtcgctcctcaccgacggcctcggccaggtggccgccggcgaggcctcgatcgcgtggtcgtcgtcccgccgcggcctcgccgagggcggcggcgccccgcactggctgggagcccgggaacgccggctgctgcagatgccgttgggccccggtggcatgccggtggacgccgtggtcgccaaggacgggagcggcaactacacgacggtgagcgcggccgtggacgcggcgccgacggagagcgcgagccggtacgtgatctacgtgaaaaagggcgtgtacaaggagacggtggacatcaagaagaagaagtggaacctgatgctggtcggcgacggcatgggcgtgaccgtcatctccggccaccggaactacgtcgacggctacaccaccttccgcagcgccacagtcggtgagtgcatccacgcctccaaactagcttacaccaacatatcctgttcgatcatgaactagaagttcattacgtatgctaattagttaggttaattaaacttaaacggtttgatcgatcgtaatgtcgtcgcgtgcttattataggagtatagatcaacgagctctcaagtgcatgggtcaatgccatgcatgctagttttagtagctgcattgcacctcgcgttgtacctgtatgcgtgaggcttgggcaagctaagactcatgcctaggattagctcatcatcagaaccacgatgagacggtcgtgtcactgggagtacttacgtaagatggtcaatataccatcattggaactgtgctccgtggggccgtgacaacgtagggtccagtccgtatcttgctctgctgggcgagatacataggagtacaccgtacccaaaaccccaagggcagcagagcacatggcattaaacatggacaagctagcaacgtgccaacatgtttcatgtttggatgtactaccagacttgctatggtagacggaactcggaagcctccgagaagtagtagtagaactgaagaagggtgtactgttcctttcatcttagccgcgtaagtacattcaagtccgaccggtttaccaccttcccagccttaaatacacacatgctgcattaacgcaactccccagtggttgccgtgcaccagcaacgaattcaatgaactagctgagctgagccagcggcgatctgcctgggccgccgggccggctatcccaaactacaaagtcctccttgtttttactactacatgtcaatgccacttgccacatgctgcggtgcatttttcatctggtccggtccacaaaattcgtgcatgtggtgcaccgtgcacggtgtgggatttcgtttaatagtttccctttgcaacgacgaccctatagtggattagtggtacagtgatgttggtgctggtgccgccaggactgacaactgacaagtgacaggagtactatcaagccaaatgcatccattagtactgtagctatgagagtaataaaggtaggagtggacatagatcaccgacacagatgatcttcggctctggtctcaaagctgctgcgtagtactccgtatgctgctaatcttttttacttcgtctcgtcatatccgggtgccatatatgaaaccgcgttgtttcgctgcttgtcagcaacttgtgtgccaaaacaatgatccaactcgtggttccatcagccacctgcaccctcatttacgaggttgttaacaaagtcttgtagtttcaactaaagtagcggtatgatctgcgggcccttgtgttttcctaaacaagtcacgagacctcacctccctgtctcacactctcctgcacggcatgtactcaagcaacagttgcagatcacatgcatgaagtcatcaatccctctgaccattcactcgattcaatcatttgattgcatttttaacagcagtaattaatgatgtcagactgttaattactagtagtgcctgacattgcatgattgcatccacctcctctgcagctgtgaacgggaaggggttcatggcgcgggacgtgacgttcgagaacacggcggggccgtcgaagcaccaggcggtggcgctccggtgcgactccgacctctccgtcttctaccgctgcgggttcgagggctaccaggacacgctgtacgcgcactcgctccgccagttctaccgcgactgccgcgtctccggcaccgtcgacttcgtcttcggcaacgccgccgccgtgttccagaactgcaccctcgccgcgcgcctcccgctccccgaccagaagaactccgtcaccgcgcagggccgcctcgacggcaacatgaccaccggcttcgccttccagttctgcaacgtcaccgccgacgacgacctccagcgcgcgctcgccggcggcggcaaccagagctccgccgcggcggtgacgcagacgtacctcggccggccgtggaagcagtactccagggtggtgttcatgcagtcgtacatcggcgccgtggtgcgccccgaggggtggctggcgtgggacggacagttcgcgctcgacacgctctactacggcgagtacatgaacaccgggcccggcgccggcgtcggcggcagggtcaagtggccggggttccacgtcatgacgagccccgcccaggccggcaacttcaccgtcgctcagttcatcgagggcaacatgtggctgccgccaaccggcgtcaagtacaccgccggcctcacgtcttgatcaccaattcaccatcgagtacgtgcttcttgtgtgcgacagtagtacagcacatgatcatactacactttacactacgttggagggaggtttaattaaggatctggtgtataaaatctttaggaattatggcattctgggagctatttagctgtttaattggtggttaatggaacaagtttgccttttgtttttgttccatgcttctctggtggtggtgctctgtttttggcacaacgaatggttgaaatgtgcatgcacggcgcacaagtaaaaatcacacagaatgtacatgaaacaggcaggtatcagatattcacattggaccgtctcctctcgaaagcatatgtacatggcgcacgcatgcaggtgcccgggtgtctgcacaaatatttttcacgcccacatgccgtacttcaccggcgtgccggtcggcttgatccatggctcggcgtgcaagaagttctgcacggtgaacttggtggcctccttcttgctgatcaccttcttgtaccccggccagctgacgcggccggcggtggcggcgccggcgcccttgttcccgtactccgcgtaccagagcgtcttgagcccgaagtcgccgctccacgggaggtagccggccttgtctacgaaggcggggatgtcggagttcatgatgagcgtgcgcgagtactcgcgccacgggcgtgcgaggtagctgcggacggcggggcgggaggcgtcgccgagcgccgactcggcggcgaagcggtagtgctggagcacgaagccggtggcctcgcggcggtcggcgcggccctgcgccgtggcgatgttctgctggttgtcgagcgggcggcggagcacgatgacgcagttctggaacaccgccgcggcgtcgccgaagatgaagtcgacggtgccggagatgacgcagttgcggtagaactgcgccttggagtgcgcgtagagcgtgtcctggtgcccctccatgcggcagttgaggaagatggacttgtccgactgcaccagcagcgccaccgcctggtgcttcgccgcgcgggccgtgttccggaaacccagcgcgacgcccatgaacccgtcgccctgcgcgtctacgtacatgcacgcgtcagcctgtgcaggccatgtaaatcgatggagaagctagcgtgcaatgcgtgttctggctcttactgaaggtcgccgtcttgtaggtggtgaggccgtcgacgaagttccggttgccggtgatgatggtcttcttggcgccgtcgccgtacatggtcacgttcgccatcttcttggtgatcgtcacgtactcctcgtacaccccttccttcacgtagatcacgtacctgaagaacacgattcatgcccaaagctttggttagtagtactagaattgatgagagatgttgaacattcaggtcgatcgtgcaggcgcattcaccttccggtgtacttcttgggcatggcggcgagcgcgtcgttgatggtcttgaacttgccgctgccgtccttggccacgacgacgttgggcttgagcttgttctggaacttggccttgagcagcctcctctcctgccggttcacccagaccaggacgtcgtcgtcgttccctttgggctgctttggggcgttctcgtcgaaggcgaagctgagaagtcgccggaggctgttcccggacgaacggttcacttcgggctgcttcgtggcgtcctcatcgaaggcgaagctgagaagccgccggaggctgttcccggacgaacggttcacttcgggctgctttgtgacgtcctcatcgaaggcgaagctgagaagccgccggtggctggccgccgaagacgctgggaggtggagcgcggcgaggaacgaggacgccttcccgatgagggccagcgcgttgctcgtcagctccttgccggactccatggcgtccctcatcttgtccttgaggtcgccgtcggggaagccgtcgatgcacgtctcctggtgcgcgatcaccgcgctcagccacacgcggagctggtacccgcccttggtgagcccgtccacgccgccggcgtcgatgcctgcgagagtgcggtcgaggtcgtccttcgcgttctcgtagatctccttgcaatccgcgacggcggccttgacccgcgggtcgtcgctgacgatcacgctcgacttgtcgaacgccttctcgatggcgtcgccgatcacggccacggaggcgcgcacgacgtccttgggcgacgacgacgacgacgacgcgctggcgttcgcggcggccttggcgaggctcttctcgcaggtgtccttgtagtccgtctgcgcgcacatcgccttgatgatcttggacacgccgtgcaggctgggctgcgcgccgccacctgacgctgaaccggaggaggaagaggagccaccatcaccgaagctcgcgttgtaggcgacggccgcgccgcccatgacgatgatgataagaatgaccgacgcggcgccggctgcaaccatgacgcgcctgcgctcttgcctctgcctctcgacatggcggcgctcagtgatcggatcgaagtccgagaaggtcgttgacatggccgacgaccttctcgccctgcctgaagaatgttttcggcgtcgccgccgccgctctctccctccctctgcccttaccacgatcggcaaaggcagagagagaggatcgagcgagagcgagagagtgaggggggagaagagcttgtttattcagaggattcaagggtggagagagattttagggagtcaggttaaatttgggagctggttcgttctcgtttccttgtcatgcaaaggcagcaacgcccgcgcgggagctcctgacgcggctgccgatttctcgcttcattcccagcaaaaacaacgtgactacacgggtgtgtttgcaagagcaagttcccaacactccccacgcgtacgtttttcaaactgctaaatggtacgttttttacaaaaagtttctatataaaagttgttttaaaaaaaatcatattgatccatttttaaataaaaactaacacttaattaatcatacgctaatggattgctccgttttccgtgcataggagatgggttcccagcacccacctccgaacacagccgtacgtgagcactgagcagtttgattccggcgaagtagaccgtttcaagttgtaatgggccgttgagcccgtggtgtgtgtcaactttgtttcctcgttgggcctggtggttcgtttacggcttatctgttgttgccttgttggagacgagatgtgttggcgtgtgcgctttctctcccacctttcggcttttcacggattccaggcctttcgttgaggaggacattgtagatttgtagactgtagtcttccttttttttgttcaaccacgttgaacaagcatggtttgtatcggtataaagtggcaaacacgcgtacttgagccaagaaaaacatgcaattagaccttttccggtggcacaagcacagtgacaaaaacccaagtggcaaccaagatttacaattccgagatggccttccgttttaggttctgacagaatgatggttttcgtgaaatccggtgaaaagccgatagattccgaacaaatttcataaacaaaaatttgaatacaaattccctgagtttaccgataagcttgcgaaaacatgtcggctttggcaaaattccgagcgaaatcatcgaaatttcaatccgtaactagaaaaagaggtaaactaagggtgtgtttgaggagaaggggattgaggagattgagaagatacgcaaaacgaggggagccattagctcatgattaattgagtattaactattttaaatttcaaaaatggactaatatgattttttaaaacaactttcctatataaatcttttacaaaaaatgcatcgtttagtagtttgggaagcgtgcgcgcggataacgaaacaaactcactcactatctcaccctctcaaacgcagcctaaaattgttttcctttttttaattcgctattcttttctttcttactgtaaattttagtaaatacatggaatacatcgtttttttgaaaatttatatcccaataggttctatgaatatcataatatttataagattttatttgattttttgcttttttcttaattcaaatttaaatttggatgaaactcatcgaaatctcatacggtttctactttcgagcctcatcaaaacctcgaaatttcgtggaatttgaccggtttttgtcggaattttgtataccctggtggcaacagtgccattgacagagaattatactcctctctgtgttgatttacgtaattttaaggagtcaggttgattaaagttagtcaaactatggttatatactaaagactactttatacagctataaatattggattttaagatttaattaaacttttaatactttaaatattaatttaatattaaaacaaatttataatctaacaagtttttatatcacgatggtccttgaattaagtataaacatgtatttcagcacatacacatagactcctttcagtagagtatatctctattaattgctctaatgtaatccaacatagtcgttatcggcacatcgagtattaatttctcgagttaaaattccacatccataatttcccgtcacgctacaacacaaatactttccacgctgagtcaaataaataccatattatataaatgttacaagtcatataaaaaaagaaaattgatatgcatacgatctaactgtccgactcacatacgattgaatttaatcaacacatataaaaggatgtagtccatgtaaacatgctctcattggattgatttatggttggatgtttcttgtacatgagcgtatagcagtacttataaaaaaaaaccagcacgtataactataagctgtagccttggacgtactctctctacatggtacgcgcatatctttggacatttcctgtcaagttcctatcgtccagatgatcgatgttccaatgatatatgcagtagcaatcagccaaaatataagtgtagtactgtagtgtaccaaactaatttcttccgttcctttttagggataatgcagaggaatcatttcattttcgtgtagcgaccaactgacgaccgtcgacatgattcctgatttctgcctatcatacttcaatcagaatgatttggttttactccaccgattcgatgtgacatatttttatgttttctagtatttcctccatttcaaaataaattatttttgaagttaaaattttgttctataaatataataagttaatttacatcattttacctacttaggatctataaatcaagaagtatatcattcaaaactctttacgtacctacccaacaatactatttttttaataagcgacactttggttattttctctccctactaaaattgccttagaatacaacatatgcttttatttttggatagcaggagtagtgcaacgtacaagaggatttttcctacaatagaagtagaggatttttattgtaaatctaaaaatttacaatagagcaaactcggtctcggtccttggtctttcagtaaattctaataatctaaaactggaattgcaatatccgaataatttgagtctcggtcatgaccaaaatttcataaagatcccaaaattaacatacaaatcaccaagaaactttagcggatctaaaaaaaatcatatccactatttgatcgttcgctgccatcggccaccgccagcgtggaggcggcatcgcaaattcatcgtcgctaccaccgttggagtggaggatgcaccatgacgacggtgcagcaggacggtggagcgggctcaacggccaggacctctagcggtgcggctatcagcgtaaacggtcagcatgatgcgatatttgtggtgattgcgagaatcgcatgggtatgggtatgtgtgtggtgattgggtgcacggggtctgactgggagtagtagtaggatttgttgccctattgggttattttcggtatattcaatcagttcagttaaccgataatgattatcggcacggcactcacctcatctgcatgagcagagggtaagatgcaggaaggagaaagaaaatgattgaaaaaacggtctcagtctcctgacctttagttttggtctttcggattcggtcaattttacctggcaaaagaagcgagagagttataagagtttgtcctatgatgagtaagccagtaggtgaatgatctacaagactcggggcttgttcactttgctactattttcaaccttaccaagttttggtgttgttaaattttagaagagttaccaaaattttagcaaaattgccaaattttggcaagatttcgtatgtacttaataaaatttaacaacaaactaacatagccaaaattttagcaactttaccaaaaataatagtatggttaaaaattacatcaaagtgaacaggccctagtcggtcttaaaaaaacaacacagccagatggctccatgcaaaccagtgattacaaaatactactactcctaaacactgtttagatctgtcacttgggcacttggcacacatgtgcagacagcagacttgcaaagcttgacctgatcaacctattttaacttttccttgtggaaaaactagctccattaattaacctattcatttttccctctcgtttcgtgtcgagtcgccgtcttgttcccatcacgctatacgcgcccaaaccgtccgttctcccggccatctcgacagcgaccccgcgagtccgcgacaccctcgcggcctcgcctcgtcggacccctgggcgtacgaatcgcgcgcgtgatctcaccccgaatccaccggtccaaggctccccgtccaatctccggcctccgggtcaccgggtggcggccggcgggtggtagctgcgggtcggctcagctcgctgctcgcctcaaggccctcgcctacagcacgggccacggcacgacacgacaggacggctactcgtacttgcttcagcccgggtggaccacatgtcgcgcccggcgcccgcgccgtccgtcgctctccgcccgttcgcgtctctgtctgtccctggcctcccacacgcttcgtcgacgcttcgtctcggcgattcgcggcttcgtgcgctacgggagaaaacggcaaagccgttgccgccgaaacaggacacatgcagctacagagctactgttgctgctgctgctgtgctggtggtggcacagcgcggcgtatcgtgctggtgtattctattgctatcatcacaacggctgtgagtacaaatttcgcggcgatcgagaaggttccacggttgatggtgtgacatgtgcgcgtatgcatgtgtgggttagtgccacatggggagggagggtgacgagagcgagacaggaatactcttgtggtgttttttttttctctgttcttttctcaaaagaagagtttggatgaagattaagatttttatgccatgctttttaaactgctaaacggtacgtttcgtgtgaaaaatttctatataaaagttgctctaaaatatcatattaatctattttttaagtttatatcaatcatacgttaacaccacctcgttttgcgtaaaaaaacttaatcttcatttttatccccatcccaaagataaagatgaagattaaatttttcacagaaaataagatggtattaacgtatgattgattgagttttaattattacaaacttgaaaaatagattaatatgatattttagagcaactttcatataaaaagttttaacacgaaacgcaccgtttagcagtttaaaaaatgtgccataaaaattttaatcttcatcaaacaaactcttgttggagaaaagaacgggccctctatatagcgaaattgttgctgttttcctggagtgtggtttggtttggtgaagtatgcatttgcttcgctgcatgattcgatcgatcgtccatctgcacagcgagatcatcgtggtcggtcttggtggcccacctgaaagcggcactcacggtcacggagaggtaacaccaaacaagctatataacagaatcccgttttaaaacgggatgattctgaataggtatcaggtgtgatacctatcaggtatcagacgattcgacacaacaggatgattccgagtaggtatcaggtatcaaatgattctacacacgtttcaagtgatacttacaagtatcatgctatttctaccacgtattgcgtgatactcgcgaggtatcatgtgaaacctgtcaggtatcagacgatttcaatcacgtatcgcgtgatactcacgaggtatcatgcgatatctgtcatgtatcagacgatttctaccacgtatcgcgtgatactcgcgaggtatcatgtgatacttgtcaagtatcagacgatttctaccatgtatcgcgcgatacttgcgaggtatcggatgatacctaccaagtatcaggtgattcctactagatatagctgggcatcccgttgggggaggagcacctcgacccgcgcggtcggccccctgcagccgtcccttgtagatgaggacggcgacggcggcggcaggggacgggcacgacaacggcggtggtagcgggggacgggcgcggcggcgaaggcgggggacgggcgcgacgatggcgggggatagcaatgacggcagtgggggatgggcgtggcggcggcggcggtgtcgatgggggacgagcgcggtggcggcgggggacagcgacggcggcggtgggggatgggtgcggcggcggtggcggcggcgtacggaggcgacgggggacgggcgcggcagtgatgggggacggcgacggcagcgagtgagcagaaatcgcgttgtggaagaggagctattccgttgggggacggtatcccgtcccctagcattccaaaaaaaaaagtcactgggagaaacgatcgaaataggttggatgtatctttaggccttatttttttttctctaataaaaattagataaacttttagattctcgtggcatgcttttcaaaccgctaaacaatgtgtttcgtgtgaaaactttttatatgaaagttgttctaaaatatcagattaatccattttttaaatttataataattaaaactcaattaatcacacattattactatctcgttttacgtgaaacacttaatttttattttcatctttatctttagaagattcaaacaccaccttagtacgtttaagagaaatggatgggtgaagaagagaggagagaaatttaatgtttacttattgcttattgcttattgcccggcagcagagctactatccagatgataccactacatgatgaatcatgtaatagagctcctttactagttaatttttaagcacattgtgaatggcataatgagcgatcgatgatttttttattaattctttttaataagaaatcctttcaaaacttgttttttaagatatgaaccttttggccataccagcccatgctgatccgactggcatggcaacgttatatggccacgccgctctgactagcgtgacaacattattttaccatgccacagtgacagggtaaaactatcacgctcgctacatgtggtatgttagtattgttttgccacgctagactgggctaaaaggttcggattttagaaataggttttggaaatatttattttaaaatttaaaaaaataaaaaggttcaaaaataaaaaatctcggtaggtcccaacagcaatcgtttttattttctttttcagagtacattattatatgcctcaactttatataccggaagtttacatactcgatcaaattcgaattcagattcaaatatttcatacataatatttttatacataaagaagcttataggtacaaagtttataatgtatgtatttctatatataaagcatacacacacgatttttcaattttataagtacagtatttttttctattttctctcttgttcttgaaactatcttttaatggaaaaagtataaaataccccctgaactattattgtcgaccgaattaccctctaaatttgaaaactagatatttttacactctcaactattaaaatctaacaaataattaaccccctaactcaattcggagtaattttggtcctatgtggtatatgcataacagtccagtcaacaattattttttaaaaattagtggtatatgcgtggcagtccggtgagatctctcccctctcccctctacctctctcttctcccggattcctcccgggttccccttgctaaatcacgaggcgggggccgaccgtcgaactcactggctaggcttcctcctcttcctcagcacaacaagcatgccgctctccctccgcttgtgcttacctgtcgcatccttgcgttggagaccaaggaggaggcgtgttggcggttgcctccttgagctcgagctcaaacgctccaacatccttgtgccggaggatgaggaggagatgcacatcgacagccgcctcctcgagcgcgagctttgcagcttccctgcattggaggctgccgaggtcagggaggatggggagaaacggcggagttcggcaacgaagcacgacaatggcggtgaaggagggcgaggtcgagatgctaccagatctattcgcgtggccatcctgttttccctcctccctttttctaacaccccctttcctccaggccaatggttgtagtcctggtagagaaagtggtgacggcgtggagaaagcggcggtcgtctgtgtagcgtgaagggagaaaatgtcattgagggagctcgagacgacgtcgggttcatcgccaccttcgctacttcactgctaccgcagctgcctctgtgcaagcttcggctctgccaccctctccaagtgacgggggtgacggactggtagttggggaggcaatgctgctggcctccggtggttgtcgtcaagcatctcgaggcgctcgatgctggtggacgtcggaggcctgacacgacggtgacctcatggatcctgtctactccctccgtcccataatataagagattttgagtttttgcttacactgtttgaccactcgtcttatccaaaaaatattagaattattatttattttatttgacttactttattatccaaagtactttaagcacaacttttcatttttatatttgtataaaattttttttgaataaaacgagtgatcagacaataaaaaaaaaactcaaaatccataatagggacggagggcgtacgttggcgctgcagctcttttgaatttgatttgaatttttgtaagtgcacgtggaaaggggagtcgggggcagagggaggcacatgcacgctgattagactgactgaaatgaaatgaccctctcgatatatcgtagatacggaatctacagttaaacaaaaaagatactccctccgtcccatataaaatccaaccctaacatctcagtacaaaattagtgaagagtgaaaataattaaaatatctcttattattttaaaaaatagtaatagtgatagatacgtaaaagttattgaaaaaataaaacttatcattttacatgttgagagtacgtagaatggtagaagttgattttttatacgtaaaatttaaactccagatattgacttttttttgaacggagggagtaactaaaaaaagcaaaacaaaagaatacgcttttgtccattgtgcatatcatactgctcggtgaaatttttatttggaaaagagtgaaaaaggggtgcatcgtcatcatattcaccaccacgtttaaggcatcttgttcaattggattcttaacgagtaactaaaaaatgtaaaaaaaaaaaactagaaatcttatgatgtgagaattgagtttatgcccttatcggttggcaatacattattataagcagtaacggcttattagctacttaaaaacaattttaaagtaaaatttttatatatttattgttaactacttaaaaataatgctaaaaaaatagtgttgaaaaatactctgaaataaacttcaaaattaattcataaatttaaattttgacaatgactcatgggaaacgagaagcccttaaagagagtcgaagtgcttgcttgcatgtcccaccatatgcaatccctggtgaatataacatcgtccatgtaaagccatacaaaaccatattacagtttttagtggtagttttcttcatgccagaaaattcttaaatggacattttttgagtttatttacctaaaagaaatgattttgtggtccatgagaagctaccatatatagcttttaatatgttaatttgcggtagctcttgataccttaaggtgctaatatctatgctaaacttgtggtgcctccttatttaaggacatcaaatcctttttttattatcagtttatatcctatctatatctatacattgtatataataatagttacacttcactaagcatttaaaactcaactacgtgcaaccctagtaatcacatctacaattatattacattctaaaatacaagcattctaaaccataattgttcttcacattaatttaacctaaaactatttaccatttctataacatttaaacatatattcatccgtatatttcgcagtaaaacacatgacgtcatcatctaattgccttagtacacaatcctatttaatgggatcatccgatggagaaaataatcaccatatgatctcatgttgtctcggtaaatatcttagagaaaagcaatcgtgtcaagagctacaatcggaatgtcgcaaacgagaaaatgacctataataattacggacgtgcatatatgtgagggcaacaaacaattggtcaaacattgcacaaaataattgaagatggcgctacaacgtaccatgtgtccattatatagtcatgcttatgatcgattttcaaaacggaattgctatatgtcattcgaatgaaatgttatagattttggatcattggatccatgccaagattcgtgcatctgcttctctcctccaactctggcgggctccccttcttctccggtgccggcgacacccctaactccggcagggagcatacgggttagggtttggagttggggtgagggtaggagaggggttgggcgagggggaagagggggggttaatttcctcggggcttcgagggatggccgtgggcagcggaggaccagcggtgggcggtggactttggcgggcggcgaggcggcggcggcaccgccgaagccacggggatggaggagggcagtgggccggcgtcggcggcggggccaaagcaagcgtgcggttaggaggcagcgggcagtggttgcggatccgacggcagggagccgtcggagacagggaagatggcggggtaggggcacctcgccgtcgccgccttgaggagaaagag

SEQ ID NO: 67167 - DNA, 16848 bp, Oryza sativa
  unsure (1)..(16848): unsure at all n locations
tgatactcaattgaaattcagtacggcttttcaccctcagactgatggtcaacctgagcggactattcaaactctagatgatcatgtatctttcatggaaaggcagttgggaggatcatttgccgcttgtagaatttgcatacaacaatagttaccatgctagcattcgaatggcaccatatgaggcactttatggaagaaagtgttgatccccattgtgttgggattccataggggagagagctatgttaggacccgattgggttcaacagtccacaaaacagatagcaaaaatacgacaacacatgcttgcagctcaaagtaggcagaagaactacaccgatgttagaagacgggaattggagtttaaagtgggtgatcaagtacttctaaaggtatcccctaccaaaggtgttgtgagatttggaacaaaaggtaagctcaaccccaggtatattggtccattctcggtagtggaaagagttggaatcctagcctatcgcctcgagtaaccagagtccatgaaaggtgtacattgtattccatatttccatgttaagaaaatatttgagagaccctgaacatcatattaccgtagagccggtgaccattgagccaagatttaacatttgagtctcatcttgtaagaatattggaggaatctgagagggtgctgaggcatagaactatcaagtacatcaagattctctagacgcaccagaccgagcgagaagcaacttgggaacttgagtcacagatgcggaagaagtatccagtgttgttcacacatggtgagttatataagtcctacctatgagttcctttctgtacttgttcaaggtataactggacgaattcgagggcgaattcgattgaaggagggaggaatgtaataccctatgtcctagagtatggttgggcgaattcgagggcgaattcgattgagggggaagaatgtaatgccccgggttttgaattaatatatttcgaggaatattagagcgaacgcgcaaagttcaacttttaaaccattgtttgaataggcgatcaggaaccgtggatgcgtagcgctcgtcgagtagggcgaaatagactataagtttgtggtaatctgagtcctgagttatttccggtgatcgatttaatgtgggccgttcgatcttcattagcctctccctattttaaccaatagaaaggaaaaaaaggaaaaaaaaaaaaggaggcatcgctagcagctagccctagccgccgacgtccgcgtcttcacctctgcgctgccgctgctgtgcgtctgacgccggttgccacagccatcgtctccttggtgagttgctgctgccgatctgatttttgtcttgtgttgctgctgctgccgctaggactgctgcttgtgctgctgcggctgctgccgatctgcttgtggtgctgccgatctgccgttgctgctgctattggctgctgctgcttgttgctgcagaagaacaggaaggaggaagagaaggggaaaaaaattagaagaagggaaattcggggagtttggtggatatttccaaattctttgtttttcttacaaaattagtactgctgggtaatctgttttagtccttagttgtttctaatttatatataagacgatccgtttctggtagctcgaatttatttttatcgaacgctaggctaaaatcgtatttttaattctggtattaaaccatcggattcaggttagttgtcctaaataaagtttgtagtcatcgtcgatatctttctaacaccgctggtttcgttcgattctgataaatggtctgggagaaacaacaaaaacagtactgttgactggatccagaaatcaggacagcaattcgttttccttaatctgggattttcagaggcataactgattttgtgctcaacatgaaagtggtagacaagtttgtctaatgtccgaggttgtattattttgctagagtttcgttagacggtttgcgagttacgcataaaacagtaataaaacagctataggttatttaatacaagtcagtaaaaatttatatgaattgagtttcaatttttagtaaattccttgtaactatgattagttggatatagtggtttatgcgtagttttgctcccaggtgtggagggctccaacgttggaggagttgagtcgaattatcgaaggagttaaggcaagtacaagacggacttgtgtgatggataaactgtgttacttagttcggtttcatttacccaattattattcaaagattcctattatcaattgtgtggtttggtattatgctacgtattcatatttcacttcatgttcaaattcacgacgttattcatatttcattcttccggaagtttttgttacattattcaagtaccatgcgtagtcatgggagtgcaatttggatctttattcatgatccttgagaaacgttgatcacgcttgctcggcttaccggtaatgctaagaggatattcacacctgcccgggagggaactactactttttgtctccttcgttttaaattaaaggaaaacaaaagtatcatattggtttcttattgcattaaacctgtgtatgttttactagttcaatattgtacttgctgagtattctttactcattcttatgtttaatttggtttttaggtacctaatgatattgatcggcatgggatgggagtagcacccttgaactacactattattgcacactattgaaatttagttttaaattatgtttttgcttagcataagttttgcgtagaacttgtaatggttatttaaagttctggtctttactttcacgtggaatttgtggagctaggatggtttggattgtgtggattatattgttgttgagttatcttataactgcctgtcgtggatgtccgtatttttaggggagactttgctgaaatttctaataatttttggagttggtggtttttgagtgtattttggtgtggcattctaggtacgtggctacctggggtgttacagtctcatgattatctgatggctagggcaataaaaatatatgagaatgatttcaaggatggtccattcttgtttatgcattgttggaatgaacttaaaaaccaaccaaagtggcatgcatatttggagcagcttgacaagtcaaacaaaggaaggtagattacaatgatgccattccccttgatgacgaagatagctttattgtagtcagttcaaaattcatatgcagtccctatttcatgcttattaattgcagccaatcaaaaaaacatgtggtcaatccaaatttccatgctgattgcttattagttgcagttagtccaaacaaacatgaagtcagtccaaatttacgtattgtttgcacttggtccaaactataatgcaatcaacacaaatattctttgctagcagccaaggcagtgaaattggcaagcagtacaatagtacaattaagcatgcaaactactagaacctccatctatatatatttattgacccttccattgtgaaactctcaaaccaatccattgtttcattctgaaagtaccatgttagactcatcctcaaactcatcatcctccttagatgatctagacccatctaaatttcttgacaaatacatctctgaccagaatgtcctagactcctttgctactcgaattgtggagaagatcaggccaagtttgcagctgggctagtccagtgccaaggtggaacaaggaatacctttgcaagggatcatggagaaggtcaccgacgtctagtggctgattattttgtagatcggccactctactatgagagaatgttttgcacaagatttcgtatgcgaaagcatatctttttacgtattgtgcaagccctagatcagtggtctccgtactttactcaaagagaagattgttctggtcgcacaggcctttctccacttcaaaagtgcacagcagcgattcatatgttagcatatggaacccctgctgatgccttagatgaatacttgctaactggcaagagcacttccttagagtgtttggacacttttgctatagggatagttgaggtctttggtgggcaatatttgcgacaacccacaagtgaggatatagagcatatactacaggttaacgagtctcgtggctttccgggtatgctagggagtatagattgcatgcactggaggtgggggagttgtcctagagcttggaggggccaattcacccgtggtgactacaaagtcccaacaattatccttgaagcggttgcttcacatgacctttggatttggcatgctttctttggtgtcgctggttctaacaacgacatcaacgtgctgaatcagtccccctctattccttgaataagttagaggggaggctcctcgggttcatttttctgttaacgggaatgagtataacaatgggtataaccttgctgatggtatatacccagattgggtcagcttcatgaagtctatatcacttccacaaacagggaagcataaattgtttgctaaacgtcaagaaggggcaaggaaagatgtggagcgggcttttggagtgttgcaagcccattccaatattgtgcgtcgtccagcgaagaagtggaaacggaagagtgttgggaaaatcatgctagcttttgtgattctcgacaatatgattgttgaagatgagagagaggatgcgatatgtgacattgacctcaatagaattcctaggacatcaatagtcctgcctcctgaagtaacttctggtgataatccatgttttactgatgtgctacgttgaaaatctgctattcgtgctcgttctgtgtataccgaactgaaaactgatttaattgagcatatttggcgtcggtttggacataggcagcagacataaacatggtagggtaataagcatgtcgtttctttgccttttctttgccgtgtgtagattatatcaattaacccttgtgtctaatttatttcaggaacatgctctgctcagtatgtccaaatcatggtgctgcacttcttaaaggtagcttatatgaactaaatttagtgctaggccagattacttacagacacattctaatgattctcttttcttccttgtgatgatttacttgaactaaatgtactcctagtccagactactaatagccacagttcagtatttctcttttctttcttacgatgcagtagcatggtgttttgttattgcttttacccgctgaactcactttgaatttacttgttatgcatctgggcatactgcaaactgttacgaaatggtgatgaaattctcaatttttatgccagtgcaactatttctttgtaagatataccaaccgtagaaaaatgcatgtactgattactccttttagtgaggtttcattgaaaagagatttcattgtttcatttattcatcaaatgacaaactactcaagatgttatgtgttttacttctcccattaggttgatgatagctcaggcaatggtaatatgatgcaatgatcctgctatcaagggtctatcttcgatgaagaaatcattctctcacttgttggacagcatatttatatgtacttttgcttaatgccctattgttgatgtgactaatatccaccgttgaggcagagggagtcgaaatcgtgggggcgcaacggagttggggtcgtcgcggaagccacgatccttggtcttacggggacatttaccggctcaccgccccctgcgatggtgaacaaaggagtgaggtgagcgctgggctgggagagtaggggcacgatgcggtggcatgcggcagggagtctcgaggaggcgcaacagcgagtgaggtggtctggtggtggaagcgcggtagcggaggcactggtccagcagtggactacggcggcagaggggattcnggcggagtgaggaggaaggaggattcnagcggaaagaggaagagtgaggangcggcagggattggcgctggtcccgtggtggactgcagcggcagcggggattcgggaggagcgaggaggcagcagggattcgcgtggcggagtcatcgcgcagtcggaaagagcggtggagaggaatcggtgggattggttatgatttcctacagcaaggaggatacacggatgagattagatgagatagcagatgaacggtagtgattgatctgagtgatttggcatgtaggattggaggggtacaactcctcctgtttatattagtatagatatagatatgttgagcagagcccagctgcccatactacacgtcaatactgagaattcaattgcaaaaagatgcgctacagtatgctatcaaactattcagtaaagacctactcacattatttcctttggctctgctttgtaaatcacttgttgaactagttttactattcatcaatgtatatatactcatttgttccattatcttaaataaatacgcatatatgctatatgatgagtgagaaagaaaacaaacaggagcatagattggatcgaaacaacgcagcctctaaatgcaccggttctttggtttatatgggttatacctgtcatgcaacagtcatgatactggacaactgaagttgttacattttacaaccagagaagaatatgataagagataaaacaagaatcagcagacaaactttatacatctctagtaatttttatatgagtgaactaaatatatcttaagcggggaagacaggattgaccgacaaaaaggtgcacacctaaattatcagaacaaagtaggaggtctaattgtgactgcctagttgtgtacccgcactgatacgcaaatattactgcctattgatgcattgaattggcaatgataatcattctaggcccaaaagaatttacaatatggttgcacgtacgacaaacattccacgattacaaatcaaaacccaattccatcagacttgagaaatgctaaaggtcagcttgtataacatgtgagaaccacgcatggtacagagtcccgatcgatccaacaaatccatattcgatctgcaaacatggctgaactacatgctacacagcagcactatgttgtgttgtaggatccgctttattaggttggtagggccattgattctttctctcttaacagcatgggagagtgacatgaagacgcacgcagtcaggactaaaagcatggctattagtcacgatttgggtgatacatgagcaaaggatgtcggaggggcgagctgatcatgcttctagcggctagcaagcagggtgctaggcaagagtgtccgtgtagaaacttagcagaatcggcttatttgatatttttcttgagagtttgttgggttaatttactagttttgaatctgtcttttttatttaatctccccttcattttgtcaaattattttctaaatgtttgactcagactctcacatgcgtaattaataatgatgatacctacatgtacatgccagtgataatacatgtcaataccagtgatgctatggtatctggaacctatgttaataactggcagtggtaattaatatctgtaggtaccactaatgctacctactacaaataaccatgatacctcgagttactacatataataatactacttctcagtatcaaaacaatatcattgaggtttcattatgaagtaacctagttgacgcgtgtacatacatatatgcttacatgggccaaaatggcatgcatgacctatgttattgtcaaatacctagtgtacaccgctactggctaacacgactttttggatccccatcacactccaaaccatggttgttgtagaagagctatgtgcctctctctatagcttacggacagacagaagggatgagttgtgaaccgccgagcaggcatcctgctaggcaattaggacgtgcatattgcaccacacagtctaatcgatcggctcagcataacatcacctcgtgatgcccattttctggacccacatggcatgctagcctgctctgttgtggttgcctatagctggtcccctgtaaaccgagccgaaaccccattcactaaagccttgtgcacggcgggttgaacattataccatgaaagatcacacagtttaattcgttcctaacatgcggtcatgagatcattgaacaaaaaggtttaagagtgaccaaaatcatgagagatcatccaccgccgccaggcccctcccaaccgccactgccctccccaccacccgatctgctgtcgccgctgaactctccactgtccgagctcgccatggcccttgtgcacgccatcaccgctgccaccgccctccccactgatggaatcgccgccccatgaccgtcgaccaccagtcgtcaggagaaaagtcgagagagagagggaggagatgcaacatgatagacggtctgagctgagccctcgttgacgccgccgctgctcttgcagtcgcccaagaggttagggagagagagtaggttgaggagataggttggatagagatgcagattttttttgtatatctaagcacatgcaagcttttaattatgagtatgagcaacctacgtttggaattttatttgtagacaaaatgtccatgtgaccatgttaatctttcgacctcatacctaaccaaaaaatggcctttttctccattgtttcaagcaataacgtggaaaacttaacatgctagtagagtaaactctcttatttatcagccaatagcaattgtttagatatcttagcttgcatattcagattacactaagaaatacgcatgggatagatataagcaaaataacacagtttatatcatatataaacatgtaagctatgaacaaaccacctaattaagtatatcaaacaatatttcaaagtaataaaactcaattcaatggcccatcatattaagtgttggatatccggttcgatagaactacattgcacttgagaatcctatctatatacttagatctggatttggcttgctcgcatttaaatttacagtgttgcatatgcttacatgcaaaaaaagtggggggggggggtgagtgtagagagaggggggaaaatgagaggtgagagagaaggtgaggagatagggatgaagccttagaaaaatttgaagatgctgagagagaagagaggagaaatgttagacttttaggcagatctctatgagacccgtctgcaaaaatgtatttccgcatacggcctcttaagaatccatgtaggaaaataaatatatttttgcaagtgagcctcttaagcggccgcatgcttttcgcatgcagcacttaaaccgtttttggggaatgatttttgcaggtgatagcagttatggctcgcctgcaatttaaaggagatattgtctagaaaaatcaattatgtagtagtgaaagtttcagaaatgttagatgacatcatctactactcctatcggatggactattagaaatgagagattaactccaactccttgtatagtaacgaaccgtagccgacgttttgtatttgtttaatttgtatctacccattagagagatgagctcgcctctaactgtttgttcctttaatttcagccatatctcaaacagaatctcttcctagcgtattagagattaaataatattcctccaaaaaaaagagagattagataatatactcaaacggttcaaattgaatctttagagatgatcaattggggatgatatggtttatatagaagtgtttgatattgctctatcagtatcaagaaagcgatgatcaggcaagaggaaaaggtttttgtgatgtgtttgctgatcactctgccagtcagcgcccgcgcatgttaagctttgtattgagctttatttgctattgtgggccatccatattttgatctaattgttcaaatcagcttattcaacacaaatgatcctgaaattttctctgatgatattctaggacatttttctacatggttctcgagaatcacaggctttcattttacatctagcagtgctagtactacagttaacttgcagttcagttaactctgcgcagcgtttctgaatcaacttgagctctgcaacattctgcttcgagtctaccactaatggtgagcaacacccctgatcccgatgcctctcagacacacatacaagctctgcctggggctgtcatgacacagctgaatgcgcgagcacctagccggaactgaagaatgtgtagcgcaatttcagttctgggcatcatgaggtgccgttttatagctccgaaaattcttgcacagccatatgttacctactgattactagcctctatcttgaagctgatggtttagtcgcatgagatataattaatcgttcaaccggccctcttaattgctcatatcagagacgtgacaatagtactgttggtctgttgctcgtacaggcatgcagcaattgcaatagcactcgtaattaaatccactacataaattatttgtcagtaatgtactgaaaattttcaatagaaggtgtgctacatagctacctttcaggtaagctatttgcaatatgttagtagctagatttttttttttatagttttgcagtaaccaaaaattgcatacatcacgcggttcattttctttggaaagttctttttctctacgatttttttttggatttatacgttgaagttcttaatttatcgttgtttgaatttgaatgtgtctaatttaaattgagtaaatgtttatcagttctaaattagttttatacctatattagagaatcctatattcgaacttttatctaggaaagacgagaaagtgttttaaattaggaatgacggaagtgatgaaagtgttaggttatatctaagttatgagaaaagtgaagtgaaaaataggcaatcaccttaaatatataaattaactcttcagattaaccgtacttataggcaaaaaaaaaacatgtgacaagtaatctacaacctcatcaagtacaatacaatattttctttcagtgattttccccaaaattaatagtctccataagacacgtaatatcaacaaatactaataggataactaggtgaaaccccacgagttgctacgggagttcagtactcactccgtcccaaaatataagcatttttgataagtcaaacattttcaactttgactattaattgtaaaaaaaataaaaaagatcaatcatgtaaaattaatgttactagatttatcattaaacaaactatcataatatgtaactcattttatttaaaacaccttgttttatagatattgttgatcaaagtggtatctcggagaccgtgccgggtctaaaaatgcttatattttggaacggagggagtatgatttaatgagagaagaaaatgagagataatttagaccatgtatgaattatctaagggctaaacaattaatatgatatgacttattaataagagaggagagaaataatattaagtaagtgaggataaactatataggtatgtaagatattataaaaaataatgaagagatatattaaaacaatatgtgaattatgtagaataataactaaatgcttgcattttaacgctttaaaattcaataaatcatagataatatagcatgcttgcataatatttaagatgtaataattattagtgaataataatttggtatctttacatcttaagttttaaaatttagtgggttataactttatagtaaaataggatatatagcactatttaagtaccttaaatagtcaagaaggaatctgcagcaattaaatagctctcgctaaagaaaattcaggggattgcaaacaggagattgcacgcgaagcacaaattgtgaaatcattgtcatgattaatattttgtgatgaataattggctttacaaatgatttattcgatgaactgatttgaaaagatatgtggatgttggtgtaagtgcgtgtgactaatgagtcaggttatgatatatgtgctcaggaacggttgctttgtctgattgtgtgcaggtgacttcaggtcaaccttggtcaatgatgaggaccgagattatgctcagggaggatcagaggtccagtgcggtcgggatatcatgtgagaaggtgactagagtcagaattcttggaggaaaacttcggtcgatagtgttatcgggtctagactcagggaggaatgaggtgtgagtgcaagcgtcggtgttcgcgaaggagattagagaattggataagtgtatgttgctacattacttcggtttactgtagcatatgttgtatgcatgtgtgttgatcaatgatggcagggcttggatgttactccctccatcccataaaaaactaatctaggaccagatgtgacctatcctaattaacactataaatatggacagtatttggacatatgtctagatttgttatatcaggataagtcatatttgataccatgttggttttttatgggacgtaggtagttatgtagcaggttaggatttggatcctctaccttcgaggggtgaaggcacggtggtgcagtcaaaccatcctcgccatccagcaaaaataagtggctcacattcatgcatgtatatacagagtataatgggccagcccattagtccgtgcagtcaagccagcaaatgaggccgagctagcgttgccacattatggcgcgaaaatgtccgcggtaatggagccgtggagggaaaaatggcatctttactctgttttggcgccagaattacataattctcttcgtctactcttttcacctccatttctcttttcagttccaaaaagattttgtgccctttttcttgtcacctcttcacagcctagctttgagatgcaacaagcttgtgatcggtcagatatggcagaagaacccacttgaagaccatgtgtttgccgcggtgattagtcagtttctacaagagagatggatgaaaaggcggatggtgagcaccatgagttcatcaggtaaataaataccaactctatacttgtcattcttcaagcatggctgcattttctctatagtaataatccacttgtgatttttcagagaggggatgatacctagtacactacctcaacttggaacgaagttttaggatgagatggaggcttgggagttttggaaatcttatggaggtaacatcggtttggaggttaggaagaggtacgcgaataagaggaagtctgatggtaaagttagatcatttagatatgtttgctcaaaagagggtcatcggaaacaagataaaagatatcattaaataaaatgtcctagagctgaaactagaaccggttgtcaagtaagaattggccttatactagaccaaaaagtaggaaattatgaggtgactgatcttgttctagaccacaatcacatcctttatccaccggaaacattccacctaatgtcatcagaaatgaatatttcagatttgcaagcttttgaaattaagacaattaaccgatgactccggaattggaccaaaagctgcacatgagctagctagccgtcaagttggtggatcatttaatcttagctacacccttcgtgatcaaaaaaaaattattcgtgtaccaagcaacagagggaggtggcatatggtctaagtcggaagtatgttgaagtattttcaagacaaaattgctgagaatccttctttcaaatatgctttgcaaatggattgtgatgagcaaatagcaaacatattttggactgatgctaaaattatcatagactatgcacattttgatgatgttgtcattttttatactacttttggaacaaataaagagagtagatctttcagtgtctttgttagtgtcattttcgagaaacatttgagtctttcaagtggttgtttgagacctttgtaaaagcacataatggctaacaaccgcaaacaatttacacaaaccaagatagtgcaatgggcaaagttgttgaagaagtgttcacagaagaatggcatggattatgtacgttccacataatgcagaatgctatcaagcatttatctcaaccggagaatgaaggccaacacctacttctaaataacttgacaaagtgctagtacaagccactggagacaattaacaggctcaaaacctcaaactcaaccatgttgcacagaaaataactataatcagctaaatgttcatggcggcatgagatgagcaagcgggaataagcatctacattgttttgattctattgtattcttctttcttacttgcatatagagactgaacaatgaacaatgaacaattatatttcacatactcatttgttcaatcaatggaaaaacgtaaaaccagcccatataaaattcatcgtcttcgaagagatcacaatggagggcgcttttccttttttttttaatggaaaggagagttttgtttacacatcaacttaggatttttctatcgaacactagacgaggaattcccccatccaactgtgttacagaatcaagcatagctcgcaagatcgttaccaactccactgcactctttgctagccaattcagttttcacttttcacttcaggcaatagccacattgtcgccttaatttcaaccaatagctaagctttataaatactgcttgtcccgcgccttcttcagtcttggtaccaacaagctacagtgaatgagattgttggaatttgaagctatttcaggagtaattgcaaaaactatgagttttgtttcttctaaaatcgatcaaaacatatcgtaaaattcaccatgacgacaaaaggtacctgacatggttatcacgaaccaaaacaactatgcttccattcaccatgacgatgtcatacaggcataaccataacaatgattccgatgtctcaaagcctaacacatattatctctagtatggtatgatgaatgtggaaaacctatatatcataactgaagaattaatatgaattctttacaattgtttcactgaaatcaaattgtgttttgattattattttgtgatgaacaattggtatgtgaaataattgattttttatatttggtggataattgacgaagtgggattggtttggcccagcacagtggtggtcgatcagattggcatatgttgtgcagtcaaattgaccagtccgacaatctgaccggctgactctgactcggtgttggttttacgttgtttatttggatactcgtaattatctcgtgattatgattctagatataatactgttgtgtgccaatgttgagtatcacgatgagggtcatgccgtggaacgagatgcagagttgcatcgtctcacgcctgatagggcatagagggagatgccggggtcgtcgtccgcctccggcgtcgcattgtggtcgtcatccgcgaaaggcgcgccaagccaaaacaggcgcttgcacttatgccctggaataaatttttcatcacaattaaaacaaagaccagcctcacgatgcgagtgcatctcttcaggtgttagtgtacaacgtggagtgcgtccctgttgaactggtttaggtgttgttgtcgtggtattgatgcgaaaaacacacactggcctgagagatttgatttactctggtgcaggtcctaaatcttacttttgggttcagggcgtgccagttggtttgatcctgcaaccaacaagaaacaacgaaaccaaagttaaatctataaactctagtcgatcggctggattgctgatgacgtatcattcatatcaggtcgatgtgatatggatcagatcggatatggcaaagaaaaggttaaatctacgttatctcaataatatataatcttggcttcgaaatacgcttaaaccaagtgattgggatagatcggacagcatgccgagatagaataaaccacttatgtctaaaggtattttaaagcaaagactatatatattcatagcatggccgattggcaaatccaacgtgtatcggctagtgctccgatactactttatactaagatatcaatatagattaaatatactaaacaagaatcaattcaatgttagggtagcctaacagactgatatcggcttgatatattttatccaagtgaggtcttgatataaagggcagattcagtatattaagtaaacaaataagaaacaagataactaaaccaggtaagaccgactgaaactccgatactatcccaattaacagtcatgaagcaggctagatattgtggttctagatatcacttaatagatcaaactcaactgatgtagcattaagcataaagaaaaacataaggtctagacgagccaatgagagccttttcgggatggtggatatactatataatctaattcgacgatagcattggaccctatcggctgttttcgatgatagaggctaaccggtgagatcacatagtaaggtcgatctatattatatagcatatatgataactcgacgacttgcgtggacatgattagagtgtcataaagatgtaagcactaatcccgataacacaagccgccataacaagctttacatcttgtcggagatcgaaactgatgcagcccaactcgaaagcaagaactcgtcgaaaataatgaaaagtaaaagggtggcaatgcaccaagaatgtattgaaatgatgttgttttgtacaaggtattgggtcatatttatatccataatacataatatgtccttgccggacacaactccacttcttattacaactcaaaaagacgaactagtcccttaagcggactcttaccgaaaatatgtataaggaaactaccaaaatatcctagtaatagatacaattgtcatttttggactcaatccatacttagcaatacttgtatagcacttcaaccaatcccggca

SEQ ID NO: 67168 - DNA, 32498 bp, Oryza sativa
  unsure (1)..(32498): unsure at all n locations
tttgactccaaatccaatctatgatttaccacatttggtcgttaacacgtggtcctaatgttgtcgcttggttgccaccgaggttgggcgcgcccagagaggcaatcctcaccggagttcggagggggaggccgggaggcgggagggccggatgctgggcagcgggtgcacgacggcgcggcgcggagcgacaacttggcggcgccggcgcccagagcgaaggcagcggttgcacggtggctggcggggcgcgcgcgggtcttgtgggaggccggacacggcgtggcggctcgaccgcgcgtcgcgcgagtcgggaaggcgccaaggcgagcaggccctggcgcggccgctcggggcttcttccggcgtcggtggcttggtgctggctgcgtggtgcgtgcgggcgtgcaccgtgcgtcgtgactgcgtgagagtgggaggccgggagacgggagtaacaagagttagggttttttttgttgcctattgggccaggctttttctgatgggccaataaaactgaatatctactcttctctgggccaaattctagggtagtcctaggcctatatggactactctctgggcccgctaatgaaccgacgccacggcggagtgccataggcgcgttccacatgagtgtaccactgctgcgcttctcggaggagatgaaacgctacggtccaaaccttctcttcctctatggttcgatgctcgcggaaaaattgttcacagcggctgatccacgttgccggatcgccatgccgtcgtattagggaaaatcccacttgtagtagcggggaacccgagcgtcaccgtgtgtttccgcgtgcggtgtaggcgacggtagtggtctcatgatccccttggaggactcaaggcttttgattgccgtcgagtgttcttggagcgtgatgttgatctttttaagctcatcaaggatggctgccatctgcacattgctctgactcgcagattgctcaggaggagtcgacatcatcacaggcgtatgacgttgctctgataccaagttgtcacaacccggcacatattgcaagcggtagttggggaacaccggcggacgctgtccgggaccgcgagaccggcgaggcgtggtggcggaagaaagaaataatgcgcagaggagagacgcggcgagagaggagaacagagattggaaataggaggagatttaactgatttccttcttaacttaataatccggactacaactccttaaatagcaaatactaatcctaacaaccggctaatgactttagctaatgacaagcacaagataaatgacagaagataaatctatctccagctaatccgaagacacgcgcacgttactttcgcccgccgcgccatccttcttccttcgtctccggaactgaatttcccacatgacattcattttgagggttcctaatttcgtacttgtcgaaattaatttttagcccagtcaaataaatggagaacactgaagagagatttcgtggaaatcagtggcatatatcccaaatggttcccatgtctagtagaatgacggatgacacgcatgtgtctcactatactctctccgtactcataaagaaagttgtttagaacaatatttaagtcaaaccttggaaatataaatcataaataactgtctagttgttgaatttgaaaatgtaaaaattatatgaatagatttgtcttgaaaaatactttcataaaagtatacatatatcactttttaataaatatttttatagaaacaagaagtcaaagttgtgttttagagaccgtgtcgctgttctaaacgacttcctttatgaaaatggagggagcatatgtgctagaatgtccattctagtgttcccgaagcatttgattgttggctgccaattcaaagttgttatgtctccacgtctaatatctctgttttagatgagaaaccggccgatgtgtgatccggcgagtttacagagcaggcttgcagtgattataaccagacggttcctatttgcctctttgtgctatttgggcacaagaggctgggtgtggtttatactttataggtgaatgtatgattcagagttagaactgggtataactaagcttttctagtgtccgatttgtaggtgaatgtatgattcagagttagaattaggaacagtaagctctagtatgatcttcatgtgtccaaattataggagaatgtatgaatcagaattggaacacggaataactaagctttgtgcttgtttttggcccttctgtacatgtacgacaaggtaacctcctatagctagcaaattaatgatatataaagcattaacattgctaatggctacgattctgaaactagaaatgaacttgactttttaagaggtaggagtatgttggtgcactagaagatatgcatgtgtgtatgcaatgaatgcgtacaatacattagcattattattgtgtgctacagctgtaaaatttcggaggatgtcagtaatgttacctgttcaaatttcggaggttgtcagtaatgttacattttcttttctcaaaaaaaaaagttggacaaatttttggatacttatgacacgcttttcaaactgctaaacggaacgttttgtgtgaaaactttctatatgaaagttgttctaaaatatcagattaatccattttttaagtttataataattaaaacccaattaatcacacgttattatcaccttgttttccgtgaaacacttaatctttatctccatctttattttcaagaaattcaaacaccacttagtttgcaccaaatgacataactgggtccatgatcattacaatatcttgttcggttgttctttgtgcagtatgtgagcatgttatgttgggatatacagaaattaaacgagctaggatggccacgtggctccacactagcagctctcccattaaattttactggcgctaacacacacacacacatatatttaactagaaaataccctgcgcgttgctgcgggatatgagtgcaaaaagtagtaccgaactatgtaatttcgaaaagggtgataatatgaacaaacacattctgaaaatatgaacaaacacattctgaaaatatgggaaatctcttatatgtttttgtaatcgaggagtactgatattatagaattgtagtacagataatgctatagctgcaagatgaagaacagaatgggaccctaataaaatatagcaagtcttatgcatatgacataatgaagtcttcatatggaaggaaaatataataagtcttccgcacagtaaaatcaccgtaggtcagacagcatatgttcacctgtattttgtgttggagaatatattagtagtacaacagggatgtgcttgtaagataatggagtaaatctttaggaatgtgaagaataagtaccatttttattatgtagattggtcaggcagattggtatgcaatgcagtttgtagctctatgctgtttggagtggttcataagatattgcagttagtgttaaaggcaaaagtattacaagtcatgagtggatttatctatcacaaaaatcaatataaaaataatgaaatgtgtggtgttataaaataatgtatacactttggttccctcaatggagtcttcaggaaaatcagcctttccctctgtatgttgtagttttttgctgcatgaaatagtttcaaaaatattgtagtcagtattatagttgagttatgttattctatgttttttccaaagtagtacatgcccttctttgtaatgtttgagaacagggagatttttggtagtgtaaaaggaaaaatgttccaaggttggttgtgagttgatatttgttaatcagaaaaggcaatataaatggggttataaaatataccttctggtttcctcaatggagtctttagtgaaatcaatggctctctttgtagttgagctgcagtaatggataataatcatatgaatgattttattaagcataatttttttgtatatttacctggttttttcagttggagttttatcagccaaagatatttcaggtgtacttttgcttgatgctcctgtattatgaatagttgtgctgaaatttatttggcatcagcagttagtactatatatccaatgtgatgtagaggctgggttttaatgaaaatcctttatctaaaaaaaattatggtgttgtacaaatgcaatgaatagaacatttgatagaacaacaaaccttgggttatctgtaagtggtgcaggtggtggaagctgtagtacctctttgttcttcaaaggcttgattagttttatattttaatttaattagtttgaaatatttgaagtaatatggaacaggatatctgaagtaatatggaacagtagtatttactaagctctccatctgtgagcatagggaccgacatagtaggctcaattgtgaaactcttcttaagcacatagctgatagggaacttagaagatgtatcagtattcatccctatagcaaaaatttttgttttaccaatggcattattgagtgctgttggatgatcggctgggtctatcttcatgttttgggaagcttgggctgcatcaagctctaccaaatctttagcaacaaaagaaaatgctactgcatctaaactccctgattcatctgtaatcgtgacagggagtttgtacctgaagcattgtacattagttagatacatctagagtggttcttcgaatgaatgtataagagtaggagattgtacattggtttgcggaatgaaacttcgcaagcacatcttggtgaatcagaattgttgctgtaccctttatcacaacgatggcatcctatgtaataccatttaattgatgacagtatggcagttatttttgcagtagtactgtatgtagctccacccttatgtaataaaaagtattaaatcttggagaaaggaatccatggcatggtaataacaatataattttttttcttttgtattgagttgtacctgaaaggctgaaataggcatagctgatatctcacttaaggtgtacatttttcctgctgcttggatcggggttaaacgtataaccttagggagttgttgctcaagagttggacgttcccattggtagcttcaaattgcaaagagataggttggcatcttttgacgtgaaatataatacatattgaacaggaatattcaagtgcaaatggtttgaaggggttaaagagaattacctagtgcgaaactctctaacttgaggtgtgtccaggtcaatatatatttcagtagcagagcttgaagatgcttctgttatagctgcaggtgaaagtgaagttgaaatgttctgcattctttgtatgggagggcatttgtttgggtcaaagaatgaacctgaaaattttcctgcagtaaggccagcaaagatggctactacaatttcatcctttgatttatggagtgttgcatcttcgttgaatgattctccatattgtccccagagtaggacatcttgagtctgttccctgcaaaaatgttgcatataaacaattgctgagattacacaaaagtaaataatgagagcattgattttaacgatcaggtttggaaaaggtacgtactctaggttttgaattttaattctcctaagttttttgtctgatgttgggctcacaaaatcatatggaccaatataactgattactccaatcaaatctggaggaatattcattcaaaaaaaaatctggaggaataagccaaaagaatgtgaagtgtaataagtatgattcaatgtggaattaaagatagcattacctatgagaggtttggaactgatatttttccctagaacttcatcaaatgggcagaagtcaaaaaagaactttggtatggttaatcctctagattccaggggttgaattcgtgtgtcatgtttaaactggagaatgtagttctggcactggtagatattggtctttctttttgcatcaatggcaacagtattactaattaggtagacagatcctttatttagcaaggggcggaattgctttgcaaacctttttggcacagtgatctatgctattgagccctgaaaaattattgtgcaacaattgatatggctagtattaagtatagcaaagaagtagaatctagtattaatatttggtggaacacataagagaatgacatacatgttcatccaataggatgccgtcaatgctgatgaggggatctgcagattttgatctcatgtttatagcatcccataatcttattagacgtccaaaaactttgcagttttgctggccaacagatatatctttcaatgatgtagctgggttagccattgaggtaaatctgaaaaaacataataaagaaaaaatgaaacttaagtgaatatatgtactgagcaaaatatggaaattgaagtacagtaaaacattatatttacaaaactaataacgaaaccaacctatgcatcacaatataccttatcagttcctgtttctatttattaggttgaatacctcggaatatactacattgtgtgtgcaattttcataagaagcagggctgttctctattagaactttcaaaccattaggtgaagtcactctcgagaatgcaacatataattgaccatgggagaacacaggtgaaggtagatagactccaactctgctcaaggtctgtccttggctcttatttattgtcatagcatatgaaagacgtattggaaattgtcgacgccgcaatttgaagggccacttggattgagttgatgttgtaacaatgcgaggaatatatgcttttgtacctttcgcttttcatgtgattatttctccctctatcacacggtttgttagttgtgtgacaatgagcctagtcccattgcagagtcctcttgatggatctagattacgcaaaagcattataggaacaccaattttcaagtgcagcacatgttctggaagtccatttatagaaattgtgtttagaaactctgttggatatagtgcctctatagcagtacagttagtagaactgtcatcaattgtatctgagctataatatgacatctcacttgcttctaactgagcaatcattctattgtttatttctgaaaccacctcatttgtaggtgctaaaattgcacgctcacacagatatgatataagatttgatggttgacatcctaagttgtagacaaaagaaatcaatccatctagattcctacagtttggtgatagaagaagggactgaggcatctctatgaacatgttcgttagttgctctgggacatcaacaaaaggttctgtgccatttcctattttcaaaagccaattagaaaaatttcttaactcttctctatcttgtgcggaaatagatgcagaggtaagcctcatattttcagttaactcaagaagtatgcactgattccacaaataagagttaacaatgcatgatctcaaaatctgttgctttgtagcattttggatgactggcagtgtctgcctgaaatctccaccaagaactactgttataccaccaaattgtttgtctaatgaatttgggtttgtttcagacaatatatctcgtagagttcgatccaatgactcaaagcaatatttatgattaacaggagcttcatcccacacaatgagagatgtttttttggatcagtttagctaaatttgtatttttctttatactgcacattgaatttttagagatttccaatggaattttgaaacgggaatgaggtgttctcccacctggaagcagcaaggatgcaatacccgatgatgcaacagctaatgctatctttccctggcttcttatagaattaagcaaagttgtccataagaatgtttttccggttcctccatatccataaacaaagaaagtccgtccttcattattgatggcagaattataaatagcattaaaaacttccttctggctgttattcaaacctgaaatagcttcatctatagtggatggcatgttataaacatcgtagctgagctcatctagtacaagtctattctgtgctgaaacacttccaatatcatctggtagtggcaaactaaaatgggataagtcatagtcagcatctcttagcagtttatctaactcaatgagaagaacagatctaacataaggattggtggagctgctggcctgagaagtgttgcggggcattcgatatgatatatcttcgctcatatatgattcatgttcactgaaaagtcttgtaggatttgttacctcacaaaagagtaacattgtaacaaaaagttgtcgcagttgggatggtaaggcccattgagctgcatctttcaaagcatttgaccactcttggtcatcaccaaggagacctaatgcttcacatgctgcccgaaatgtaggatattcatgacctgatatagttctgatttcagcaaaggatctagggcccttaacgatgtgcagtagcattcgcagatagtaagcttctccttgtgaagggtttacataagcaatgtggccaattctacattgagaaccacgacgaccatcccaatatttgccttgattgtgccatgtccaatgttcagggtattctatatatgtaagttgcctagcagaagggttctccctattagcttctaaccatgcagttagtttggtcgtagagctgtttggatcttcaatgacctcttcaagatcatcatcttctgtgaaaataacattattctcaaatgggagttggacaggtaggcgttctacggagggatctgtgtggtggatgtcaaattgttgcaatcgccaagcagcatcatttggactgacacaacgacattctagataattatctatttcattgatagtttcacttgatgattgtgatcctgaattagagtgaattccaacccttgaacaatcaaatccctttgttacatacttaaaaagatatttgtgcatgccatcataattaactttctctagatttatatgtgcctaaaacttcacaaccaaatcaacattatgaggaacaacaaatctgttatcaacgtcaactccattttttgtaacagttcttccattgtttggacgtgcatactgtgtaaaaccattttttaatatagttgtttcttcacagaattccttagggtagaattttgtgcattttccttcagacatgcagattgaagaagtgttgtgaggaccgcaaggtccatgcaccataaaagaagatacagcctcaaatcctatttggtcaattgcaggatctggtaattgagctgaaatataatgatcaatcttctgggaatctaagggttctgttttggccaaccatatgattatgtgaacatgaggtaaaccacgtttctgaaattcgattgtatagataactgcatgaaaaatgatatgttttaagggttgcatggtggtaacatgcatgtttaaacctacaaaaggaagagaaaggaaaatttatcttttggaaaccaatgtaaaatttgatacctgcatttatagggccaaaaaatttgtgcttctttatatcatccattaaaatattgagcttcattttgaaaacactattgacaatatctggacgatcggaaggttgttggccaggaattgatgctaaagcttctctaatttcaggccaagcagaattcgatgtgaatgtcaaaaaaagatcagggcaaccatattttctacaaatagcaatagaatcttgataattttgatacaaataccgaggtcctccggtaaatgaagatggcaatattatcctttgcccaacagaagatccagatgtaatacctcttgagacagaattaatcaatgagttgaatggtgatgatctatatttactttggaaggctggtgtgagataatgtgctatccggctcccctcgacacaacaataaaaatctacttcataagattgtgttagccttttacaccgtaacggtgtattgaagtctcctggcctatcatgcaacctatatgcatagcactctagcattgtaactttattccgttgcatggattgagtgcgtgctgttgtacgatatgtgatgttttcatgataaccatcctctccatatgggaacaaaagtggatattgcatagccataaacttgcggtgattttcattgattagctacaaacgtgatgcacgatcttggattataatatctcgccctacatcagctgatccaacatcaccaacaatcaggccaacaacttcagaagcgactggagcactataaatatctccatgtgcatccggcttaccaaataaccttatgcaaaactgatcagatgcgtctagggatattctttcatgtgctgttctgaatagttgaacaatgggattatttgtattcaacatttctatcaaggatgcaacaatttgttcattagcatggaaagtgacacgggaagatgaagcaatattgatccggtttgagatctcatgttctatatcaaaaatatataattgcacatattctggacgttgaccttgtggtgggagcagagaaccaattcgatgacagacttgaccactaattttgaaaacatatggtgttcttccatcatttatggactcattaattttagctcccattgaagtaattgcaaacatgctattgtattgccgaatatgatcaaagaagtggttagaaagagtgctgttttgtgaggtcaataaatccaacaatggctgtggaggaggttggtagggtgacagccatattctccctcctttgcaacacaaattatatgatggatttgaagtatgtctctctctacgtgttcgctcctcataccaaaaaaaagcaccacagtggctacaagaatgatgtggaccaccaagattcaatggttcaaatatagtgcctgaaaggtgtgtcattggtatatgtgaaggaatctttatagcaaatggataccttaaagtggttagatcctaggagtagaaaagacaacttatgcctgtgattgaatgattgattggatgtagatgaaccaatatgaatatggggttcattttgtgctatatgattagaattagaagattcaccaattaaccgtgggcgtaatattcgttgatctgcagaggttgatgctagggaaaaatgatgaaattgataatgtgagtcatttttttcgtctgcataaaatgctgacaacttgtaggaatgttaatcttctaacaaacctttgttcctatttgcatcgataacttgcctacgcctacgtcgagattcagcagcaacagtttgattaggacgtgggatcgggatattagaaggctgctggcgtggtcgaccacgacgacgtataattagtcgagaagaacctgccgtattatccattctacccgagagcataaaccaaggaatcctataagtcgaaagaaataggtgtactataactgaataaaatcaaactgaacttatcttgtaaacaattgttgaacttacaaaaagataataggtcaaattgagcattcatcatcaagagtagaaacaaaagccgggggaaagcataagggagaagaggcacatactagatttatctttcctgaatgaaaatccacaggagccacataacaattcaaaaggaaggccgtcggtaccacataaacaaatacccttctgtagacatgagagattcaaactgatgaaaaaacctatcagaagatcattgtactccgaataaatccaataatatgtacctatgcaatggagattcagatgaaacgaagcagttggtgcaggtggattgcagaatttcattggcaatataagcgaagggccgcaatgatatcgccatggcgttatgagcaaacaaaattaatgtcttgatgacggtgatgaagtctggttttagtgggcggcggtcgttaagcttctctcggatatggaatcggaacggcgcgggaaaaggagaagcaaccgtcgttggggcggtgtgggtcgcaaaaccaaaggctgggtggcgctgnaggggcaaaggggggaggcgaagagtggcgcaagaggaggaggcgaagcggatcancgtggatgcggtgcggcgtggatgcggtgggggggttgggggggcggcggcgcgagatgcgggagaggggaggagcgatgcaggagaggggagtcgatgcgcgtgggccggtggagcagcgcgatgcgggagaggagaggaggggagcgatgcgcgagaggaggtggggctggcgagtagcgatgcgggagaggagaggagaggagcgatgcgggagaggaggtggggccggcgtgtagcgatgcgggagaggagaggagaggagcgatgcagaaggaaggaagcgctcgatgcttatccaacggtggggataaaaagggtgacgtggaagcaccaggaagcagagaattgtagtagtggggatgatttgtataggtatataggattatctttgttcaaacaaacatgttgatggaattaaattttaaaatacactgttcatttttatttttctcagaaatattgcaactctattggctgaaattagggatattaggcatatatatagaataacagagtctagctggtcgatcgtgacataatcctttatgctatcggttgagacattagttctactgtccttcaatctcgtaccatgtatgtaagtaaagccctcgtttgatcctatctttgctccatgatttaataatatagtgctacagtaaacatttgctaatgacagattaattaaccttaataaattcatcttgcggtttactgattgattctgtaattagtttttttattggtgcctgaatactctatgcgacaccctatataatacccgatgtgacacgccaaaactttacacccctagatctaaacaccacctaacttctacttattagcaaaataaattgttttctgtaccaaaagattgtactgataaatatggggtacatatatacctctgagcagagcaacttctcagagactgtaaagctactcacataaaccactggtcaactaatccatcacacatcatcatacaaatacaatatatagtacataccatctaatctagcctacagaacagttcataaaattctcttcactacaatatcattccatatcctttcagagtaaaaatattcgctgaaactaataataatcaacgtgccatataattgtctgaacaggcgaatgagctacagttgaacacgtatctattagcgaacaaagatgaacagtgaaaaccagtgaatcctccaagtcttattgatctcaaaatgtccccttttatagtggggatttacatatgcacaagcctaggatactcctaggaattaaggagcctaggatactcctaggaattaagggtgatttaagccactaaatatggatgattatgtgtcacaaattcaccatagtatggcggttacaagtcacttgattcctgccattgttgctctttgatgagcctttgatgagataaaaaatgtctcatgatgcttttgtaacactcccccttttgatcgagtccatcttgagatcaacttgttctttaattccttcgaaaaaccctgtggggaaaaaaaataggaataatgtgattggtgattactctatcagaaacctgaaaggtttaaggagtaatccatgccatgttttatctctagaaaaacccctgtgaggaaaacatgagataaggcataagcttgtatctaacattgtctcattaaaaactttgtatgagaaaaaccggatggtaaaaactcacaaaaggaaaaagagtacaatgtgatgtgtttcaacaaagtacatcattcagagagtctccccctgaagcttgcaagtctctgagtagtctcataccaattccccttaacacacctctcgaacgaagaagtaggtagggatttagtgaagagatccggcagatatcgcaagactttggctgtaagatgtttatttctccactttgctgaagctcatgcggataaaacaacttaggagcaatatgtttggtgatattgctcttgatgtagcctgtttgcatctgtgtaatataagcagcattgtcttcatagataatagtaggtgattctgatgaaccgatgccacaagattgctcaatgtggtttatcatcctgcggagccacacgcattcacgtgatgcttcaaacagtgcgatgatttctgaatgatttgtggaggtagccactaatgtttgtttagatgacttccacgatatggccgttcctccatggaggaatacaaagcctgtttgtgatctggcgttgtggggatcagacatatagctagcatcagtgtacccaaccaaactaggatcagcagttttctgaaagaataagccaagatccttagtgccatttaggtacctgaggatttgttttccgccggtccaatgacgcttagttggagcagcactatgtcttgctaatagattgactgcaaacgcaatgtctggtctagtactatttgcaagatacataagtgctccaatgagactgagatagggatattctggtcccaatatcccctctccttcctcccgtggccggaaaatgtctttttctttatcgagtgatcgaacaaccatgggggttttgtttggatgtgctttgtccatattgaatttctccaataatttctggacataggcagattggtgcactaaaatgattgagtgaaggtgctcgatttgcaaacctaagcaaaatctggttttacccaaatccttcatctcaaattccgccttaaggtggtggcgggcttcatcaatatcttgtgtgttgccaatgatattcaaatcatctacatacactgatatgatgcaaaatcctgtggaggatcttttgatgaatatgcaggggcaatcatctttgttggagtaacctttctgcagaaggtactcactcagtcagttataccacattctgcctgactgtttgagaccatagagtgatcttttgagctttacacaatacatcttgcgatttgcgcttccattcggtatagagatcccatcggggaccttcatatatatgtccgaatctagtgacccatataagtatgttgtcacgacatccatcaattgcatagatagacgattttgaattgccagtgaaatcaaatatcggaacgaaattccactagtgactggagaatatgtttcattgaaatcaatgatgggtctctgcgtgaacccttgtgctacaagcctcgccttatatctcaccacctcattgttctcattccgtttccggatgaaaacccatttgaaacccacggggaaggttttggaggtgtaggtattacttgtgagaatacctctcttttattgagggaggctaactctgcttcaattgcttccttctatttgttcagtccgagtgtttctaccttggattttggatctggatcattttggatggtatctgcaactgatgatgcaaagtatatgccgacaattgtagtcctacggttgaatgattctccagattcaacatagtttacggaaatttcatgcaccccagttgacggctcagtatttcccaatatgaccgcattggggcgttccaatgtcccatcatcaaaaattgagtgcactgttgatgtgggaagtgaatctgatgaatccacttggtgtctctcaacttgaggttgagtttcatttactgtatcagaggattctatcctttgtttcctcgtgcgcattcgaggatttgccgtacttctcccactcttttgaggaagggagttgaatagttttatttggtacctctattcttttcggcacattccttgcgggaatgtatgattttgtgactcttttactcacagtaaattagtctcacagtaaatgagtctggcaaattgtttgcagctacctgcaaatcaatgatctgtggtacgaagatcctcctttagggtgtttaaggcatccatatttatttccgggcattcagtgtgatacttgaattctccccctaatgcctggaaaaatgatcttcattgaagataaaatcagcgtatcgggccgtgagtaaatccccagtaaggggctctaggtatttaataatcgacggggataaatatcccacgtagatccccattttcctgtgaggacccattgatgtacgtttgggtggtgagatcggtacgtatacaatgcaaccgaattttcgcagatgggaaatattaggaggatcaccacgaaccaattgcaacggggaagttgtatggtatacagttaggcgcaattgtattaagtgaccagcgtgtaagactgcgtgaccccaacatgaggttggataggttacaattttgcaataatggtctggtaatgagttttattctcttgataagagattcgactaaaccattctgtgtgtgaacatacggtatagaatgttggactttaattcctaaagccatacaataatcattgaaagctttggaagaaaattctgccgcattgtccaatctgattgatttttatctggtgttcaggttgatctgctctaagtctgatgactagtgcaattaattttgcaaaggcatggttccgtgccgataagagacacatgggactatcttgtggatgcgtctattagaaccatgaaatacctaaatggcccagacaatgattgaatggggccacaaaagtcttcttgaatgcattcaagaaactttaatggctcagcctttactttgagatatgagggtctcaaaattaatttcccagttgcacatgaggtgcacacaaaatccgaggattctgggaattttctatcactcataccatgtccatcattccaatgccgggatgattcccataataatctatataatgtgaaatttaaattcataagaataaaagcaaaatatagaagaacacacatgaatatgtgtgattgttatatgtataaataggggtagcaacatcatgtctattattataatggttactcatgcaaaattaaacatagaagttatatggcgcctaattaagctctctataaatgtcgttggaagaatattccacgagcatgtcgtcgatgtccaaagagccttcctcttcatttgctggagtcttggttttgctcggttcccctccttcaggaatggggtccatagctccagtctccagcacatgagaggcaaagtgtgcttcatgcttttggttggtctgtgtatgacccacagacttcatgtatagatcaacaagatgtttaggggtcctgcatttcttagcaatatgattatagcaactacacctgtagcaggcggttttgttgccactatcattatttggcttcgaattgccttttcccttttgagcgttcccacgttgctttttgccctttcctgaggaatttccagtctgtgtattcccattgggaacttgtttcttctcattcgcatttacttcaggcaatggtgcagtgcccaacgggcgctggttcgagttccatacagtgagctcatggttcttttctgcctgtttcaatgtctgaataagtgaagagtagacagtgaaattcttctcacggtattgttgagtgatgatccgttttgatgggagcattgtagacagagtcttctcaattttctccgcttcagaaggttcattcttacaaaaccggagtttagagcatatcttatgaacagcatggttgtattcgtctatagttttaaaatcctgtagacgcaagtgattccactcgtgcgatgcctcagggaagataatcgccatatgctgttcataacgatttttcagagatgtccgtaaaactcgtgggtcctcctctaacatgtattccattttcaaatctgggtggatatgattccttattattcttaaggcagagaattttgacatgttagagggggggacggttccatctgctgtatcgtctatacatctgtatagtccattggttgacagactcactttgagatccatcgcccaaatagggaaattggaaccatcgagagcgagtatatcgaactctttggttgccatcttacctacattgtgatagccaaaattttgagaaattatggcatggttggaaaaataaaaataaaatagggcgagaataaatttgcaaagtaattgtataataaaagacatggaaatgcttaaacacacccatatattaacaatatcagagaagtacaaagtgctgatggcaaatgtaaaactctaattatttgctaaaatttaaatgaccaaaaggtcaagtactataatgtaaatgcagaaaatataaatattattgggtgatgggccgaaaataatgagtattttggccctccaccactgtaggtccatggaggcgaggagggatggcgcaggggttggcggcccatcagtggatggcaaatgggccggcctggccgccgcctcaagccaccgccgtcgccgcccgcaacggaggccgcccctgccgccgctaatgtggggcacagccaccgccgtcgggggccggcgcggctgggcgcagtcgccgccgcggaggccgtctccgtcgagcaccggcgtggctagagcacggccgtcgccgccgacggctcgccgccgccattgacgctgtgcagctgtggctgccatctccgccgaggactccccccgacgccgtggacgttggtcccgccgccgcgggatgcagcaaacgccggtgacgcccgcaccggcgccaccctgcaccctccgccctcccggaccctttactcccctttgctcaggccttccccttcacccaagggtgggggatggctaggcttgccgccaccgcttgtcttggccggggcatgcccggcttgatgatgcgacgggggttggggagcgatggggccagtggcgaggcggagctctcgccgaagccccctgctgccatgtagaacggtggggctctgtggcatgcagcaagggttcctctgaggaggaactccggcgggttggccggtgtcagtgtgtgcagcagtgtctccggtgtctccggcatgcagtccggtgatgatggtggagagatgacgcggcggagatgatgggtccagccatgatgagggcagaaggccgtcaccacgtccggcatgtccagctgcggtcgcacccatgcggtccacccatgggacgcacagtggtgcggtgcctctaccagaattctttctggcgctgagcacatgtccggcgttgctggagaccctcgacgagtggcgagggtactggagtcggtgctgccggctccggagttcctttgggcagcctcttcctccatgtccggcaaagccaggaggaggagacggggggccacggccggcattgccagcacgacggcccctgccgcgtcgtgtacgacgcacgggagcccgaaggatcgtctcgagctgttgcaagagacgacgaaggtggcgtgcacggaggttgcggggaagggaggagtcggcagtgaggggaacaggacgagccattcttaccacgcacgtgccggtgagtcttttcactcttctctcttggtagagctgctaataacgtattagagaacaaagatgaacagtgaaaaacagtgaatcctccaagtcttattgatctcaaaatgtccccttttatagtgtggatttacatatgcacaagcctaggatactcctaggaattaaggagcctaggatactcctaggaattaagggtgatttaagccactaaatatgactgattatgtgtcaaaaattcaccatagtatggcggttacaagtcacttgattcctaccattgttgctctttgatgagcctttgatgagatcaaaaatgtctcatgatgcttttgtaacagaatcatcagttatctcgcagtttgacgtttgtactccaattaactgatcgatcaaaacttgtgattggtttcaaacataatggctgctccatttcggcagaccgccaggcccatatgactgagggttgtgcctaccttggttatagtgagcctgtcgtcagtgacgaaccgggaatgacaggacaagtactgaaggtcaacactcctgtatgagccacacacagcatatttcacagaaatagagatggcacacggctataataaccatggtcctgatgtctccaaagcctcacacatatgatctccacaatattatccatgtatatatatatatgaaactatacaaacatcgacacttagcaagttatggtgcctaaacggtttgatgaagatgcgatccgagagcagtgaaacgaaatcataagtaaaggttcaccaacaataagttgaggaacatagtgtttttcaggacactaggttggacaacggtgagctatatatatacaccgtaggatcctttcctacagtttttgttaaaaaaaaatcagctctcagtcgcattaattcagctctcatcaattcagctcagcagggactgaaatttttgtgggaagaaacggaaccactgacgatatattagggccttgtttagtttcctaactttttcttcaaacttctaacttttccatcacatcgaaacttttctactcacaccaacttccaactttgttcctcaaacttccaatttcaattaaactttcaatttggtgcggaactaaatacggcctaggtcgcatgcatgcatgtggagaagatctcttctttgtccttaagaaatagtactaccaccttggccaacttgacaatgtaagaagcccgaggccaacacctacttctaaataacttgacaaagaactagtacaagccgctggagataattaacaggctcaaactcaaccatgttggacagaagatagctataatcagctaagcgttcatggcggcataagatgagcaaacgagaataagcatctacattgtcttgattctaatggattcttctttcttatttgcatatagagactgaacaatgaacaattgtatttcacatactcattttttcaatcaatggaaaaacgtaaaaccagcccatataaaattcactgtcttcgaagagatcacatgggagggtgcttttcctttcttttaatggaaaagagagttttattaaatgaataaatatttacatattaacttaggattttttctgtcgaacactagacgaggaattccccccatcgaactgtgttacagaatcaagcacagctagcaagaccgttaccaactccactgcactctctgctagccaattcagtttttacttttcacttaatttcaatagccacattgtcgccttaatttcaaccaatagataagtttcataaatactgcttgtcctgtgccttctttaatctttggtaccaacaagctacagtgaatgagattgttggaatttgaagctatttcaggagtaattgcaaaaactatgaattttgtttcttctaaatcgatcaaaacatctcgtaaaattcaccaagacgataaaaggtacctgacatgattatcacgaaccaaaacaactatgcttccattcaccatgacgatgtcatacaggcataaccataaccatgatcccgatgtctccaaagcctaacacatattatctctagcatagtatgatgaatgtggaaaacctatatatcataactgaagaattaatatgaattctttacaattgtttcactaaaatcaaattgtgttttgattattattttgtgatgaacaataggcatatgaaataattgattttgatatttggtggataattgacgaagtgggattggtttggtccagtcatactgcacagtggtggtcgatcagattggcgtatgttgtgcggtcagattggccagtctgacagtatgaccggctgattctgtctcggtgttggttttaggttgtttctttggatactcgtaattatctcgtgattatgatttctagatgatttctatgcgtatataatactgttatgtgacaatgttgagtaaagttgggaaagaacttgtgctgggatatggtttcttgttgattaatgtgtaagtgtgtcttgatgatgcagtagcactgccggtgatggatcgggaatcaacttgggagaaaataatgtccgaacgattagaatatcatacgggatgcttaggctaaagaacaatgcacgtggttgatagagattccatgtgacatacgatgggagattgcgtgcatatagaaagtgcagtcaaatttggaagtagtccaagtttgggaatattagagtttaaattgaaaagatataagtttgtttcttgtacgggaaggtttcctagtgaactaggacttcttataaagattggattcatggctttaggcagcttacctcacatataaatagagaggaggttaagacctctcggtattgttttttctaagagttgagtttagagtaaagttaaggtttcgagtttagtcgaattttgtgataggagtgttattgttgcactttgtaaatatgaatagaagcagtaaagtttaatctattttcaagagattttcagtttgtatttgctcgagtttggcggtcagaccggcgaatcatcggcggtcagaccgatggcatagcttcggtcagaccagcgacttccaggcagttggaccggtagcgactacaggcgacgacaactaggcagacggtcagaccgaagtgactacaccggtcaaattagaggcgtctatgcggtcagaccggtgcaacaactccagtcagagagatctgcatcggtttcgagggtagcttttagttcagttacatgttttcggtttttggtgtttctaccatttaccctagtaggcttagttcttgttgttttgaaccgtgacagcaacaatcttttctgggaggctgaataaagtacaacaaacacagaacatggacgacgaggtgaaattcaactatcctgaaggtatctgcaagcacagcgtgaccgcggcgatggctggggaggccacagacggtgtcccatggagggcacatcgtgtagctgccaccatcgtcaacaaagaactcgattgatgtgaaccgatccactcctggtgcaatgagttttgtgtcctatcgaagctccaggtctcttaacaatacataggatgcggcttccacactggtgcagttgatttattcggaagcatggcgatcctgttgcctcccaaccccagtatggtgcatgcagccagtcagatcctacaaatgaatcatatcactgtcagtttatatttgaaagtcaaaacacgaaatacattttaggggctagttaaaattgtgttacactcagtaatacttgctaactactccgtatgtaagatgattttgtagtttccactaccattgttggccaaactgacatggcatggttattggtgctgcacgtgaggatgtatatgattgaaatgcacaattttcacatgtatcatttttcacggtatctaaagcgtggaatagagatatttgaaccatttcctcaggcctccgttactttaataaatggattctatatcaagctatagctattgcattaaacaataaaagaaactaatagaaatcaaaggaatgggacagcagtaaattgagaggaagattcttctagttttcttgttcttggaaacattcataattcgagagctacaaaaggagatccatcgtttgcaatgaaaactacataaaaagagctctagaaaatttaaaaatcagtctaggtgtctttaacacttgcaaaaaagaatcattattggttgaccattgacttaacatttaactagttgtatatatcactattggtttgatacaaaggatggcaatgtttcaagtacgttaagaatatagatgtaggacaatttatctagaattacttaaaagcctatttcctatatcatatttatatctcatgaaattcttgagccgaaagacggatgcgtatgctatgtttcatttgctaaacgatatcaattgaaattgaatggtgtattaactccataaatcatatatagcaataaatatataagcaaaatcttttattttagttagaagaaaagtttcttccatgattgatacctccttcttccatgcattcaccatcaggtggcatgtcttgcagatgtttctataagagaaaggcttccattattttgagaaatggatacaattcaaatatagatattgcatttgcactaaagaagaatataagttttcttgttcctgaaaatattctatctcctagtcgctttagagaattgaaaattgtcatgccttttgattcttctactagtacttggaagaaagttatggaataaaaaaaaacttagacaatttaaaaatcaagcaagtgtattaatacatatgcgaaaaaaccattgttaacccatgattgtttggaagatttaacttgtataaatcatatcagtttgatacaaataatggcaattgtttcagtatgttaatggtacagatgtatccacgatttattttaagagctacttaatagcctacttctaataccatatctctgtcctgtgaaattcttgagccaaaagatagattgcatatgctatgtttcatttgctaaacgatatcaattaaatagtgcatcaactccataaattagcaaaattcttttattttagctagaagaaaagtttcttctccgatttatacctccttgttcccctgcatccgtaaacaagcatgtcaaatgaggattagtgtacttgagttttgcataggtcttttccaagctccccttctcagcctcaacccataaagatctgaaatataaaaaaaagcccaagtgaatgctgggatttgtagcatggacatgtatgctaatatgatttaaaaagcagaatatatttttttttaacaaaaaacgagaggcaggaggcttggctcatatattagtaggaatagaacgtttaggacattgtaatcccttaaatacgaggaaacaaatcagatctaatgattaatttaaaacggggaacatgaactattgttataattgcaaataagttagatggattgcaaataagtctagtaatccacctgcgtggtctaatcaattgaaggttgacaaaatgcatactggtatacaggacatttgttaagccaactatggacaggtattgagcaattaaaaaaatttcagtttggcaaaaattcaggaagttgtttctttaagttatgaaagttggctttgtaatctgacagattgtggaaatgcgacgttctagaggcattatcatttaccataaaatttttatttgccagaattatactaagaatttggcctatgaaatactccaagaaccaatataaatggttgtggaattttttagatgatataaatggttgtggatgtatagcccgaccttaactaatctgatccattgcattgaaaagagtggacagttcatgcacatgtgtgcatactgtaaaaaaaaaaacataactcttaatagggtacatgagacctttaaagcaatagttaaaaatacaataacaggctgtatgacaaatacaataacaggctggagtaaaaatacaataatagggtacatgagaccttaaaaaaaaacataacttaccaccctagttgtatgacaagtacaataacaggctgaagaaaaatatcgtacaattcaaattagagaggatattataatcttaaaaggtaaaaccaactatgatatttcaaaattataattcccatattaatcacataatatatctgagatttataataaatttatggaacatatgaatagttttttacacataaactggctgtgtagtttaatatctagtgatagcatatgtgtcccttttttaatggaaggcaccagagaatcaatggcatgttttccttttataaattggtcctttccttctttttttttctctttccaaatactaacgtgtaaagtaatggtgtacagagacagaattgaccttcagattgtcaaatagcctttgaccctcaaaggaaatagtcaaataggaaaataataccatcatatcatataagataaatggttccaatgaattgtagttcacctcaaaatgctcagcatagaacagaacaaaaaggcttgtaaaaataaactagtttcttactttgattcaggaaaatagtactcatcatcttttgagtaatctactttccaatcaagaaacttccctggaagtggcttagcagcacttaagggtatcaatgaagatttgacctgcataagaggagcattaggcagtttgttcttgtatagacaagaacttacaacagcattaactgtttaaggggaaaaacccacacctctattgtcaggatatcagactgctgtccgaaaacgaaacaaaaggatgtaatgtcgtcgaaggggatgtcaaccttcctacacagcttgtccttggacatttggaatataactgactttttgtggtagaagaacttaacaaatatgtcgcattcatttgtccgagcgaactaaatgtgttcaaaaccatgaacagaatcatcatgatcagcacataacagcaaacattttatagaaaaccaagagtacattcaggcatatatacctttttgttgccaatgtgaagtgccaggacaggcaatcttgttggctttatctggctgtgccattcaagctgatcttgtgcagttttgagttggcactcagaagtaaagccttgaccccactgcggtataagtctgagtctcatgaagttaagaaaaggttcatttaacttcagttcaagatcttcagctcgcagctcatctttcttatcatgtgcatcctctaatatttctcctctctgcagagttgttaataaaaagtttaaaaggcttaatgcgagtcaataggctgtaatgctcatgggacatgccaaatgaaaatgattttgagggaaacaaaaacctcagttagatgcgtgtggttgctgccaccacctggaccagatatttccattctgagatttggctagggcctaaactttgcaattatagatctacctgcaagaatggtcttgattttagatagaataatgtaaaatttacacaagataatgaagagtagtatgcccatccctatgtagaacaaatatagcatttagttgggaaaacaatctgcatttgttcatatcattgcagaatctttgaaatgtatacaaaaaggcatgattactgagatttatactctgaaaatgacattttagcttataatgtaggaaaactgactccatacgacgctaaacatgttattgcgaagcaattgaatggtttcaggatccaagaactggttttacaatcatgcgcactactagtatgcaggcacctagttcagccagatgagagaatgtggctactattttttttataaaggaagcttttattaatctcagacgattacatcaagttgatagaaccatataccattacatctatttgtgcttagaattagttgcattgtaccatagaattgtaccttatttctcctgttctctggcctacatctgcacacgtaatttgctgtgctgatgtcaagttgtctaatgttcaaagttatgttcaggatgctcacatgccttcatgttggtgttggtacagcaacatggaaattccactggcagcagctcagttcgtaactgtgaattggctgtcgaacgatgactttttctcggatatggttttctagtagcaaatctaattcttctatatataagttgcactgcgggggcatgaattgttcaagtcactacatacattatgatacatatacgccccaaattgaacagattagcacaagtatacgccctaaactatctgaacagaatttcgcccaaaattcaggcgagatcccgtcgaaaaataccaaatgcgtcttaaaacttgtcaaactagagccgaaacggcaaataaccacagattagcaagtgcacgcagtacacgtcctaaattacttcaatctaagaaccaaccataattgcagcgtgcctggtaatgtctgggccagaagaatgtaaaagcgacactgatcaaatagaagtatatagaacccgggggtgaaaaacctaagcacggaaacacggatataattccgcccttgcggtgagtacttccctccagccgatgaaccaatcaaagggaaccacagagaaattcgtcttacctccccgtaggatcggagagtggctcggtccgcggcggcgaagatgaggaggaggagagcagcaggtgcggtgtggcttgccgttcccggccacggtgtggcgagtggcgacggggtggggggagggaacgaagcggctgcggacggcgggcgcagccggtggggatgggaagggccctagggcggcggaggcggtggcggtggcgcggcgtagcggaagaggagaggtgacgcgcgggacgacgggacgagacgagacgagggagacagttcgtttatggtgtcttcttctcagcccactcccgtgcccagtggacggaggaggaaaacgggagcttcacgtgtaccgcggcgcaggcaaagccggactccaccgtgtttcttccccttctttccagctaggcaaattttgctagacaatttgatgatttcgtggttttagccgtagtacaccgctcgaactcacttttagggaataacactacataaacatggtaatttaccaatggacactgcaccgattaccataataattttcggttgaagagtaaagagaaatcgcttgaaatataaaaaaaaaatcgttgggcccacgtgtcagctcttctatctctcttctcttctcttatctctctatcttctctcccagaagataacgcggctgctggcctcctcgatcgagggcgcgcgcggggaggaggcggcaggcgggagtggagggggcagggaggtggaaggcggcggcgggtgtgtcgacgaaggaggccacgacgaggaagcgtcgggcgagcagtggcgaggccaggtggttgtggtggcgaagcggcacggggcagcgtcggtcgtggggaggaggagggagacgaaggacatcgcgtcgcttcgcgaggcgttcgccgcgccggtggatggggaggtggaggacttggatgttgcggcagcgaggtgtgacttctacggggtgttcgacgggcatggctgctcgcacgtggcggacgcgtgcagggagcggatgcacgagctcgtcgcggaggagatgggcgcgggggcggcgccgcgcgagccggcgtcttggacaggcgccatggagcggagttttgccaggatggatgccgaggtgattgccggctgccgagccgagagcggcagctgccggtgcaaggggtggaagtgcgaccacatggggtccaccacggtggtggccatcgtggaggagagccacgtcatcgtcgccaactgcggggactccagcgtcatgctccgccgcgacggcgcgcccgtgccggaggtgacggtgaccgataggtcggacggcaatgagtgcctcatcctcgccagcgacggcctctaggacgtcatcagcaatgaggtctcgtgcgaggtggcaataggagagaagagaagagagataggagagctgacacgtgggccaagagtatttttgacatttcacgtgatttttctctcctcttcaataagaaattattattctaatcggcgcggtgtgcattggcaaattactacgttcatgaagtgtttcccccaaaagtgagtccgggcggtgtcctacagctaaaaccacgaaatcgaagtgtccagtagcaaaatttgccttccaactaacctcttttccgcaatcgaagtgtcctgtagtaaaatttgccttccaactaacctcttttccgcacacgcgcacgtttactgaactattaaaaaattatgttttaaagatttttttaaaaaaaattgcttcaaaaaattatattaagctataaagaacctgtgtttgttattttttctttattgttctcgtttctttctttagagttgtaggctggttttttttttttatagttgccatcatttcggagattccatagtgcagtttgagtttgtcgtggaagcttcagaagccctccttttctctgagcaaggcaagtcatgctctcctttagcatattgaatcctaatttgtgaaaagtattttaattgaaattattgtattcactttattaaatttaccgagttataattgttttacttatcatttcctatatttccttcactcctagaaaaatcattttcgccgatgttagggttttctttcgcaggcgggtactgttggtaattcataacgtcacagatagaatccgcaagcgcacggattaccgaagtagcacttcccctatggagtattccaagggtatcgaatccaagggaacgtgtgtgattatctcttcctccggttcatccaaggacacaaagctaatgttggcaaagggcagagagaatttcctaatgagaaacagtgtctagggaaagcttaagtttaatcctaacgcaatacttcaggcaccggcaacccgctgttcccagatgatgctctactacgtacccgggcagggaggacttaagtgctcttgagggctgtcaccacctctacacccacctcaaacgtactgtgggatacgcagcaaccactggagattaattacccagacaccgcgtctatgcaattaataactactctagtgccgatcaaacactaaagtagtcactataaataaatggactatagtgaacaatgatcccgtatgctaattaggaactaaccaagaagtaattctcactaatcaaaccttaattactcagaatgatatttctattaaagcagagtaataaataagatacaaaagtaggaggagattaccgacaactccgggattcctccgattccttctatcttactctctccctattctaatatacaataaagtacactagagcctcttgtaattcagctcatgctttggtgtgtgtgaatgagggagaggagaagggtatttatagtgtggaggtgacttgagagagtggagatcctccaagcatccaatgagcatcttcatcctcctagtgccatgtgtccagctgatgacggttattcaggtaaagtcggtaactgccggcctgtgaagtttggggccgaacgacgcagctaggggttcggccgaaccacttggttcggccaaaccctttctggcccgttttgctccgaattttctcatgggctttggtggataaccccttagcccaaatgtacatgcaattggcccatttgaatgtgtttcattaggtttgtgggtccaaagctccataggctggaaaatggatgtttaattcacctcctcctccatgtatcttttgtctcaactttggtggttcgtcacctgcatccaaatatgcaccaacactcgtggaaatggttagaaataaaccctaccactacattagatgttttacttttatggttttatgcaggtattgacggcgttattttggcacttaacagccgtcaacaaaaccccccagacttagctctttactcgtcctgagtaaaggttatgtattaatgtggaataaaatttcccaagatataatacaagtacacaaattattctaagccatacttgtacctgtgaacttttcaagtgtctaacttaccaccttgagcaattgatgaatggaacggtcgtgactcaagtcctccttaatcctcctgtcaatctcttgggggtttttatatatttttgcaaagtagctatacttctcaaatgaccttctctcatatcactcatgtgaatttatttgtggatcctcaccaaggcatgtttgccgaattgtccctattctaagaggttgtataggtggggctcggtagggatcaatcggggcatacatgcatcacatatattgcaaagccaaaataccagacccaaggagataccaagtcatactctctgatcaagaatgtgcatgtgtgtgatatgtgcatgggtatgtgtatgtgtatagcaagttttgtggatggaaaaaggaaaataaaagataacaactcctttgatatacctcctcctctaattttttctctttggagatttaagagagtgcatggctatctcttttctttttttttcaatcatggcccatactttgtatgagcaagatttgttttttcatttttttctctttttttttatcaatgctccatacttgtatgagcaatactttttttttccttcttttgcatagccatgcctctctctatctctgtttttttctttgaaagaatttttggaggaaaaggcataaatgacatggagtatttattttgtggataatgaataaaataaataatggatgagggatgctagcttccagtgtagaagtttagcatagtgtgtgtatgtggagtgtgcgtgcgatcttgatcatggaagtatgaaaagcatctcacacgggtcacaataatttgac

SEQ ID NO: 67169 - DNA, 1798 bp, Oryza sativa
cccacctacggccggaacccccgggacatgcaggcaggactgagcccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtgaaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccaaagtgtccaggtgatatgaatatttcccaaagtctatagttgaaaaaccacctaatgttacctaattaaattgcgaagcatctacctaaaattaaactagtggtgccatgagtagagtgtccactagttgaggttttgtttattctagggtgaacaaggtaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgtagcgtctacacgaccaacggaaaagaaaaggcttttactctaataaactccatataacagcagaaacaaagcataaaaatgggttcttggcttcataaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagagaggggcgcgcggaccgggtccacgggagtggggcccacgcgtcagcctcatggtccacggtggaccgggcgcacgcggctgacgccggctggcgccgtgggtcccacgcgtcagccgtacccgcaggcgcgggcggctgacggccgggccccacctggcagccgcggggcgcgcccgaaggcggcctcgccggcacggccgacgggaggcggcgcgcccgcgcccctatggtcgccggcggcggccataggcacgcggagcggcggccgagagaggggagggaagggggaaacgaaatggcggtcctcggctcaccccgggtcgacggcgatgacgggaacggcgaccaaagcggagagaggcggcggcgcggctcgggtcgacgaggacggcggtgctccggcggttggcgggcgaaacggaggagtggacgaggtcgacgagaacgcggcgaagccgaaggaggcgatgccgaagcgggaggaggtacggggcgacgacggcggcgaaccggagctcggcgccgacggcggagagagaggacgacggcgcgagctcgaatccgacggggagagagtgcggcgagtggcggaaacggaggagagaggcacggggagcgtttaaatagcgtcgggagtgagagagggcggccggaggggaaggaatcggccgcggaaatctcgggctccatcaatggcgccggcgaggtttgcgggagcaaatccgaacgaatccgagggagagagagaggggaaagagggggaaaagagggagggaatcac

SEQ ID NO: 67170 - DNA, 15642 bp, Oryza sativa
aattcctgcagccccttctcaattattatttgtgctctgaaaattccactaaaatttatttacgcattttaggcttttaggaaatatacaaaaatcctccaagccttatttgacttttaaatttgcacattttaatttttggaggctttcacatgaattttaattattctcggcataattttgaggatgtattttagagtcgttttgggacgcgacaccggccgcacggcgagacgatgctcaatcacctccctagggaccccgggcatgtccgccggtctccaggcgaagacgttggcgtttgcccgcaggaaggagacgagcgcgtcttcctatttgttgtccagaagaccaccgattcgtgtggtcttggacgggccgtcgcccagggcaacctccttgactgggacctcgtcgcacgtgaccatccgctgccttggggcggccgggacggaggtgctgagcctctcgtcgccacccgcgggcttggacgccgcggcgagatggtccgcgcgctgctccatacaagcaagcgcgactttgaggtcgccatggtcggtgatggggccaccgggtcccggcatcttcatctgaagataggcgtagtggaccgccgacatgaacttcaccaacgcgggcctccccaggaccgcgttgtagggcagactgaggtccgccacatcgaagtccacccgctccgtgcggaagttggcggaatcaccgatggtgaccgggaggtcgatatgacccagcggccaggtgtgccccggcgtcacaccgatgatcggctgggacggccggagcaccatccctggggccttgatggcgtcaaaggctgcgggggaaaggatgttgagggctgcacccccgtctatgaggacacgccccaacttcacattgcaaatggtgggggaaaccaccatcgcgatctgtcctccccgggcaacgcacggcgggtggtcggtctgtgtcgcgaccgagaaaattgccttttcccgaacgctagtgtattaatccccgtctcaggaaaagccggggtacaccacacaaacatgatataaaagacacatctttattatatcgatagtatttacattattacagaggcgcttcaggcctggcgatcaaaaataaatagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggcggatgcacgattaatgcaagggggtacaaggggataataataggggttaagttttgcagtaaacagcatttaaaagtcacttagttgcccaaagccattttaaaaagacgatcctagagctacacagtattgttaatcaaggtcgtgaacccgcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacgtcttcctcacgtgtaaccacgtgccacataccaccacggtatacggacggaagacgtgacatagttcccaacccatcctagccatagacaagagtactgacccaaccccacctacggccggaacctccgggacaggtaggcaggattgagcccctagcagcaggacaccagccctgtgccatgacatctcgactaccgggccgcaactcgtgtagccttcatttgtcctagagatgtccatcgacccccgacttcgtccatctccatccgtgtacttttgtttataaccagactgagccacaaactaagccttacccactagacatgtggaagtacggtaatgctttgcaacagaggcccgaagaccggtccttatatggccgaggtgctactatcaaaaccatgcaccccgagcccagcctaaaaccattttggggattttgaatagagggggccgtgtgaatccaattccacaataaacaaacaattccaaagtgtccaggtgatatgaatatcccaaagtctagagctgtaaaatcacctaatgttacctagttaatcagcgaagcatctacctaaattcatactagtggaaccatgaatagagtacccactagctggggttttgtttattctagggtgaacaaggtaataataacaatagcaataataataaggtcataacaaaggtaaataggcatggctaaataaaacagtgctaaagcaggaatttaaataaagcgataatgcattaatttaaatcaaaataattttataaactgggattcaatatgctcaaggatgatatgacttgccttgctcagagagaacggccttccgaaccttcggcgacgaccacgaaccacgcttcgggaacctccggaacgacagaagctacgcgaagcacacaagcaaagctacaagcctataaagaagcaataacaatacataaagagaaaacacagggttctttaggttataacaaacattaggagacttgaacgggtcgattcagagttcgtatgaccaagatatgatcatccgaagtttaatgctgttatatggagatttgcggattattataattaggctttgcaaccataaaacatgtgtaagcgctagcctggaaaagacaggaaggctgcgccgttgacatgcggaccccacatgtcaacctaaaggaccgcggtagaccgggtacacagagacggtccacgggtcgacggaagcggactccgtgtgtcaaccgaggcgagtagccgacaaacggactccactagacaccacacgggctgcacacgtggaaaccacgcggctaccgagcggacacactaacacagtcaccacacgcacaagcgaacgactaccgacaccggtacacgggtaccggggtcgacaaccgcacaacgggtacggggcgacaccgaaaggacgaggacggggcagcgagaggacggatccttaccaccacgcgacgaggcgtgggaacgacaacgacgaacgggcgcggcggagacagacgggcacaacggagacgaacggcgaggggacggcttcggcggcgatccttggacgaaggcgagacgtggccggcacaaggcttgacgacgcggagccgaggacgaagacgacgacggggctgcagcggctcgcttgacgaacgcggacgacggacgagaacggctcgacggagggacgaacgccacgacgaccgggaacgacgagaggacgacgacgacgacgaccggggccggcgaggaagcgacgagggcagccggcagtggctgcacggagacggggacgacgtggaacacgccgctgcgatgacgatgacggaggcggcgccgcgagacgacgagccgggcgaccgacgggacgtcgacgacgagaacgaacggagacaacgacgatggaccgcggaggggttcggtcgaaggggaggcgaggccaagggcgaccttgccgctgcgatgccggaggtggtggtgccgcggctgactggtaaacaagcgaggaggaacgggcggccggaggactccggcgaggcgggtggaggggttggtggcgacacggcggtgttccggcgaaaccgaggtgtggccggggaaggagacgttgccacggcgtcgacgaaggagatggcgacgtcggccgacgctccgacgagggacagcagccggctggagggagtacagtggcaccaatgccactggttgccggcgggaacgcgtctccggtggtctccgcatgaaacggaggcgacgccggtggaggggaagcagctgcgacgctgctggcggcgacggcgcgaccggacgacgctccggcgaggagggagaggcggctggaggcggccggcggcacgggagagagaggacgacggcggggagaggcggggcggccacgagagagcgcgggagggggctaaaactggagaacgtaccgaggtggttccattttataagatgggggagggagccgggcacgggagagggcggaacggcgacgggaaacacggccggcggccatggaaggcggccgggaaagacgcgtccattcccgacgattgggggcgccattcaagggggaaattgggcgggattgaagaggaatcaatggggattaaaaccccctaaccaattttggaattggccaattgaatcaagcggatttggaggagagagcgagctagggttcgcacgggagagagagaagccgggcggaaggaaggagacgaccgggtgagtgggacccaccggtcgggcgcgcggcgtcagcgcgcgtgcggcgcgcgtgcgcacgcgggagggggagcggctcgggaggctgggtggggcggcttgggccgggcggcggcccaggcgggaggaggcgggagaaggtgggccgggaaagagaggagggaggggcagcccgggagagagaggggaggggaggaggcccaagaggaggagggagagaaggagagggagagaaagagagggaggagagggagactttgggctgggcttggcccaaaggaggaagaggatttatttttaggtttttctttttaataaactctaataattgtttttgttgcttaataattatttccggtactctgaaaattcaagtaaaatttgagggctccttttagaccaaggagaatttaacaaaaattctccgggccacattcgaatttttcttgtacgtattttagtgtttgccaatttcttttcgaattttaattaattctattattccttttagcgaatgatttttaattcgggatgaatttatcaggacgtgacagtctggtcgaaggtgagggcaacctccgaccaccgcgcccgccgcatcgcctcatgggtaggggccgcggccagaagctcgcgcttcatggccttgaggctccggcgagaagcgtgagcgcacgctcccccatcgacggtggcgacggtggcctcaggctcctggaaccccaggtcctcgtcgccatcgtcgatgtcctcggcggtggccttctgcttggcctcacctcgccggttgccggcgggagccgccggggccttgccctcacggcgctcctgcctcttctcctcctcccacttcctcgtccgttcagccaaacttttgaccgcgcggcagtccgcgaggtcgtggagggaggtgttgtgcacggtacaccacttgccggtcgggcgctccctgctaggagcgccggcctccttctttttgtcgctcgcaggcctccctttcggggggcccgcgaagcgccctcgacggcgaggacatgaccctcgtcgtcggaacgggccgaccccttcttcctcctcctgtcccgccgccctgaccgagcggcggacccgggggcggccggagctgccacaccagaaccgaaggagttccaggtccaggcctcctccttgcgagccacacggtccgcgagctcaaaaagctgcgcggtggtctggggctccttggaggcgatcttctcgagcatgcggttgtgccgcacgccccccctgaacacgtagatgtcacaccccgaagttttcctcccaagccaaaaattgaatttacaaatgaccccaagaaaatgcaggtgaaatcaggaaaaaaaccctaataaagtaatgcaaataataatcggattggacatgtggaatttttcttgagttctacatgtcaaaattcattaacaggatttttagtggaattttcagagctctagaaataattttaaccaattaaaattgagcaagcaatattgttaattccagggaaaatcctttttctttttctttttctttttcctctctttttcctccttcttgtcaaatgggccgtcggcccatttcccttttcctccccctcctctttgttgggccggccgcaggccgaggcccagcccggcagccggccgcccgcctccctcctctctcggggtcgccgacaggtggggcccacctgtcgggcccgtctcccacctcccgccgatcccggcgcgccgccgcgcccgcaaccgccgccgcgcccacgtctccgccttccccgggccacgtcgaccacgcccgcgcgtgcgccgcatcccccgcgcccgttcccctctctctcccgctcgcgcccgcgcccgagatggccgggattcgaaaaccgaatcccgcctctctctcctccccactcccccacgtcggccggcgaatcccgcctcttccggccacgtccggtcctctctccccctatttaagcatcgccggcaccccctctcgctttttccccatttcgccgacccctcccgagctcccaatcgtcctcgcgccgtgcaaccacccgccgccgccgtttttgctacttcggccgccgctagccgccgctaggctcgccgccgtcttgcgccgtcgccgccgttagattcgcggggtcgagatctacctcggccgccccttccccgttgaggttcgccgccggagacccatccccgtcgtgcgccagtgagtgacgccatggccgccgccttcggccggcgctctcgctctctcgcgctcttccctctccctctaatccctctccttttgttcattaggaggttccggagctcgtcccgccgtcgccatcgtcctccgtcgccgccgtcgtcgaccgttgtcggtgaggccctcctcctcgttttctctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccgtgcccgcgcgcccggccgcgagctcccaccgccgtccgatctacccttgggtagatcggggccgtcggttcggccgccacgtggcgccgccgccccttccatctcccgtgccgctgacagtgggcccgcgggccgacgcctcctctctcctccccgtgccgctgaccggtgggtcccgcatgtcggcgccgcactcccctgtgctgacgtcagccctggttaatattgcgcaataaatgatttaaggtttttcttttatagtaataaacacagtgaatcttctaaaaatcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgagatagtcgccgaggttcctccagcagcagagcaaggcaagtcatgcttgtcacttgatcatattgatcctatattgcaaatgctctattgttttctttcaaatgttgcattgttttataatattactatgggatggttacctattgttacagccatgtttttggatatcatgctcctttgttagcttggggttataacatgattagagtttggactaggaattgcttagccatgcttagttcaactagttcacaatggggaaaatcatattaatgtttagactgttggttctaatgataatgttggattagtaccaccgctctggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatgtggatagtttaggtggatggttgggcctgtcgcaacgtgggttagcgttggacggcggatgtttaatactgcttaattattacaaccgttttcgcattcaattcctgtttttaaatgccaatatttatgcaaatgaaccactttagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcaaggcttagctccagtttcttttgttttccgctgcatttctgtaagacttttatgatgtttgtaagacgtggatctgaatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccggaaaatggggatctgttcttgtggttcgagggaaaaatcttggtcgctcgtttaagcggggtttttcaaaacaagtcagtctagggttttagtaaaattattgggatttattcgtcagtcagttggggtttgatgggtgaaatgcattaggtcctagctctataacatgggttgcaaggtgtttatgcttcgtttgttattattaatatgtatctaatttctcattattttatcgttatgtgagtctgtcttatttattcgctctcatgcaaaatgatctatgcacgaaaatttcgcttttattcgtttcccttatttgagtcttttattgctttatttaaatttggatttgagcatgcattgatcctactcctttgtcttctctagatggccggtcacccacccaaccaccgcggagaaggcatgatcgacttcgtggcagagctggcacgcatgacactggtggtgggctatcccaacgcgccagagtacacgaccatcccaccgctcagtggcgagcttcctcaccgtgtccgcttggaggtccatggctacgtggggacttgcctcgctaacatggcggtcgaggcatctggaggcacagtagatcacgcctgtcaggaggcggcctacttgatgatggccaggttatgggagcgccacgactacatcttccacgacacggcgtaccgctaccaccctcgtcgagcccatggtgatggcgtcagctccttccgtccgacagctggcgagaacgacaccacctttggtcacatgtgtgctgtgatgaggggattggataggatgcactcggacctgcacaaggcgaccaaggccttgaacgatgggaagctcatgaggatcgtcgctctgaaggacgagatagcgcgcctgaagaaggagaatgctcagttgaagggtcttccagcgccaggaggagtccggatccgcactacgccccgtaagaggacgactgcacctgtgcgcatccagcttgcgcccaggaacccacctccagcagcagctcccgcagcacctccagttccgcccgcagttcctgcagctccagctccagctcccgcgttcactctctccttcgctccagcatcagccgccagaggtccagccagtggtaccggaggttggttgtctgctactcccagtggcagcggcgagactgatctgtcaggctccaggagtcgctcagagggaccgggtgacgagcaggaggacgccttcgactccaccgaccgcaggagccgttccgagcattaggctcgttttcccattagtttatcgattgtctagcttctgtttgttagtttgtgtgtttaggttgcttgtttggggtcagtcgacggtcgatatcatgtgcctatgatatggctgtcttaataaggatttttgcttgctcttttgagtgttttaattcagatcagaacaattgcagttttaattcctttgtaataaagcttagttcttgagcatctgtttttctccttttcccccgtctgcttttccctccagatggtctacaccaggactggcaaccgcacgacaggcgagggcagcaacggcgaagaacgcgccgatggtgtgcaccccaacagtgattctggcaatggtccgccaccacttcccgagaatccgacgcttgcccaagttatggcacatcagactcagatgatggcagccatgatgcagcagatgcagcagcagcaccagcaaatgcaccaaaggatgatgcagcacgccgaacagcagcatcaacagtttggtccccctccccctcagtccaagttgccagaatttctacgcgtcaggccacccaccttctccagcaccaccaaccctatggaggcgaacgactggctccatgcaatagagaagaagctgaatctcctgcagtgcaatgatcaggagaaggtcgctttcgccacacaccagcttcagggtcccgcgtcagcttggtgggacaaccacatggccacccgcccaccgggtactgaagtcacatgggcagagttctgccgtagcttcaggaaggcacaggtgccagatggggtcgtggcacaaaagaagagggaatttcgtgcactccatcagggcaaccggactgtgacagagtacctccacgagttcaatcgcctcgcgcgatatgcaccagaggatgtccgcaccgacgccgagaagcaggagaagttcatggcgggtttggatgacgagttgaccaaccaactgatatccggggactacgctgactttgaaaggctggttgacaaggcaatccgtcaggaggatcagcgcaacaaaatggacaggaaaagaaaggcggcgcagttccggtccaaccaaggtagtcagcaccgaccgcgcttcactcccggacagcagggtggacctaccaccatgatcgtccgtcagcaccgcccgttcaactccagcaacttccaccagggcactagtggcagtcagaaccaccagggaggccagcccaaccgcggtgcagctccacgcccaccaatggcaccggcacagtcaggccagcccgcgcaagccaagaaggagacgggagcaaaaccagggtcctgcttcaactgtggcgagcttggccacttcgctgacaaatgcccgaagcccaggcgtgccgggccaaggtttatccaggctcgtgtcaaccacgcgtctgcggaggaggcacaagcagcaccagaggtcgtactgggtacgttccctgttaactcaatccctgcaacagtactttttgattctggtgcaacgcattctttcatttcaaagaaatttgtggggaagtatgggttaaggaaagaagagcttagcacaccaatgagggttcataccccgggaaatagttcaacctcagtcagttttagcccttcagtgctaatagaaatccaaagatcaccatttctagccaacctcattcttctcgaatccaaagacctagatgtcattcttgggatggattggctgaccaagtttaagggggtcattgattgtgcgaatcgcacagtcaccttgaccaacgagaagggagaaaccgtagtgtacaaatcaccagactcaccaaagcaaggagtctccttgaatcaaattgaaacggaaatcccagtggacaccgtggagaagaacttgagaaaattggaagatatacccatagtctgcgagtatccggaagtgttccccgaagacctcactaccatgccacccaagagagagattgaattccggattgacttggcaccgggaaccgctccaatttacaagagaccatacaggatggcggccaacgaattagcagaggtcaagaagcaagttgatgagcagctgcagaaagggtacgtacgaccgagcacttcgccttggggcgctccggtcatatttgtggagaaaaaggataagacgaagaggatgtgcgtcgattatcgcgcacttaacgaggtcacaatcaagaataaatatcctttaccgcgaatcgacgatttatttgatcaactgaaaggagctaaagtgttctctaagatagacctgcgatcaggctaccaccagttgagaattcgggaagaggatattccgaagacggccttcaccactcggtacgggctatatgagtgcacggttatgtctttcagacttaccaacgcacccgcattcttcatgaatctgatgaacaaagtgttcatggaatttctggacaagtttgttgtggtgtttatcgacgacattcttatctattcaaagtccggagaagaacatgaacaacatctccgtctggtactcgaaaagttgaaggagcaccagctatacgccaagttcagcaagtgtgacttctggttgacggaagtcaaatttctgggtcatgtcattacagctcagggtgtggcagttgatccgtcgaacgtggagtcagttaccaaatggaccccacctaagaccgtgtcgcagattcgaagttttctaggactggcgggttattaccgccgattcatcgaaaatttctccagaatcgcccgacccatgactcagttgcttaagaaggatgagaagtttaaatggacagctgagtgcgataagagctttgaggagctcaagaagaaattagtatccgcaccagttttgattctgcccgacccgactaaggacttccaagtctattgtgatgcatcccgtcacggacttggatgtgtcctaatgcaggaaggcagagtggttgcgtatgcctcgcggcagttgcgtccacacgaaggaaattatcccactcatgacttggaattggcagcagtggttcatgctttgaagatctggaggcactatctgattggaaaccgctgcgaagtatatacggaccataagagtctgaaatacatcttcacccaaccggatctaaaccttcggcaacgaagatggttggaactaatcaaagactatgacatgagtattcactaccacccgggtaaagccaatgtggtggcagacgcattaagccggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagttagagccgctcaagtaaatgatccggaaatagcagagctgaaaaagaacatgagagtcggaaaggctcgggacttctttgaggatgagcatggcacaatctggatgggagaaagattgtgtgtacctgacgacaaggaattgaaggatctgatactcaccgaggctcatcagacccagtactccattcatccaggcagcaccaaaatgtatcaagacctcaaagaaaagttttggtgggtcagcatgaggagagaaatagctgaattcgtcgcactctgcgatgtttgccaacgagtgaaggcagagcaccaaagacccgcaggtttactccaacctcttcaaatcccggaatggaaatgggaggagattggaatggactttataacgggactgccccggacatcatcgggacatgattcaatctgggtagtcgtggatcgactcaccaaggtggctcactttataccagtacataccacctatacgggaaagagattggcagaattgtatctcgcaaggatcatgtgtttgcatggggtacccaagaagatagtatccgaccgaggtagtcagttcacctcaaagttttggcagaaactgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgaacgtcaactgttcggaacagaagtattagcggaagcagaagagaaagtcagaaccatcagggaaaggttgaggattgctcagtctcgacagaagagctacgcggataaccgccgaagggagctcacttttgaggccggagattacgtgtatcttcgtgtcactccgctccggggagtacaccgttttcagacgaaaggcaagttggcaccacgcttcgtgggaccatacaaaattttggaacgaagaggagaagttgcttatcagctagaacttccatccaacatgatcggcatccatgacgtgttccatgtgtcccaattaaagaagtgcttaagggtacctgaagaacaggctgattcggagcacattgatatccaagaggacctaacatatgtggagaagccggttcgtatacttgatactagcgaaaggagaaccagaaataaggtcaccaggttttgccgtgttcagtggagtcatcattcagaagaggaagcaacctgggaaagggaagatgagttgaaggccgcccatccgcacctcttcaccagctcctccgaatctcggggccgagattccgtttaaggggggtaggtttgtcacaccccgaagttttcctcccaagccaaaaattgaatttacaaatgaccccaagaaaatgcaggtgaaatcaggaaaaaaaccctaataaagtaatgcaaataataatcggattggacatgtggaatttttcttgagttctacatgtcaaaattcattaacaggatttttagtggaattttcagagctctagaaataattttaaccaattaaaattgagcaagcaatattgttaattccagggaaaatcctttttctttttctttttctttttcctctctttttcctccttcttgtcaaatgggccgtcggcccatttcccttttcctccccctcctctttgttgggccggccgcaggccgaggcccagcccggcagccggccgcccgcctccctcctctctcggggtcgccgacaggtggggcccacctgtcgggcccgtctcccacctcccgccgatcccggcgcgccgccgcgcccgcaaccgccgccgcgcccacgtctccgccttccccgggccacgtcgaccacgcccgcgcgtgcgccg

SEQ ID NO: 67171 - DNA, 2310 bp, Oryza sativa
gcggtcaaccagattcaccgtgattagtctcaccctagtgtaatcttttgaatgtggatagtttaggtggatggttgggcctgtcgcaacgtgggttagcgttggacggcggatgtttaatactgcttaattattacaaccgttttcgcattcaattcctgtttttaaatgccaatatttatgcaaatgaaccactttagctcttctttgttaattccctgcatcatacccctattccggtatgacttgctgagtacagtgggtagtactcagtcttgctctacttttctgtcacgcccagaaatttagcccaaatttccagactattttgtgtattaaatccctgtccaggaccagccagggtacacaaaacgacaagtaatatacagttccaaacgtaaataaagcgtaaaatacttacagaaaaggcacttagtcctcacaccgaaacaaaaacagcagcagcggaaaaaggcgatcctagcggggcttctgctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctgaactacagtgcattgggtcgatttattaagatgggactaatcacggtgaatctggttgaccgcccataaccgcgggcgcggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaactgccatgggtgcgactagcaaaaccatgcacccacagcccaccattcagttgcattttagttggataattacgaccatgaagcatggccaggtgtctcgagcacgcagctcactctgatactaaaaaggtctaatattgtaattatcccatcaactgagctagtagtaattaagcatggctaagcatatagttctagctaggtcacataagtaacatgagctagtcgatttattacccaatgttgacaaaggatagatatcaagtaaacatggcacaagcgagcagataggtaaaccctgatcccgtgtaattagcaaaacatgcatatttatttgcaaacagtaaaacatttataaattaggatcaaaatgctcaaggggaatgtgtgacttgccttgcttcttcactttgatcttccgaactcttttcctcgcgaccgcggacttccgaaacgacggaaactacacgctggcacgcaaaacgagaaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattattatcgaattattgcgcaattattaattatttttacaaaggaaaaggatctcgctgacgtcagcaaggggcagccggcgccgacacgcgggccccacacgtcagcggcactaagaaagggagagggggcggctggcaggcgggccccaccggcagcggctcaagggcgccggtccaccgtggaccgagaccaccgaggcggtccaccgtcggtccacgggaaccgacggcccggatcggcccaaagccgatcggacggccacgaggcggcgcggccgagaccgacccggccggccatggcacggcggctacgcgcacgcggccagacgaccaccggcgacggcagcgcgtcgcggtggcgggcatggggagcggcggatggggaa

SEQ ID NO: 67172 - DNA, 3302 bp, Oryza sativa
acgggaggcgacgggaacggcgttcgacgacgcccgaccacggtggagccgcggccgagggccggcaagacctagggaaaatattggagcggttagggagagaaataggcgaccggagcggtgaggagcggtggtttgagacgacaacggcggtagcggagctcgggtcgacggcggaaaggtggttgcggcgatgaaatggggaaacagagcagaggccgaggtagagcttggcacagcgttgccgacgacgcaaacgacgaggtgcggcgacgactaacgcggcagcagcggccggctgaagacggcggcggcggggaagagaggtggtgcacgaggcggcggtgttccagaggcggagaggggaaatggagtagaggccgggctgcggcacggcgccgcgaagccgacagtggtggcggattggcgcggcggtgggtggagcggcggaatcggccggccggagctcgccggaaagcggtggtgcacgggagcacggtggggaggtgtctagggagcgcggggtgctcggggagaggggaaaacggatgaagggaggcacgtgagtcgtttatataggtcccggagggggagaacgtggccgggagaggcggatttgaagggggaagaggcgccggcgatgtgggcgagtggggtggttcggcgccggttttggagggggaaagtgggggaggagagcggggtcgtgggcggcgaggtcccacggacaaacgcgcgcgcgcggggtggaggaggtgggcggaaacggcggcgacgtgggcggttttcggcggccatggcggcaacggcagctgccggcctgaggttggggatgaccccgacaggtggggccgcgggtcccacctgtcggccaaagaggagagggaggccggctggggaggcaaagtagacttcggggaggagagggccgagcggcgagctgggccgagggagagagagggcccgagagggggaggaatttgggccgagcccgaaagcaaggaaggggaaaaatattttcttttctttttattttaattggttaaatgaactttgtgactttaaaactatttctcgagctccgaaaattcacggaaaattccggagagtattttagggcacaaagaatattgcaaaatattcccggccaatgatttttaagggaaaattttaattctcccaataattcacttgattaaattgcttaactttttatttaatttctagaaaatgcattatttaatgatttttaatcccgaacgaaaatcggggcgttacaaatctaccccccttacaggaatctcgtcccgagattctgggatggctagaaagaaagctggtgtaggctgtcggtttgactgatctgacgggtctgcacactgcactgcccctttctatcttgaactgactgattgactgattgatccaacctgcaccattgaaatggctggattcgacctttctattcctttgctttgccaaaactaggccggctagttctgcttgaactgacccagaccagaactgtggctgctcacgaaacttacttatcttgatctgaactgttgatactggcagtttgataacctgacgattcaccaagctggctagagaagggtgaagttgttcctaagacttgcatctggcatttgtaactcattaatcctacgtccgcttgaacgggtcctggctcgaatgacacgtaattccaggaaacctgcttgacctgtcttttgtctgaactgcaaccgtccctgatgctgcttctcaaagctgagctattgacctggcctcaccggtgtacctcagaattcaatcagataacttgagattggtgtaactctgctgacaccttgcaactggcttcttcaagtactacccggattgttgcactgggttgaaccttcaactaaaacagcgacgaagtgagccaaaactcatctccgagacctaccccccttacagggagtagtcttactttctcctgactaggaacaattggactattgtccttgaaaaataaccaacacttctcttgcttacaaaggccctcactttgaaaactgaaacttcaccgattcatcaaaatagagtaatgacggcgcactttcatcccagcaagatttggaacttaatcctcagttgctgatgggagattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcgtacatcttccatggatagttggacactttgcaaaaactgctcttgaaaaccataaccactgtaggtagcatttgttgcctctgggattggtggtgacttagctgtgctggtctgctgaagacttggtggcgtactgtctgaggttgcaggtgcttcctctttgaaaacaaactggctttggctccgatcctgattccggcttgcatctgagtttgtacttgttgttggagacattgtcgttgcatctgccgctttggactctgcggttgctatatcaatatctggcacatccatcttccaatcttggttaaccagagcgaggtgctctgtcttagctggtagcttgttgtcttgaactgatccactgactctgactgcaacacactactgctggagttatttccgctacatttgactaggtatcgaacctgcttctcccacatcgaatacacccatctcctgatcttggacaccaaaagttgatcatgagcagggttcatctggcattggggcaccttgcagctttcaactaaaccattgatccgtggctttagtacaccgtcgttgctcttctctctaacactgaccatctgctgccagaacggaagagaggtggaagagaggggttgctaaagataaggtactaaaccacttgtctactgatctgttgtgagtagatttttatggtttaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaacttcacttgatcttcgcagaacgacgactctgaactgatcttctcgctccttgcacg

SEQ ID NO: 67173 - DNA, 6099 bp, Oryza sativa
cctgtgtcgcgccctatcttccgctgtttcccgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacagccgggcgcaaggccggtccggcagaaagtgcggcggcaggccccggaacgtcaagccttcatccgcgaggaggtggcgcaacttctggaggccgtattcatccgtgaggtcatccatccggagtggctggcgaacccggtcgtcgttcctaaggcgaacggcaagcttcggatgtgcatcgactacaccgaccttaacaaggcatgtcctaaggacccttaccccctgccatgcatagatcagattgtcgactccaccgcggggtgcgaccttttgtgttttctagatgcatactctggttatcatcagattcgcatggctagggaggatgaggaaaaaactgcattcattacccccataggaacttattgttatacaacaatgcctttcgggttaaagaatgcaggccctacttttcaacatactactcgaatttatttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttcttgggttcttggtctctgcccgaggcatcgaggccaaccccgagaagatacgagctatagagcggatgcgcccccccagcaagcttagggatgtgcagtgcatcaccggctgcatggccgccctaagtcgattcatatcgaggctgggagagaaggcactacccctatttaagctcctcaaacgctccgggccgtttacctggacggaggaggctgagcgggccttcactcagttgaaggcgtacctcagttctcccctggtcctggtcgccccggagccagatgagccgttgctactctacctagcggcaaccccgcaggtggtcagcgcggcgttggtcgtggagcgcgacgaggacaaccctcactccgcacatccccaccctgtgtcgactcgacccgggagagagcagggaggagaggcccccaagccgaacggcggcccaaggcccccgacggccggagctggccctccgcctgcttgtccgacggtgccaggcgcccccgacccccaggatggccccggggccactgcgggaaggccgcgcctgtcgccctctgaccccgaggtcatcagcacagaagccgagtgcgccccgcgtggcctctcggacgaagagcgccctggagatgcggcccctagcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggtcacggtggttacgacttaccccctcggccaaatcttgcataaccgagagggtactggacgggtggtgagatgggcaatcgaactctctgaattcgatttgcgctttgaaccacgccacgcgatcaagagcgaggccctcgccgactttgtggcggagtgaaccccagctcccgagcccgtctccgcccccgaggccacctcgggcccctcgcagctgcctcacaccgcctactgggtgatgcagttcgacggctccctgtctcttcagggcgtcggtgcgggggtcacgttgacctcgccgagcggagacgtcctcagatacctggtccgcctcgactttcgggcgaccaacaatatggcggagtacgagggactccttgcgggactcagagtggcagctgaactggggatccgccgcctcctggtgttaggcgactcccagttggtcattaaccaggtctgtaaggagtaccagtgctctgacccgcagatggacgcttacgtgcgccaggtgcggcgtacggagcgccatttcgacgggatagagcttcggcacgtgcccagacgggataacgcggtcgccgacgaactctcaaggctcgcttcctcgcgagcccagaccccaccgagcgcctttgaagaaaggcttgcccagccgtcggcgcgacccgaccccctaggggagacggacgcgcctgaatggcccccgaggcccgtcggagtccaggcctcaggacccgaggggagcgctcccagctcccctagattgattgcttggatcactgagatccaggcgtacctcgcagataagactctacctgaggatcgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgctagggtttctattggccgacggctctcaacgatgcggtcgacctggtccgacggtgcagggcgtgccagttccacgccaggcaaacccattagccggcccaggccctgcagaccatacctctttcgtggccgtttgctgtctgggggctcgatatcctgggtccgttcaggcgggccccgggcgggttcgagtatttgtatgtcgctgtcgacaagttcactaagtggcccgaggcttatccggtcatcaagatcgataagcactccgcgcttaaattcatgaggggcatcactgctcggtttggggtgcctaaccgtatcattacggataacggcacccagttcaccagtgagctcttcggtgactactgcgaagacatgggcatcaagctctgcttcgcctcccccgcccaccccagaagcaatggccaagtggagcgcgccaacgcggcaatcctcaagagcctcaaaaccaagaccttcaacatcctcaagaagcacggggactcgtggatcgaggagctgccagcggtgctctgggcgaaccgaaccacgccaagccgagcaaccggggaaacccctttcttcctcgtctacggcgcggaggcggtcctcccatctgagcacaccctgaggtcccctcgggtcactatgtattgtgaggctgatcaagatcagcttcgccgagacgaccttgactatttggaagagcgaagacggcgcgcggccctccgagccgcgcgctaccagcagagcctgcggcgctaccatcagcgccacgtccgggcccgatcactctgcgtcgacgacctcgtcctatgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcacttctacccctagtgggggtcgggtgtcatttcttgggctcgggccaaccccgcacccccccgggcgtgcagggttggccgggggctaccacatgcatatacttaccttttttctcttccgtatttcaataaaagcattttcgatttcctgaggactgtgtctgtgccatcgtttccttttgaagaatcttggcttgaattagcacactcgttcccgaccctgccctcggtggcccgggccggctaaaatcgccaaacggggcccagaaccgagccgtgccccggggcgtagtgaactccgggggggaatcggcaaaggcccacaatcgggtcatccataaccctcggtcaccgcgctcccggcctggccagtctcgacacgtggatcttcccaggcactagccccgacccgcgccgtttgaggctgggacctgggcacgagcccttgttcaagccaagacacagaaggaccgcggcacaggccatcctcgtctcatacacacaacaaacagaactgacgcagaaatttcttctttacttgattgcagaataaatcagtctatacaagaagggggcccgaaggcctcggaagaagaaggaaaagttattaagattggtgggggcctgggggctcactccgacgcgcccgggtcgccggcctcgtcgtcgctgtcgtccgcactgtcgtcaccgccctcctcgtcggagtcgagcgcgaacgcgagctgaggggccgtaccctcgaagctgtggacgatgtggtcggcggcgtcccggacctgcgcgcgcgcgccgtcctcggttccgggagggaactcttccagcgctgcccacggggagaagtcagggtccctggcctggtaacttgccagtacgagctccaccgccccccgggcgaggtctctcgaggatgacttgatcgtctcctcgagctcctcagggagccgcttgagggtcccggccatctctgagaggcgctgggcgaggcccccctggttggcggcgtacttcgcgtaccgcccgccccagaggcccgcctgccgcccggcgcagtctagacgggagacggcgtcccgaagcatgccgggccctacctcgctcgccaatcggagggcctcgacctccccggcggacgagtccagcgcgcccggcagctcggcgatggtgtgttcagcggctgcgaggcgggcggctaggtcgccgtcgcccgcggccgccccgccgctgtgcgctctcgcgtccagctccttcgcccgcgcctcgagctctgcggcccgctgatccagtgcggccctctcggcgcgggcgccttccagattgcggcgcgcctgctcctcccgcgctgcctcgcggaggaacaggctgtccgccagccgctgcgccgtagcctcggcctcctcgagagctcgcccccgctcggtgagctcgtcctcgcggaggcggagtgcggactcctcttcggcgcaggcggcctcgtgcgccgccagtgttgcttaccgggtggcgacagcggcctcgcggtccgccaggtctctctccttcgcgtccagggcgcgggcgcgctcctccagctccgtggcgcgagcctcaagggcctcttcgcgctgccgggacgccgcctcgttctccgccgcccgccgttcccgggcagcggcggcgtcgaggactccccgggcggcgatgagggcactctcccgctcctcctccacctccctggcgatctccgccaggtccctacgacgggcctcgagttgtgaggcgtgccggcggtgtgccttgcggcccgcctccaccatggcctccaccgagcgccgcccctcctcgacgcgcgcccacgccgcgtcgagctccgcccgctccgcctgcagggcctccatctgggcgcttcacccgtccagcaccgtgctgttcgcggcggccaaggcctgcaggaggggctccgcgctcagtggggcagcggaaggcagaggggagagccgcctcggtgtgggtgctgcgcggctcggcccgccgatcgacgtgccggactcgggggcgtcccccgaagctggctcgtcccaagcgtcgcccgaggggtcgggctcgagcggcgcgcccgcggcctcgtcgtgggtggcctcggaagtcgttgtcgcctcgggcggagtcgggtcgggggcttggcaggccgcctggcgtgcgcgcgccgcctctgcctcccggatggactccccggcccggcggagtctggcctcctcccgagcgacctcctcagcctggcgaacccggacggcctcctgggcagcctcctcggcttcccggaggcggtccgcggcttctcgcgggtcagcttcctgcctccgggcctccgcggtcgccgtctcctcggccacagaccggccggacttggaatggcgggggggggggggggggggcgacgggatctagctaaggcagaagaaaaaccagaagacaaaaagaaacgggtaagtgaaaactcgcct

SEQ ID NO: 67174 - DNA, 1052 bp, Oryza sativa
gtacggtgaaaaaccaccggaacagccggagagatgggcgcaccccgataaacatctcgcacaggtgcgcgaagatggccaacgtcattatcgcgttgggggtaaggtgcgccatctggagatcataaaactccagaatatccatgaaaaaaatagagaatggcgggaccagccccgccattgcaaaagagaggaagaagacggaccgccccgggtagtctggcgccgggcatcccttgcccagcgcgaccacctcccggccggtggcagattccggcatgaatcggcgcggcagcccggcctgcctctcgctcacgatgcaggaaggcggcagcacgctaccatcgagcagtgcggagccccgtgccatgacgccggcggaggaggagcttgagagcgagcgagtgcggcaagggtagggcacaggaaacgaagagttagagcgcaagtggcgaaggcaaggggaagagtggcgagaggaaggaaacgaatcccttcctcggcgtctttacacccttgccaacgctatgcccggctcctcgcttcccgcgcgcactacctcgccccctcgtttctcgcgcccacgcctccactaaccccactcgcccgtctgcggcgcacgcggcagatgtgcggccgtggcggttgagatggggcagatcgtgcgcgcattaactacgctcgccaaccgcggaaagcgccatcatcatgtctccaggcgaaacgaaccggctcgtcccgattcgcgcgctactcgaataatgtagcggtcttaaagaggccgctcattattgtcagtcggttttcccttgccgatgcgcgcgatttgcgaccgctgggtttctgcccgcctgtagggaccggccccacctgtcaccgggcctaaggagtggcgtcacgcccgagtgcttccctcgaggggcgcgatcgccctggcgtaatgccgggggctactgtcggtgacatggggccgggggtatcgtgactagaggcttgggtagccgcggtcacccacgtggcctgaccccctcgggggggggggggcgggcccg

SEQ ID NO: 67175 - DNA, 7082 bp, Oryza sativa
aaatcgactgcaaattgatatgcaagtttctatgcgggcctatcaaatgcagggttagccatctcatccggctacttatgggcaataatgtggcttaatttgtcgagacaaataatgtgtatttaatcagtgtgcaaattgatatgtaagtttttctataaatgtagggtcaggcgtctcatctgtactcggtagtttgattttggagtgtattttttacattttggactttttcaaacttattttacaaatatacccttaaaaatgtcatatttcgaaaatggatcattttcgcaacgccaacatcattgacgccgtttctcttgacttatcttcgctggagagactagagggacaacactaatgtttagtaccgtcatgttagaccatggtatcaatgacattgacgacatgaaaatgatttatttttagaataagctttttgaaaaatttatttgtaaaataagttttcacagtagaccaaaaagtgaaaaatcgagatattttggagtggtcatcatcactccctcgtcgctgtcgttgttgtcatcgttctttaatttcctgtcctttcacgaccatgtcagagaagataagaatacaatacatgcatatccagttactgatatgtacttggttcgattttggagtggtcatcatcactccattgccgctgtatttgttgtcatcgttttcttcgtgtcctttcatgatcatgtaaaaaagataagacttcctttgttaagggcttgtttagtctaaaaacttttcccaaaaacatcccatcaaatctttagacacatatataaaaccttaaatatagattaaaagaaaaaaataattacacaataattatatgtaaattgcgagacgaatcttttgagcctaattaggccatccatgattacccataaagtgctgcagtaatccacatgtgctaatgacggattaattaggctcaaaagattcgtttcgcggtttccagacgagttataaaattagtttttttcattcgtatctgaaaaccccttctgatatccggtcaaacatctgatgtgacatccaaaaatttttatttcaccgagtcctaaaatgtaccccttcatagtatcctactatgtacttcctctgtcaaaaaatcagtgtcaacttcatcatcggcccagtttctcgagggatatatagccattataggacatattgtatagtcaaaactgcattattggtgatatgtgacgcatgacgcatggctacatatcactaataatttagctcagtttgacaagacggatatcgcgtatttaaatcgagtgtaacttgatatgcaattctagctatgcaggcctctcaaatgtttgccaagaagtagtaaagattaatttactatcagaatactcttacaatattagagtacacggccatagaaaacggccacatcaaccaatgtacccatgccatcgctgccgctatcagctctacatataggattctccccctctttctggtggagaaatgatctttgctaggtcgatccaaaaccataatagtctcgattccaaaaaaaaccgggattaaaaatgatctttagtcccggttaaagatcctactaaaaatgtcagatgtatgtcgggggccgaggatctttagtcctggttggtgtcacgccaactgggactaaagatcaccactttagtcttggttggtaataccaaccgggactaaagatcatctagactctcggttggtattaccaaccagaactaaaattaaacgcgtaatatataatccctatcacttatcctctcctctacaatcgcaactcacacagatcaactctctccccctcttccctttcctcctcctctcctctcctacagtctatcctctcttcctcatcccctctcctccacctcctgcccttcctcctctcctccccctcctccccttcccatccggcgggccggcggccgtggcgagcagtggcagcggctttgtttgtctttttttatataatctgtgattcactaagatgtttaaatttgtgattcaatgcatggatctgagatgtataatctgtaatgtatttgatttgtgtgtaattttttaggatttgtgatgtatttgatttttgtgtataagtaactttaagatttatgatgtagatttgggatgttacattgatttggggatttagggtttgatttgatttggggatttggggtatgatttagggatatgcatgccacttgattcgggagaaaataaaaaaagaaaaaaaagaaaaggggatcatctggtactgccgctattctttctttactctcggttgataacatcaaccgggactaaagatccctctctttagtccggttggtccatctttagtcttggattcctattccggttggaaaaccgagactaaaagggttactaaccgggagtaaaaatagtttccacctatatataaagtaaaatatatgactgattcaatatgtcatctgaggtccaacgtgtaacgatcgatcgaatcgccatcgtagcacccactgtggcgagaaatttgtatttagacccctcgtgctatataatatgccttcaagtcaacttccaaacactcccagaccttttgagaaaaaaaattcaaaaatatacttttttttcattggttttatataaatatacaggtttagaaagaaattatagaaatctaatcgtcacgaaagaaagttcaaaatcgcgtgttgccgcacgacttgcgcgagaccgctcagtctcgcgcgcgtctcctgtgtgcaagaccggacttcgcttccctaacctttgattaataaattaattaattagtgtcattagcatttaattaattaatagtaatattttttaataaacatcattagtaattaattaatcggtaattgtctgttaattatccactaatcatgatgccagttgccaggccatctcgcgagcggatgaagcgagaccgtgactggacctacggtatcgcggcaggatttggcgagaccgcggcacggcgtcacgccattgtaattttcgctgaatggatatcgttttgatttcgtactccgacaacggtatatttgttataaaaaatttagggtaattgtgttcttgttcttgctttacagttgaattgtgattttacccctactttttagggtttatgattttgtcctatctttttgaaatgaaggagtggagtgcccctattatgttaaaatttgctaacggtgttacatgggcgacacaacgacgagtatacctcttgtgcaaatatgtgttcacttgtgtatttacccgttttgagttcagctttgaacggaactttacaaatgtttcgaagtgaactttgctatacttggaatttataaaaagtttgactatatttcagcaatagcttaacaaatatcacaaaatttcaacaggattccaacatgatttcagcaatgattagacaagatttcatttcacaaaatttcaacatactttgaaaaaagagatctcactgaatttcaacacaatgttagctagcatcacaaagtccagcagcaccacctgtggtcgtccctgagctccccttcgcgccggaccacactggcctgcggtcgccgccgcgcctcccttcgtgccggccagtggtcgctgccgccacgctggcccgcggtcgccgtctcgcctcctgcgcaccggccagcactccttgccgccgcacaggcccgcggtcgccgcctcgcctcctgcacgtcggccagcggtcaccgccgccgcgctggaccgccgtcgccgtctcgcctcctgcgcaccggccagaggtcttcgccgcctcgcctcctgcgcgtcggcctgcggtcgccgccgccgcgctagcccgcggtcgccgtctcgcctccaacgtgctcgccagtggtcgccgccgctgccaccggttgaatggtcatgttgctgcgccatcgccaccactcgctaggccatgctggatggggaaatacacagcttcaacccgatacacacagctgcttagtgatttactactcaccatgggtataacagtcattgagaaattgcaatatcattttttattttcttttccctttgtttaactcaaaaattccgggcccacctaactcccgtcaaaaccaggggcaaaaggctgctcatttcgaaaaagcaggggcaaaagcacaaaccctaaaaaataggggtaaaatcacaattagatcgcaaagcaagaacaagaacgcaatagctccaaaaaatttacatctccgatatttatgagaaaagaaggccttgtttaattccaaactttttttttcaaacttccaacttttccatcacatcaaaactttcctacacaaataaacttccaacttttccatcacatcgttccaatttcaaccaaacttccaattttagcgtgaactaaacacacccgaagtaaatgaatagaatatttgtagatttactttcatcttttgatgcatgacttgagctataaatttttcagacgttgagaaatgcatatgtgttgattagggatgataggagttgatttttttaggaagtagcagttaattttgagggcataacttcgcaaatagaccaagtgtaaaattcttattaccgtggactgtcacttgagctgcgtcatttaaactttagatcttgagttatacattgaagcaagagatgggtgaaaaggacagtattcatccgagcttaagcaccaacaatgtattttacccatataattgttgggaattgataggctagtgcgaagtggatgaaggatagtgattctaggtaaatcgagactaagaagggttgaaaggactgatactaaagatacatactaagccaaaataatatgtgagatgttgcattcgaactcaaaatctttcaccttagccctcacgcacattaccatctcacctactacacacatctaacttgaatatagatgtttttcttttaaactaactctgaagatatctttactaccatttggtaacatcaaccggttttagaaatatctttagtacgggttgttgttttcaaccgatacaaaaaatgcatctttaatgctggatagtaattaacatcaaccaaactaaagatcatccaacattagtctcggttggtactaccaaccggtactaaagatatattttttattggttgataacaccaaccgagattagagatgtttatagcgatttggacttttagaaacggtactaccggtacttaatctagttgaaatatttatgttttggggctttggataaaaactcgtttgtcaagtagtgactatagtcttctaaaggggtatacatacaaaacaacgtacatattatagtcaacgcataaccacacgcacctgctgagtacacaccaaactggaatttcatatgtacaaaattaaaagaaaggagagaatatggtacttagagtatcacttctgtcttagtctcgtcataaatgtcatcggttgtaactttctgacgtcggaagaaaaggttagtgtctatactagttactaccatattcgtctcataatataagggtttttagcgttggatacggttattaagaaagttggtagaattaaacgagagaatgttgtgattgaatgggatgtgaaggtagatggaaaaattaaatagtggagggttgtgattggttgggaagagaatactagagaagaaattgttatattttggaaaaattttgaaggctaaaagttattatattttggaagggagggagtacctcggtttcatattataatacactttcatttttccctaaataaaatttctataaatttaatcttttttcacgaacgcgtaaaataattgcacgtcaatatattaaacgaatctataaaattaatcaagtttatagtgaaatctaacaactcttaaaacatcaaattagatccattaaatctaatattaaatatattttgatagcatgtttgtttgctgttgaaaatattatcatgtttttctgtaaacttaatcaaaattatataaatttgacttagaaaaaaagttaaagctcttacgaaatgaagggtgtacatgtttgggctttggacaactacatctgtatataagtttgccctcaaatctgagtttaagtgcaccaccttgtggccctccagcgcgcgcatatatatatatatataccagcctttcccacatagatcatccaaccaatagctaaccacgaaagtgcaagtgagactaaccttgtacctgtagtgagtactggtgatgatggctgcgagtaacggagaggaacctcctagcacatccatggcaacaagttcttctccattgcccatggtcgctcaactgatggtcaccacagaccgtgctgtaagccagcagctgaaggatctagtgaataaggaaaactccactaccatggtggcggcgttgtccttaagtagagaggcttatgaggtggcgatggcgttgaagaacggggaggagcatcggcaagggagatgcagcggcaagggagatgcagcggcaatgttgatgatgatggcgtccaaaaaagaagacgccgcaaagccttccactgcgtccatgaaccccctgttgctatcactagcatcgcagggtcgtctaaatgattatggtagtattctttccttacagagattaagatttactaaacggtgtgtttcatatgaaatatatatatatatatatatatatatatatattgctttaaaatattaaatatatctatttgttaagttttcaataattaaaacttaattaatcgtgtgttaatatattctgaacatggaagcaatatatagctgctgctcgagcatttcctaatgatctccaacgggactcttcgggtaatggatctaataataactaggcgattcccatgctctgaggaattttatactttatagttcttgagaaagtatcttgagatatctaaattttatgttcttgagaaagtatcttgagatatctaaattttatgaaaaattttttagtaccttagtagctagtacctataggtac

SEQ ID NO: 67176 - DNA, 9471 bp, Oryza sativa
ataaaaaactaaataatttcccatgctttgatatggaatatatggatgaatcactagaacggtaaccaccatctcaatcaggcggcaacccccatctcagtcggacatggcgtccgtcacagcctagaaatcacagatgtgaaaagttatctcaatcggacaaacggctgtcactaatgaagctatctcaatcaggcctcaattaaagcccgtcactgatagccttgaaccagacgaccagtcaaactatagcccatcacggctgacctatctcaatcgggccacaactagcaaatatctcttatttggtttataaactataaaatagatatgtaaaatttgtgaacaatgttactaacactttgtctgacgaagaaatgaaaaaaataaaaattatagatcttgatgagttatacaactttgttgttgatgactttttagttgaaatcatttagtatttgaaaatgttgtttgaagttgtcatattttcaaattcaaattcaaactgttcaaaaaaaaagttatatagaaaaataaccaaaataaaagttatagatcttgataagttatacaaatttgttgttgatgacttttttagttgaaatcatttagtatttgaaaatgttgttttgaagttgttatattttgaaattcaaattcaaactattcaaaaagagttatatagaaaaatgaccaaaataaaagttctaaatcttgataagttatacaagtttgttgttgacaatttttccatttgaaatcatttactacccgaaaaaataataaaatgaattattatactgcagttaattattttgatataggtcaactcacaaatataaacatttcatatgaaaaatggaaaaatactaagtcatattaatcgggcattactatagttaacggatgagtcatgtgtgacaggcctaattattatcgattgagatatggtcgcacgtacatgttagatgggcataaaaatcaggcccgccactgatgacctctatcagtgacaggccgtagtttaggcccgattgagataacgatccatatctcaatcgggtctcaagttggcgcccgtcacggatgatcatcaagtttagccccgatagagataatgttccatttctcaaacttgaggcccgattgagctatggaacgttatttcaatcgggcctaaattacggcccgtcactgataggtgtcatccgtgacgagcctgagttttatgcccatttaatatgtctatgcgactatatcttaatcggacactttttcggcccgattgagatgactttctagtgacggcctactaattctaggcatgttagagaccgtcacagatgaaaggttttgtactagtgaatatacatgtcaagtattataaaaatgatgactatatatgttaaaatattttagaaatgatgtgagaggtgatgatgattggatatgtttacatgttgatttatagaatttaataaattataaatgatattgtatgtatgcattagcttttttataactaatattattgctagtagataataatgtggtatctttatatattatgtttaatatttagtgagttataactctggaaggtatagatatgacgacgcagcaagcttctggtgcagatgcagagtcgggcatggatctggacggggtcaccactgaagggaacactgcactccatgttgtggccacctgcggtgatggcccgggctacttgaggagtgcaggcgtcatctacagcaggtcccaacatctcatgttagtgcagaacaacaacggtgacacacctctgcactgcgctgtccgggctggccattccaaaatggttgatcatctaattgatctggttgaaactaaggacaactcccctagcagcgcgagactggaggaactcctgagaaaggaaaactgccgtaaggagacggcctttcatgatgccgtctgcattggaaataaggatataatcaccaaccttcttaaatattattcagaattggccggcttccttatggatgcaacaggtacttcaccgttgtacctagctgtcttgcatcaacaggtcgacattgcaaagttattgcatcaaatgacagacgggaatctttcgtactctggcccaaatagacaaaatgcattgcacgcagccgttctacaagaccaaggtacgtgtgcaatttatatttgctgttttgaatttcattctagctatattccatacttattttgaatcatatatttgcttttatcataaagcgacaacttaatttgttttataagtttataggtcaatatgtcatacacaaatgcaaaactcatgcttttgcaagttggggcccacaatgcaagtcatacgcacatatatagtgggaaatatttgtagctttctaataaaaataaaatggtttgctatcgtgtcaatttcgttgaaagtatataagattgattgagcgagagagattgagcgagagagagaattgaacgcaatagagcgaatgagcggatgtcctttattgatcaatgcggtacaatttatagataggaaatgggtgctaaggagtgcctagggaagaggggggtgctaatgggcgggtgatcgctctccgtccccctatactctactctttcccttcctcctccccttcttctcttcctactacaccataaatttaaaaaaaataaaaaaataaagttggaaaaatttatgtatagaaaatactatatataaaaatatttgaatttaaattcaaatttgaaatgggtatgtaaacttttgacttataaactttgggtctataaactaatatttgaattcaaattcaaatttgaatcgggtatgtaaacttttgactcataaactttgggtctataaactttaggtgtataaactttagatgtaaagaaatactatatataaaaaatatttgaattcaagttcaaatttgaatcggatataatttaaattcaaatttgaatcgggtatataaacttttgaattataaactttaggtctataaactttagatgtacagaaatattatatataaaatatatttgaattcaaattcaaatttgaatctgatgtataaacttttgacttataaactttgggtctctaaactttaagtgtataaactttagatgtgtaaacttgaggtgtacaaactttaggtgcataaatttactaaaataggaaagtaatgcggtgccaaaaaaggaacccacgtggaggagggggagggggatcggatctgatcgccctgagcgagcaatcgcctagtagcaattccgtagggaagaggcgtggttgccttcggttgcgatcaatccttttatatggatgagatcaccctattgtttcataatactctcccttgatcgaatccagctttgatcattgctctttcattgttccagaatatttgtaaacataatcttagaaataattataatttattgtattagatacatcaggtaaactcctcaaaaacccattgggaaaataaggagaagaaccgtgatatatagttaactatttttagactttatgagtaaagctcatagtatggtccaaaattagtataatgtctatagttatcatttagtaaaaaccctagtggggaaaagcaaaatgataagacatataacttatgttgatattacctcgttaaaaactttggatgagaaaatataaagggtaaaactcatacaaaggaaaaatagtataatatgacgaaaataggttatttcccagagagagttactccccctcaatcctgcaaatttttaagtcatctcataccaattccttcgacacatttaaaaaatatggagtatggcagagattttatgaataaatcagcgagattatcacatgacttagtttgcaagatgtttatctctccatgttgctgaagctcatgaggataaaataatttaggagcaatattcttagtgatgttgctcttaatataaccagtttccatctaaacaacacaagcggcattatcttcatagataatggtaggtgattctaatgaaccaataccacaagatgttaatatgtggttaatcattctgtgaagccataaacattcacgtgatgcctcatataatgcaattatttcaaaatgatttgtggaagtggctaccagtgtctgtttagaagacttccatgaaatagcagttccaccttgtaaaagtacgaatcctgtttgtgatttggcattgtagggatcagatagatagccagcatcagtatacccaattaaggtcgaatcttggttctttttaaagaaaagtctaagatctcttgtgctattaagatatcgaaagacattcttaactctagtcgaatggcgtttggtaggagcagcgatatatcttgctaatagatttaccgagaaagcaatatttggcctcgtactatttgcaagatacataagtgcgccaatagcactaagatatggaaaatcaggtccaagcacatcctcaccatcttcctttggtctaaatgggactttctccacgtctagagatcgaaccaccataagggttttggaaagatatgacttgtccatatattgaatttctccaaaattttctaggtatatgcactttggtgcacaaggattccagaaggtaaatgctcaagttgtatacctaagcaaaatttggtttgacccaaattcttcatctcaaattccgtctttaaatgatgacgtgcttcattaatatcttgtgtattgccaatgatgttaagatcatcgacatataccgagataatacaaaatcctgtgggggactttttgataaggacacatgggcaatcatcatttttagtgtatctctttagtgaaaggaatttacttaatcggttgtaccacatcctgcccgattgttttaagccacaaagtgacttctgcaacttaacacaatacatgttacgatttaccttctgattcggcatgtcgattccgtcaggaaccttcatgtaaatattagaatcaagtgatccataaaggtatgctgtcactacgtccatcaactgcataaatagacgattttgtactatcaatgatattaaatatcggaaagttataccacccataactggagagtaagtttagttgaaatcaacgccatgtttttgcgtaaaactttgtgctacaagccttgctttatatctcaccacctcattgttttcattccgtttccagacgaaaacccatttgtatcccacaggaaagataccacgaggagtaggcattacagccgagaatacatctcttttgtaaagcgaggctaattctgcgtcagttgcgtccttccatttgttccagtcagagcgcttttggcactcttttatagacctaggttctggatcaacttgcaggcaatcagcaatttattcagaaaaattaatgtcaacaattgtagctcttctatcaaaagattctccagtttccgagtagttgatggcaatttcatcaacccttatagactcattgtgatttcccaaaacaatgtgtctatggtcttctgaattcctagtctcagcattatgcacaactgggctaggttgcagattatcacgatctgcttgatacatagtatcaatttggtgtgtaccaacttaaggttggtttgcatttattgtctttcttttcttgctagcaactgtatctcgctgagtggccaaacttcttcctctctttttagtgagtggaagttgagtggttttatttggtacctccactctttctagcgcattctgagcaggaatgaaagatttagtaacacctttataattagtaaatgcatctggcaggttatttgcaagtctttgcaaatgtataatttcctaaacttgaagttcagtttcagtagtgcgtgggtgtgaggctggaataccctgggcatcccaatcaatttcctgtcattctttctggtacttgaagtctcccgctaatgccgggaaattttcctcatcaaagatagagtcagcgaaccgggcagtaaatagatcacctattaagggttttaaatactttatgatcgacggagatttaaatcccacatagatccccactttcctgtgtgggcccatagcggtacgatgtggtggtgagatcagtatgtatacaatacaaccgaacttacacaaatgggaaatacttggaggatttccacgtactaactgcattggggaagtttcacgatatgcagtttcctcaatgcagttggtcgtagttggacaaggtcagcagtgtgcagaactacatgaccacaacacaacgaaggtaatttgcagtttatcaataatggtcgggcaataagcttaattctttagatcaatgattcagccaaaccattttgtgtgtggacatatggaacagagtgttgaacctgaattcccaatgccatacaataatcatcgaaagcatgagatgtaaattcggcagcgttgtctatacggattgattgaatcctatgttcaggataatttcccttcagccttataatttgagacattagtttggcaaaggcatggtttcgtgtcgatagaagacacacatgagaccatctagtagatgcgtcaatcaaaaccataaagtacctgaacggtctagatcttggcaccatagggccacagatatctccttgaatgcgttcaaggaatttaagtggttcggctctaattttgagataagatggtctcaaaatcagtttcccagtagcacatgctgtgcatacgaaatcagagtatttgggaaatttgtcagtgatcaaatgatgaccaatagaattgtcaataatttttctcaccatcccgataccgggtgctcaagtcgatcatgccaagtgtggaatgcatcaacattttaaaaaatcactttgtacacaacatgtgcaatgggcttaatgtatgtatagtacaatcccaatgtgagagatggaattttctcgcaaatgcgtttgccatatcccttttgtttggttaagagaagaaattcttctcgattatgcatatgggtttcaatgtgaaacccaatttgacggatatctctataacttagtagggtatgggttgaatcaggatacaataaagcatcctcgattgtaatttgtgtatccattgggagtgtaatagttgctcgtcctgagccaaatatcacagtatcgcgcccagcgatagtcaaaactttgccttctctctttttgagagcttgaaagtatttgatctccctaagtatagagtttgtggtaccactgtccacaagacataattcatctccaatcggagtcatatccttagacatctatagtgaaagaagaattgcttagtgaagaattctttatccacaatatatacatacatacaataattaaaacatcaaatacatagtatgatgtttacaaatgttataagtacatactctaatgactagcaagtcttacaaccttataatataagggagtttgtacttatctacttattacaaccaatattgttttgacaaactataggatatcaatataatgtctcaaacacactgagattaaagcagctttatctctaagtggggtgcactgcgatcatagtaaatctccaactgggtccgttgagcagtactcgatgagcatgtcatccattgcagaaagtgccgcggtatcctctaggagaagagcgaggttgttctctggttcaataggagcctggtgagaactttcaatctcaggtttttcttttgtaagattgaagtgagcttcaacctggtgagaactttcaatctcaggtctttcttttgtaagattaaagtgagcttcaaatcttagttctttagaagatttatttttctcctttagggatttctgatacatgagaacaagatgtttttgggatgcggcaatctttagtgacatgatagtcagatccacacttgttgtaatgcctgttgctatttgccacgaggttgtggtgcctgacctttcccttttcctttctgtcgaccattggatttgcgcctgttgttgcgtttgcgttgtccagttagattcttagggttattcgaggaatttctcttgaatccttttagtgcgatactattggttcagtatcctgtcctttggaaacatagttgatagagttttctctatcttctctgcttccgttggctctttttcgcaaaatcctgtaggcgtaaatgaatccactcataattagcctcaggccaaatgagttccttttgctgatcataacgctcttttagagctttctataggttgagagggctcgtctccaacatgtactcatgtttgagatctttatagatgtagagccttagaaggaaaatggcaatatatagctttctgttctcaactagtggatcccaatcattgggttcctaaattgtatttgaaatcccacgagaacaaaaatttattttgatatcggaagcccaaattgggtagttactcccatcgagggcgagttcgtcgaactctatagttgtcatgtccctataatcatgattaacattatttatttacagaggtaaattaataaaaacatgacattgaggttgtaatctcaatgcgaaatgtaagacttcatattttgtaatgtttcgaaaagatgtaggttatagacctgataatttgagttagaattcgaaattaggtggcacaatgtggataatctccaagtaattaaacagtggagtagatctcttaatagtgggcaagttatacttgctgcctaaaacatgatctctaggcaaatatattctggtgaatataccgcagccaatgtttaggactccactaccttgtgtttatccaaatttcaaataatctcatttttcaaaacatattctcggaaaataccacatgtgggtaatcatcgtgagatgtagacctctgtgtgataggcgagatactcgctgcctaggttatgaccagtgtggccaatttgtaggactccaccgggtaatcatctcaaaatgtagaacacttaatgatgggcaacatacttgctacctaggttatggtcacgatgaccaaaatataggactccagctacatgtgattaatttccgagtcaaaatgtgtagtggaacatgcattaaatcctccattaatcatgttgtacataattaagagaatttgctaaattaaagtacaaaatttaaagaattttgtaaattaatgaagcgaggaagtagagcatgtctcaaaataatatgcaaaaggcatttaattaagacaacatgaaatttagtgaagcagggtatttgaataaacacctatgttaagtaacatataacaccagtggtcttacattgtaatttgtacaactgatgaactgcttgtactaaattaaataaaacacagggactaatatgaaattgctgctaaaataaaattaaaaactaaaataaaggggtaaatgggtgg

SEQ ID NO: 67177 - DNA, 9156 bp, Oryza sativa
cacatgatgtcgccgaggcggcgccgcctcctgcacctcttctgccgccaccgtccatttcggcgcctccttcttcaccacttccagcgccgtttccactgccgactccctcatccaccaccgattccttttctgccgcaccttcttcccctgttacaccactgccggcgcctccatttctgccgccctcaccgctatagtcaccgcagcccccgtcgtccgccgacagccccctctcctcatcggagtaagagtccggtcgggttcggacgccgttctccccactccatttgagagcgtgcaactcggggagtcgtgaggaatggcgcgggcggaaagtagcggggaggctgggtggcaagcggcggcttcaccagcatggtggcgagactatgatggagggtagaaggccggctaccccgtgcgcgtggtgagagttccaatccccgaaaccccggcggcgcgggatcgggggagcagctccgacgaggtgaaggtgatggcggagcggcgacgaacggtgccggtggcgactccatctccagtgggagggagcactgctcgccggcgggtgtcaccaccgcaatccatccatggtgcctggacctggacgcggcggggcgccggtgccatggcgggcgcttgtggtggtggagtcggaggtgtagcagcgacggcaaatgctgcgccgaggatggtggcggcggccaccaaccctagaatggtgcccggcatggcgatggtggcgactcctcgaatcgacagaggaggtggcgaaggcgatgggtgcggtctcggcgagggaggccgagaacggcatcgaggatgaaatcaaggtagacataccttatgcgcttccttagtttcttctgttcttcgctttttcttgagataaaaagcaatcggatttcttctcttcgcttagagctaagtgctgataacatgttgaaagtgggtaagattgattgagcgagagagagaattgaccacaatagagcgaatgagtggatgtcctttattgatcaatgcggtcctttattgatcaatgcggtacaatttatagagggggaagaggtggcaactgtagacgcgtccgttgccaaggagcgcctagggaagaggcgtggatgccttcggttgcgatccatccttttatatggatgagttcaccctattgtttcataacaaattttgtgaaataccttactataaatttgtaacaaactggcagttttaaccaaataattgtcaatatatgtaacaacattagcatttgataagggaaacatgacatcactgctacagagtacccatagataccggatgggaacttcttctcaactggcaccaatttagagacatatttcacaaaggtgtactaggtttttaaaactaacacctaaaaagatgtgccagttttccatggtaaaagaaaaagaatagccggctctctaccggctcaaatggatgcaaccctgattattgccgccgttattaacaacttgatcattaaaaggaaagtcaagcgcaattaccaaaattagagcaggaaaaatggatcttctaaaaaaaacaaacaataaaaagatgtaactacacagagaccgcaccctatattgtcttaaccagagactcatctttagatctggttgcctactagtaaaccgaataatacatgccttttttttcttcttatagatttttcttttaaattacttatctatccataatccgattacaccattgtgtttgttgcaattaaatttgtacaacaagatcttacatgactatattttgataaaagaaataaatatatatatatatatatatattgtaaaatatttttattatataaataagttacttttatcatatatataaattacttttcgatttgattaaattacttcttatacattcatgatgttgtgaatatattgtttattttattatcatttttggtcaattccgtaatttgtgctaattaaatttaattgctagataaactcatgtttttatctccataacggatttacttttaatatcatcacaaagttactttcttttttttaagttacttctataatatatgtaaattattattttaagttacttctataatataatatatgtaattacttttatgctttattgaatttacttttatatgtcgaagaagtagtttagtgaaatttaaaattaattaaggtatattataagagtaatttatatttttttcattaaaacataatcatgtgagatcttgttataaaactttaacttttatgaacacaacggtgtaattggatcatagatcggataagtattttaagagaattttatttgaagcacatgtgataggaatatatttttttctacttgcttgttggactagctagtactatagtgaaggtatattgttagggcctctcgttagcattaaaacaagatgcctcttgatttagattttaccaaaaaaaaaaggttcgtatggagaaaaaaaaggagaaaacttttgggaaggaaaagaatcacgaagaaacagcgaaaccaagaaattcccacctcaaccagtcaaataataaacaaaattagcttaattggatccatgcctttacaaatttgcctattcaaataaatgacattaaaattcgtctattaatagtcgtatcactaaaattttacaaaattggaccgtgccactgtcttcacgttttccatcaatatcctttattttccatcttcttccttctttctctcgtcttcttcctagaagaagagggcatacaatcacgagccatagagagccatagccacaagccacgttaagagatagccaacaggaagacaatcgctaagagataggacaactgtagtttcctattgcaaaactatatcctgataattaaatcaatacttcaacatatccacctcatttaattagatgatgcggtcatattatctatatttttaatagataatatcttcaaataaaatattgtaaaattcacaaagacatatatagtatgaaaaaaatgttacttagtagaatttagaaattccaaaagtaagatacttacaaaaacacacttatgtacaaatgttatatagtttcataggtagcaacttcatcgtgacacgatattttcttataaattcaaaactcggtgtttttaagtaattttagtttacaagttatacattgttatacgccacaatggtaatcccaaataaatttttttaaaaaaaacatgtttacaatagaataagtataaatattcgtaataaaaaagatggacgcgcatgtgtgcaagctatcttccaatttcattaaacaaataaaaacatccagctgccgcaccaaattgcactcagcggaaaaaaacacatccactgatgcagaagaaaaattgagaacaagtactacggggacttccccatacatcgtgagtaagctaaacctgagatacaaagttagataatataaccttctttatccactgtgcactgtgtgtttatttagacgcgttaaagcacgcaatgcaagatacttttcttttcttttttacgtttaaaatgaacaactacaagtccacaacctaatgttttggctaattaaataatgctatttagttactgcagcgttaatttgctccccttaataacatagtttcacatgaatataccttgtatgcagtgatgaccaaaatgttgttgaactggaacaatggcctcacagagcaatcggacgaaaatgggagcacgccactccatttcgctgcatcacttctacggagaggaatatacaatacggtcatccctgtgctgagagccaacccagttcagttgtataagcaagactctgaaggattgtaccccatacacgtcgctgcctcctccggtgccaatctgacagtcaagtcctttattagagagcgacctgagatcgctggtttacgcgattctaaggggaggactttccttcatgttgccgttgaaagggaaagatggaatgtagttgtgtatgcttgccatactcaatcgttggctaggattttgaatatgcaagacaacgatggaaacactgcattgcacatagcagtgaagcatgggaataaggctatcttctgttctctactgatgaataaggaggtaaacttaaatatatcaaataataaggggcaaactgctttagatatatcgcagagtaagattcttgcaggatatttctatggatgggtaagattacacttttaaccctttttgattaacaaagaaaaatgagtaaattacgttcatggtacacaaacttgtatggtgggtgcaaataggtacaataacttacaaattgcttattcgggtacaataacttggctagttcatgcaaacataggccaaaccgatccgcaaaagtaaaattgatctaatatgatacatactactggtgtaattgttgttacacatcaaaattttatactgacacatattattactattattcgcatgatactttcaagatttagaaaaaaaaacaaaataattaaaaatacctaatcattaaaatacactttcaatgaaagtgtcggaacatgaaaatgaaaattaaaatgttcttttagtagttaattgtacatataaaaattatcttggtcttgaatagataaataaacattagacgagttatatagatgatcaattttttccaaaaaatgaaataaatattgtatcctatacatgaaaaataaacttttggacatctaattcctctttttatttggattcgaaataagatctccaaatcatagttgtacgtatatgctgttatgtcattattgtgcactaatttagaacaattttacttgtatggatcattttggcccggttcgcacctactagccaagttattatatcaaagtgagcaatttgcaagctgttatatctatttgcacccaccacacaaattcatgtaccgtgagtgtaatttactcaagaaaaataaagagtactgacctactgatccattatgtttgctttgcagaaccctaacaaactgatattgcgggcactaacgttttgcaatgcaagaggtggttgtcgtcgggtagatcacctgcaggaacaatatattattcatcaaaaacaagtagatgaagtgagggaatcggacaaaatgacaaattcaacacaaactttgggtattgcctcagtgctgattgttactgtcacgtttggcgtaatgtttgccataccaggaggttacaaagcagacgatcacaataatggtggcacaccaacacttgctggaagttatatatttgatgcattcatcatggctaacacaatagcattcatttgctcgagcttggctatcatcaacctcatgtactctggaatgcctatggttagtctaccacttcgccgtcggcactttaacatatctctactcctggccttcagttcagtgacaagtttgggtactgcctttgcactaggtatgtatttagtgctggccccagtgactcgatgcactgcaattgcaatctgtgcaatgatgatgattgcatcactgtgcttatatacggagcctttaaatggcgttcgttttgcaatagcactatatgttaggaggggcaatcgggtattgctagttattgcacagattctacttattcgaacgctaattacatattggccctgtgtgataatctttggctgggcagcgatttcaacaaaagatgggcacacaagacatggatgagtcgtcattagatgcacccgaccagagagacagagagatgaccaaaagtatgtagtaagtttgaaatttaatctatatttgtagttgccaatcattattcacgtgatatctctccagaattaatatttgattcgaaaaaatatgtagctacatgctgtgctcagctcagatattgtaatttctttttgttatttctatttttaacattcagaccctgttaatttccttttattaaaccatcatggtacgtactgtcaatgaatacttgaggcctgttcgtcacttttatgtgacacttcaatatctaacagacaacctaagctgcaaaccgaatgtttctggtatatgtttgcatcagcgattgtgaatttaactaacaaatcattctccaaggccacattaataaagcacggatttctcttttaggtgtacgatattcacactatgcttagagaggttgattagagcctctttgtccacgtgaataaaacattaaatcatcatcgaattggctgtagttgaccttaacaaagttattctagattagttggaatgtcccaaataattctacgggtctttgtatggatttgtacatatacctaagttgaacaaatatcctgaaaggggaacagcggaacagccacattcacaaccatcggcagtgaaacatgacttcatgggatctcatctgatctaaaagccaagcatcacattctaacaaacaacaaccgagaaaaaaatacagtaaatcgtagtacatctaacttctaagagactagtttaaccaaacaaactggaaaagaaaaaaaaactcacatcattgtgcgaagatgtagtagtagagtactagagttaccaatcgagctcacacgagaaatcttccaccaagatcgtcttctccacagcaaccaccaccacctccatcttcttcccctcttctccattgccttttgcgcgatccgaaccagcgattccttccctgatcccctcgacgtagccattgtgagaaccaagcttctcgtcccgctcctccccgaccaccagaaccctatcctcctcgtccccgcagcctccgactccgccgccgaccaccatgacctcgtcggcgccgctcccacggtcgcctcccaccccgacgagggcctccaggatggccccgcacgtggggcccgagtctatgtccgggagggcatcctatggcagtattgttgatgcgaaaaacacacactggcctggaagatctgcttaacttcagtgcaagtccaaaaatcttacctttaggttcgtgagcgtgctagttgatttgatcctgcaatcaacaagaaataaagatagaaaaatagcggttaaatccataaacgatagccgatcggccagtcgccgatgatgtattatttatctttgagccgatgtcatatttaagtcgatcggcaatcataaataggtaagaaaggactaaatgtattcgatcggctaaagatattaatgatatataatacttccatcaatatatacttaaatcatgtgattgggatagatcggtcgccatgccgagacagtataaatcacttagatcgaaatatatattaaaaaggagattatagcattcatagcatagccgatcagatagatttaacatgtatcggctaatactccgataccactctatattaagatattaaatcgggcaaaatatatcaaacatgaagcttaatatacctagatgcgacaagatcttagcataaagggtagatttaacatatcaatctagcacataagatataaggctaaatcaagtaagatcggctgaaaccacgatactacccaaatcggcaagcaaagacaggctagagattaagattctaatcacgacttataaggtcaaactcaactgatgcagctataagtatgaaaagaaagacaatatctagactatcaagccgttggatgtttcatagggtggtggatatcctatataatctgagtcaatattgatatttaacctaatcggttgcctttcaatgatagatgttcgccgattgagggttagatagcaatattgtcaaagattacataagatatatgataactcgacgaattacataaacaagattagagtatcataaagatagaagcactaatcctgagaacgcaagccgccataacatattttacctctagttgaagatcgaaaccgatgcagctcaacccgaaatcaagaactcgtcgaaagtaaacaaaagtaaaagggtggcgatgcaccgagattgtttgattacatgggttcgggtcatatttatacccgagatacaaactatgttcttgtcgtacacgactcttatctctaacaaactctaagataccataagtctttgcggcagacttttgcccaaacttatctctaaggaaattacataaaatatcctaactaatagatacaattgccttttcaggacttagtccgtgcgtggcaatccatatgaagcacattaacccaatctgacaacgtgtaccaaatcacattgtcggaatcgactcaatcgactacccttgtccgactcgaactctgccgatcctggtcgcggccgattcggactttagctgattcttgctctgtttccggaacgatctctaccttggattccgcttcggttttatctccatccctgtgatcgaaacgacaaccgcatacgtcgaaacacgtggtcactcaacagtagttgggaaagaagtaaagtgtattaaattgagaatttttcttaggatccccctattacatggtcctatggggctatttatagcatacaggttcttactactagggttttggttatacagaggaatttacatggttgcccttatgaaagggacatttacatgggtacatagtgtaattgtggtccatgggcccttagcgggccgtcaagcgattatcgacccaattagcccttaggcttgatgggctaggatggcttctttggtcctcccggggtcgaatttgctatggcgaagttgtcccccttccgcgtatactcttcgccctgcatccttcgcccaggaggcctctggcctggcaaggtacccgcgcgattccctgcctctcgcggtccttgcttcttagtctacgccatggggggcttcgccctgactaaacttgacgtttcgggcttgaatccttactggtttcagcagatttggtcgaaggcctcatgccatatcgccaacaatcccccatacttgaattaccaaatttggtcgttaacaagtatatatcaatatatgggtggtttcgctgatgtggcatcctagtcaataaaaaaaataaaaaaataggtggggtccacatgtcagctgcacatcttttttttttcttctctcttgccttcttcgggctagca

SEQ ID NO: 67178 - DNA, 4370 bp, Oryza sativa
tgaatctccattctacaacgataaaagggagtatattattttctatagtctacttatatacaaggacctaatttattaaaggagacgtatagtaagaaatctaaccgaacgatatacttacaaaatccagcaactataatagagacgtcgagggcgtccagctggtatagttcgtagattcccttgaaattgatccagagaatgtcatctccttgcaagaagtccgtgtccctgatcctcgctccgatcatctctctaccggcggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctcctgttttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtccagctcctcttgcgtgcaatcgtaccccgggtccttgttcttggcggcgtcaactttcgcccttttcgttgcccttgtgtgggcaggcggtgcagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcatgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaggaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggcttccactgcatctgttagtcgttgcgcagcctctcgtatctgaacgccgaataccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctatcttatatgcaacgaactcgtcccagtgatcccttagctttgggaatgtgtcgaagttcggtgtctgccccttcagtatatacttcttgtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctcctcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagccacgagacatttatgttttaacaatctaagtcatgtatgctaagtgtaaatgtcgtacattagaaccctacacaaacttacgtgctaagtctaaatacaaatcgtgatataagctaagtctaggtgacgtatattatacaaccctagctagtaaataattatatactaagtctaattacaaataaagtaatcttatattaaaactcaaataatattacatgctaagactaaaatagtcatgtatgctaagtgtttcgtgcatatatgctaagtctaattaagacaacaatagtcaattgctacttgtcgcaccatttccgtagtaaataattatatactaagtctaatctcaaataaagtaatcttatattaaaactcaaataatattacatgctaagactaaaatagtcatgtctgctaagtgtttcgtgcgtatatgctaagtgtaattaagactgcaatagtcaattgctacttgtcgcaccacttccgtagtcaataattatatactaagtctaatctcaaataaagtaatcttatattaaaactcaaataatattacatgctaagactaaaatagtcatgtctgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtatatagtcaaatgcgaagtaacatatacatatatatatatatacatatatatatatatatacatatatatacatatacatatatatatatatatatattgcatttcacgttaacgttcgtcctcgttcgttcgctcgttcacgttccctagctcgttcacgttcgttccctcgttctcacttgtcttcgttcgatcgttctcgttatcgctctcgttcgttcgatcgttctcgttctcgttcacgttctcgcggcaacatacattgacgtgttcgttctcgctctcgttcgttcgatcgttctcgttctcgttcacgttctcacggcaacgtacgttgacgtgttcgttctcgcttctcgttcgttcgatcgttctcgttctcgttcgttaatggcggtgtggcggcatcggggcggcggttggcgccgtggcgacggcggcggcgtggcgacggcgtggcgacggcggcggcgtggcgacggcgtggcgacggcggcgtggcgacggcggcggcgtggtgacggcgtggcgacggtggcgtggcgacggcggcggcggcggcgtggcgttgcggggccgtggcggcatcggggcggcggttggcgccgtggcgacggcggcggcgtggcgacggcggcggcgtggcgacggcgtggcgacggcggcgtggcgaccgccgcggcgtggtgacggcgtggc

SEQ ID NO: 67179 - DNA, 872 bp, Oryza sativa
cgtcgtggcgttcgtccctccgtcgagccgttctcgtccgtcgtcagcgttcgtcaagcgagccgcggcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcacgtggtggtaaggatccctctccctcgctgccctgtcctcgtcctttcggtgtcgcccgtgctcgttgtgcggtcatcaaccccggtacccgtgtaccggtgtcggtagtcgttcacgtgtgcggatggtgaccgtgtagtgtccgtgttagtgtgcccgctcggtagccgcgtggtttccacgtgtgcaacccgtgtggtgtctagtggagtccgtttgtcggccactcgcctcggttgacacacgggatccgcttccgtcgacccatggaccgactctgtgtactcggtctaccgcggtcctttaggttgacatgtggggtccgcatgtcaacggcgcagccttcctgtcttttccaggctagcgcttacacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcattccggaggttcccgaagcgtggtttgcggtcgtcg

SEQ ID NO: 67180 - DNA, 13871 bp, Oryza sativa
acaaaactccgccgaaacaccacatccaccgtgcacccgagccacagctgcctctcgtcacctccagtcgcgcgccaccaccgctcccgtcgctgccgcgctgcgctaccaccgccatcggcatcgccgttcctcgccgcaccccggcccctactccgtttcccctccctgcccctggaacgccgccgccgcgttcaccatctctctccgccgccaccgtcgagtccagccgcgtcgcgccgcctctccggtcgacgccgacttgtgccgccacctccttcggcttcgtcatctcgagggccccgccggccctcggccgcgtctccgccatggtcgggtgtcgccggaacgccgttcccgccgcctctcgtgccagtcgccgccatcctttccgccgccagccgcctccctgtggtcgtctcgccgtcgccgtcctcggtgagaatccccaccgtcccttctcctttttttttccctcctccgccgctccccgtgcccgctgccgcgacgcgccgctgtcgccggcggtcgtctggccgcacgccgccgcgcgctatcgctcgaccaggccggctgtgccgtgcccgtgccccagccgcgccgcctcgtggccgtccgatcggctttgggccgatccgagccgtcggttcccgtggaccggcggtggaccgcctcggtggttccgatccacggtggaccggcgcccttgtgccgctgaccggtgggcccgcttgccggcgccgcccctcccccttgatgacgtcagcgaggtccatttcctttgtaaaaataaataataattgcgcaataaatcgagtttaattatagaaattcatttaaatggctcaaaacttctaaaattcatatctaattcattcggactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattctccttgagcatgttgatcccaatttataaatgttttaccgtttacaaataaatatgcatgttttgctaattacacggggtcagggtttacctatctgctcgcttgtgccatgtttacttgatatctgttctttgtcaaccttgggtaataaattgactagctcgtgttacttatgtgacctagctagaactatatgcttagccatgcttaattaccactagctcagtcgatgggataattgcagttttagacattctagtatcttgttgagccgcgtgctcgagacatctggccatgttttatggtcgtaattatccaactaaaatgcgactgaatggtgggctgtgggtgcatggttttgcgagtcgcacccatagcaattaaggaccggttcacgggaaaccctagaagacttacagcgcttgccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgcctttttaggggtgggggtgaaaccttagcgtggtgtggatggttaggggagggttatgcgaagggtctcgtcacaatcactcgacgtggtgacgtgtgcatcatgggcacatgatgacgcggtgacatgtcggtgggttgtgtcttgtgggtacagttgtgcacctctggccagagtaaaactattcgaatagccgtgcccgcggttatgggcgctcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgccttttttcgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaattggtcctgaacatataaacgcatacattatgaggtagtgtcatattcttgattagattaaattggcacttgttatgaaacgagaccacctgtgggtatttgacatgatcaatggttgtatccgtcgtaggcgtggtcacatcatcggcagactttgtcaattaataccaatacttgcacacatgggtgcgatgttttcaaccggaacgaaaaagttcaaaaagcagcaaaacatgagttttggacatcatggatcggattgggtgcgtccgtgttgaaaaattactccgttactcgcgcggccaatttttgtcaattaatgctgatattgacacacgtgggtgcgatgtttttaaccggaatgaaatgttcaaagagctagcaaatattggcctatgttggcacacgtgggtccgttgtttttgccaattaatgtaggtattggcctacgttggcacgcgtgggtgcaatggttttaacctgaacaagaaaaaacagttaaaaaaccagaaaaacatgagattttgacttattggaatggattgggtgcgtccttgttaaaaattcactccgtgactcgcgtggcaaactttgtcaattcatgccaatattggcacacgtgcgtgcaatgtttttaatcggaacgaaaaagtttagaaagcaccaaaacatgtgttttggacataatagagtggattgggtgcgtctatactgaaaaatcactccgtaactcgcgcagcgaaagtttgtcaattaatgccaatattggcctacattggcacacgtgggtgcgatgtttttagccggaaaaaaaaagttcaaaaaccacaaaaacatgagttttggacatattgcagtagattgggtgcgccctcgtcgaaaattcactccgtgactagcgtggtgaacttttgtcaattaatgtcgatattggcacacgtgggtgtgatgtttttaacaagaacgaaagattcaaaaagaactaaaacatgagttttggacatattggagtgtatttggtgcgtccgaatcgaaaaatcactctgtgattcgcgcgacgaactttcaattaatgctaattttggcacacgtgggtagcggaaccaaaattttcaaaatacacgaaagcatgagttttggacatattggaattgattgggtgcgtccgtgtagaaaaatcactccgtgactcgcgcggtgaacttctgtcaattaatgccgatattggtacacgtgggtgagatgtttttaaccagaaaaaaaaagttcaaaaaacagtaaaacatgaattttggacttattggacgtacgtccgtgtcgaaaaatcactccgtgactcatgcggcgaacttttatcaattaatgccaatactgcactatattggcacacgtgggtgagatgtttttaaccagaaccaaaaagatcaaaaagcagcaaaatatgagttttggacatctcgtagtggattgtgtgcgtccgtgtcaaaaaatctctccataactcgcgcaacgaacttttgtcaattaataccgatattggcacaatggcacacgtgggtgctatatttttaaccggaacaaaaaagttcaaaaagcaccaaaacataagttttggtcaaattggagtggattgggtgcgtccgtatccaaaaatcactccgtgactcacacggcaaacttttgtcaattaatattaatactggactacattggcacatatgggtgagatgttttttaccggaacgaaaaagatcaaaaagcagcaaatcatgagttttggacatcttgtagtggattgggtgcgtccgtgtcgaaaaatcactacgtgactcgcgcggcgaacttttttcaactaatgccaatattggcctatattggcacacgtgggtagcggaacgaaaaaattgaaaggtacaaaaacataaattttggacatattggatttgattgggtgcgtccgtgtcgaaaaatcactccgtgactcgcacggcgaacttttgtcaattaatgccaatattagcacacgtggtgcgatgttttctcaccggaacgaaaagttcaaaaatcaccaaaaacatgagttttggacatatttaagtgtattgggtgcgtccgtgtagaaaaatcattctgcggctcgcacggcgaactttcatcgattaatgtcaatattggattatgtctacataactatctcgtagcaaagtgcgggctatcaactaattaaaccttccctccggcgtcaacatcgtcacaacgtcattcttattcgtgccaaatttaggtggctttcccagtttatccgcatgtccacaaattaatccctcatgctcttggcatttacccaccagacgatcacatcacccgctccatttgcaacggagctccttactctacctcgacttgcaaccgaccaatggtcgccgtttgttgggacatccatacccatgcattctggatacgctcttctctcctccgtcttgctcgtcctcctggcgctctccatcatcacactagtgccacgcatgccatcaccgcagtcgttcttccgatctccaccgcctcgcctgatcaacagtagggttcctcatccatccgatgccagcgattgtattttctccgacggtaaatgggtgagggacgccgcggccgtgactgcttaccgggaggactgcccgtttcttgaccctggtttccagtgcatcagcaacggccggagcaactcgtctttccgctactggcgatggcagcctcatggctgccagctcccgaagtaggtagccatcgccaatgacatctttgataaattagtaatttcttttctgtggtttttcatgatgtggacatttttcagttacttgcattgccactcattcttcaattccaaatgatttgaggtgtttaggttcaatgcaactgatatgctggagaggagccggaacggcagaatcgtgttcgccggcgactcgatcggccgtaaccagtgggagtccatggtgtgcatgctcgccgcctccgtgccagcggggaagtcaagaatatatgagcagtccgggaaacccattagcaggcacaaagggtacctcgccatggtcttcgcagactacaacctctccgtcgagtactaccgcgccccaatgcttgtcatgatcgaccgcttcccggcaagcagcggtgccgtcaggggagcggtccggctggacatgctgcctcggcacgccaaccgttgggctggcgccgacgtgctcgtgttcaatacagggcattggtggaatgagcacaagactatcaaatcgtaatttgagccgtagttaattaattaattattttgtttctatgcatactatgttgtttcatttattataactgatccctaagtctcaaactactgccacatacatgttttcaggggaaactatttcatggttggtgatcggctgaacatgagcatggacatgaaggaagcattccgatggtccctggagacagtgaaagattgggagataagtagtacacgggttccaaatagttattttttcttcaggagttattctccttctcattataggtaagaattgttagtgaacgatacacacagttcacctctttggtgaattttaacaagacaaaacataatccttcatacaatttgaccattcgttttattcattttttttgcaaaataaaaaagaatataagccatgcttaaaaaaatatttgacgataaaccaagtcacgggtaaaaacgaaaaaataaaagacaatacatatttttttaataaaatgaatacaatacatatttttttaataaaatgaatggttagaacgtatttaaaaagtcaacattgtcatgcattaaaaaaatggagatagtacgttccaacgtagatatataatgcttttaaaatggattaaaatggagtagtggtggtgatgagtggtgaatctaccaccatccccatcactaactccctactttttgagtaattttatagtacattctacttgaagtatatatttgctgcagtatatggaagggtaggttcgatatttgttaaaaaatatgaaaagtgttgtttagtattttgaaattgaagtttattttcatccggattgattttccagttgtagtattttttctgtatctcgtcatccattcgtgatatagcgcttcttcagaatttatcgcgtgtccccggcgtccttgactcccgacgcacttgcctccagccccggcgcctctatcccgattccttcatgacaaaaaaaaaagttatgtccagatttcacccgatatgtctggaccaggaaacaactaaataacacgtgattttcagatggagctaatataaattaaataactattattttaggaaaaaaagttacctccggatttcatccggtatgtccggacatggacaacaatgaaaaaacacgtggttttcgggcgtgctagcataaattaaataactattattttaggggaaaaagttactaccggatttcatctgatctgtccagaccaggaagacaactaaataacacgttgttttgtggtcatgctaacataaattaaataactattattttagaacaaaaatatttacatccggatttcatccggcctatccggaccgggatgacaactaaataacgcatggttttccggtcatgctaacataagttaaataaataatattttaggcaaaaaaaagttatgtccggatttcatccggtatgtccggactgggacgaccaaaaaaaaaacatgtgctttttcggtcatgctagcataaattaaataactattattttaggaaaaaagttatgtccagatttaatgtgatctgtccggaccaagataacaaacataaattagataaatattagtttaggaaaaaaaattccgtccggatttcatctggtctatccatactgggatgataactaaataacacgtggttttccggtcatgctaacataaattaaatatctattatttaggaaaaaaagttacattcatttggtctgtcgggaccaagacgacaactaaataacacgtggtttccggtcgtactaacataaattaaataactattattttataaaaataagttaggtccggatttcttccggtatcccagaccgggatgacaactaaataacatgtggttttatggtcatgctaacataaattaagtaacacctattttagaaaaaaaaaggttacatccatattttatccggtatgtccggatcaggataacatgtggtttttcagtcgtgctaacataaatttaataacaattattttagaaaaaaaagttacttccggatttcatccaatctgtctggagtaggataaccgaaaaaacacatggttttctgatcatgctaatataaattaaataactattattttagaaaaaaaaagttatatccggatttcatccggtcggtccaaaccggtatgcaacgaaataacacgtggtttttttagtcatgctaataatataaagaggcaattgtgcttcagtccttgatttacaattcaattgtgattttactcttactttttagggtttgtgattttgcccctgtttttctgaaatgagtctgcccctggttttgacataagtttggtggcctgaaatttccaaattaaacgaataaagaaaatgttattattatttgtgaatgaccattctacccttggttcaatgagcaaaatcccgaattcctttactgtccgggttgcaagcgctgggttgcaagtggtggcggcggcgacgcgcggccagcgcgcggcagggaggagaagcggtgcgggccagcacgcggcagagtcgggcgcgggcagggaggtacggcagcggctagggctgtcaacgagccgagcttgagcgagcttgcctgtctaggctcgagctcgagccgagcctataaaatgttcgaactttcaaacaggctcggttcgagctcgatcaagctcgagctcaactactgagctcggtttttaattagaacattgtatatttcaaaggataatttttaaaaaatatttaatttatggtttatcatattagtataagaagaaaaaaaataaaataaacatataatgccaatacaaggcatacaaataacatatttgatctaccaatttattaaatagcaacgaaaaattatatattactaggcccgttagaagctcgagctcggcgagctttgggacaagctcgggctcggctcgtttggagctcgagccgagctcgaatcaagcctaggacgagtcgagctcaagtagctcacgagtctcgagctttctttttttacagccctagcggcggcggcgtcgtggctggcgcgcgcagggaggtgcggcgctcccgcggctgcatgcgcagggacggcctttggaggcgccgcgacgaggatgacggcgaggaagaggacattgccgtcgacgagagggactcgctcgggctgccgttgccggtggtgagcaactgctcatcgtcggagtgtgagtacatggccgagtcagaggctgagctggcgaagaccgaggaggagaagtgcgcgtcggcgtcgtcagcgtcggagtacgaaaagacgtcgcagtcgagcacgaggagcgtcgcattccatggtgctgccgacgccggaggagacgggcataagctgagtgttagtgctgcttctattattgtgcgtttagttagttgggatttgggatgccataaatacaatggtgatcgatcacgatgcccatgcacgctgtgggccaaaatcatccatgcaactgttcgtttatcaagactaaatctctataacgagcaaaaagtgcaaatatctgtcactttttacctccttttttctaatcattagacattagtgttcgttttgctctagaaattatcattgaatgccaaaacatgtcaggggtatatttgtccattcaccacaaatttaacaccgctaccattaattaacaaagtaggggcaggcggctacttcatttcaaaaaagcaggggcaaaatcacaaaccctaaaaagtagggataaaatcacaattgaatagtaaagcaaggatagaaacacatttggccctaatataaattagctattattttagaaaaaaagttacgtccaaattttacgtggtctattcgtactaggatgacaactaaataacacgtgatttttcgatcgtgctaacataaatttaataactattatttttgaaaaaaaaaagttaattctggatttcatccggtctatatggaccgggacgataactaaataacacttggttttaaggtcgtaacaaattccctttttaatcgatatatgtacgtgcccgatccatttttttgttctctccatttgctgcttgctgcctgccggttgctctttgcttgctgctgccctgcctcctactgcctgtcattccctgtctgcgctccttgcccctgactgcttccgtcgcccggatgccctgcaatgctgctgccgcttcctgcactgctgctgccgcgcctgtagcagttgcgcccgggtgccctgaagccacgacccttgactgctccgcatccccttgccgctgcgcgcctctggccgagccaccagtggccggcgcccttctgcggctccgccccttcccacgcacagagacgtcaatcgtggagttggggaatttccaaagacctaggttttgggtgcgcgggaagggcagatggaggaaaggaggtcggaaaatcgaatcaaatcacattcgcggtggctatcagcggcggcggtagcgcatgggacgaaggaaagcgaacggaattctctcgggccggatctgaccgaataagagaacgcgaaaatacaaaaaatactccatgcaaaaagatagaaagacaaatttacccttttcaatttatactgtaaactaatctaaaggaaggtcggatgaatcgacaccgttacatcatttactaatctaaaaggaagatcggatgaatctacaccgttagatcgtttaaactacaagtatatactttgcatgtaccgtaaaaatcctctacatttttaaggtcaaaaagggtgccatacatgtcaactaccccaccatcaattctctacttttttggaagaaaatatgacagtataaatgtgaataccaaatacatacataaattaaaggggtgatatatacattaatgaaggtaataatgctttaatgctaattttctttacttaaaatcacattgcaacgcacgagctagttaattaatatatgcatatatttctctctctccatattatactgtacaatgtttttccattctctatattaattaaaaatgcatacaatttcaagtttatatatagttccgtacagagaactttacagtttaaactagtattaaaatgaaggtcaaaaaatgacagcaatggcacgtggaacacgggtggctcgtgtgctgaccatcgagatccagtgaccagcagtgaccaattcgacgaggagtactcttggatcaacgccatgatctcgaacgccatcgacggcatcagaagccacggtcgaaggaaagcccatttcttgaacataacgtacatgaccgaactgaggagggatggccacccgtcgcggaaccgggagcctgggacgccgcaggacgcgcccgaggactgcagccactggtgtctgccgggcgtgcccgacacatggaatgaggtcctgtatgcacacctcatgtcaatgggatatgatatcaggatacactagtacaaaaccctcgcagggaccggctgtatatgtgctatgtgcctttttccacctccacatgataaaaaaaatataaaactagcatatttaaacactatagttgtcggctcttaaaaaaactggtagtaatattgggtataattttatgctttctaaatgtttcttgaaactaaatgatttgaaatgatgatgagattggtatatgtgatatgattgccttacttccccttatgttgtaagggaatgatgtctatctatttatgttgatatcatgccatgattaatatgctttatatattgcttaaatgatttgcttaaattacgttgcaaatagtttgtgaactaaaatttgctttatgctgaaaattgagactacaaatagccttccattgacttagagctttcatgtatgtaagtttgatggtgctcttgccagtacattaatttgattaatgtactgagtcttgccatgtgttgttttatgttttgcaggattagacttagtttaatttgagtgatgcggttttcgactgcttcttataggatttgaacttaatgggggtaaacccctagtcggtgtgcttaaggattgggtagtcaagcttccgttgttctcttatatatttatttggccggtcggcctatgtaactattaagttgatgtaagtctcttagtccctttcgtcttaaatgtgtttgctatatatgtccatgcttaagatgaaagtgtgaatctagtgcacatcttgggaattagattcacatgagttaagaatatttgagatgttgtagatctttagccattttgtcaagtctcctgattgtgtaacacatctggtcgccgctttcgagtggtttgacgggcatatctcacgccgaagttgactggcaggctaaaggcccagcaatgtcttcaatattcttctctcgatgtgtcggatatttcattatgtttgtttgatgacttgagttattcacttcatctcttaaatataatgggaggtccggagagcctacgaaaactgccgccgcagctaagccgctgccgagccaagtcgagccgagccgccgctttaacccgttgctcgatagctgagttgcctagccatagatgcaaacctaggttcctactggcctaccgtttgtcgtaccggggctttaccgtgaatcgtgtctagcccaccagtttagcctcagccgttgttgagtcgttcgctcgtttattcgaacgaggtgtccccgtgtttcgttcgtccgtccgtgttgagtcgtcctttagtttagagccgttcaaagccacaggttccgtttgcctatttcggttgaccatttgggtgatcccgtgtcacgtagaattgactcgttgagtcggtatctcatgaggcttgcttgccagtaaagtgttaagaatccattaaaattggtttcttttgctgtttcagtagctctttagcttgtatttattgtgtgccttgtttgtcgcttagactctggcagttccgacgctccaatttattttgaagtggttgaagaggttctatcagctcaagggcaaggcaagtcatacagatatcattgatcatattgagcctatctgcaaaacccctgcttttctcttaaaattgcattattttataatgtcatgtgggaaggaatttacccgtactcagccttatgcttaccctgattcattgatagcctgggataataatttgattgtaggttgggctccgtgtgctgtggttgttgcttgaacaaaacactcggctgaccgtgagccgatgttgacgcacccagcttcccaaaagccgttgtaactataggctgttgctctggggttattccagatgcaggttgatgcttaccaccattattagtgctgatggtcctatattgtggaaaaacaccctcaggaaggaaaatcgatcccttagcttgatactcacttgatcatattagacaagcactcctgattggttgatcaaagcatgataaacagcatagtcaatccgatcttgcatattattgagccctttaggatctccttatggtttctcatttttaggcttggcatctttaggagaactcgtttctgggtcgtcatcagatagcatcgctatcttatacctctgaattactgtccctgatctagttaacacaaatgagtgcaaaaacttattttgcatttggttcatcatctgctcgaggtccaccttttgttctgctgtcaacttgtctagcgttatcgggacgatgttgtccgggtcaacattagttgacttgatatccaccatgatgaagatatgtcgaagtcggtcccactgagcatgccaaaagcatgttgatgcgaaaaacacacactggtctgagagattgctttactctagtgcaggtcctaaattttgcttttgggttcaaggcgtgccagttggtttgatcctgcaaccaacaagaaacaaaggagccaaagttagatccataaacgatagccgatcggctggattgctgatgacgtatcgttcatatcaggctgatgcgatatggatcagattggcagtgaagtatatggcaaagaaaagattaaacctacgctattgcccgtatatatcagtaatatatgagata

SEQ ID NO: 67181 - DNA, 2193 bp, Oryza sativa
ggtgttgacggccaggggtgcggccaaccgcgtcggcgtcgccatcgacgtcaagggcggcacatgcaccgtggcggcggctgcattcctcctcatctcgcgtttgccgtcggtggtacggagccccgctcacccacgggtcccctgcaggggcggggacggggggatatttcccacccgatcacctgtgcggggccggggttggggggagaagtcggggagcgggtgcgggggcgttccagcccaaccgccccctgacccgcccggttgacaaccctaggtaggaggtaacgctttttcaatttattcctcaactcctaatagctgttgtaccaatggaaaaaaacaccttttcccattgcaatgcacgggcatcttttcaattgagaaaaaaaagccaagtttccgttgtctgtaaaaaaagagaaaaaacctaactcaaaagcaagaaaacgccatttataaaaaaacctgttcgaaaaaatctgtcgactcaacacgaggaaaagaagtcttttataaaaatacaggttcaaaaaaacgtccaactcaacatgagataaaatccattgtgtataaaaaaatggattgaaaaaaccgtccgaatccacgcgaaaaaaagataaaaaaaaccatccaactccatacgagaaaaaatcatcgtttataaaaaaaatcgctcggaaaaaactgtctaacccaatgcattaaaaacctcatgtttataaaaaaaaatccggtttagcactgtgcaatgtgaaaaaaaacatctaccttatctacctcatcggtttcaggaaaaaaacatccaattccatgaaaaagaatttaatcttttgtatcatctacctcatcggtttggtttttccaaagcgttcctggaatgttctgatgtgtggatctaaaacaagtcttgcttgggccttttttttctcgaagcgagatcaaattgatcgaggcttgggtcagataggatcatcgattttttccatctcctagacggcttgtgttccacgatctattctcgtgtattgaaggcacttcatatctctgtatggaattatcagactactttgttaagtatagctaatatttttgatagcatatcatataaaaataatacatatattaacagaagagttcacagtggctctgttttgtctagaattgaccatgtgaccatgtgagacagtataggatttgattaatcctattattagttgcaagaatgaaattgaaaaagagtttttcagattatatgtgtacagccacacaaataatccaattcttttgggtaaatgagacaaacttcctccgttttataatgtaagactttctagcattacccatattaatttagatgtaaattaatctaaatatatgcatgtgtttagattcattaacatcaatatgtatgtgagcaatgctagaaagtcttacattgtgaaacggagggagtaggtaattatgtcgtcgccgaggttggggtattacaatattgaagatgttccaattttccttatgacatgtctgttgtcgaatagacaacagcgtcacaccgaaaggcgtggttctctaaacagttgttggaaaagtaaggcaattgtattgcttagtaaaaatttttttggggatcccccattacatggcctagaagggctatttataaccttattacaggttctctccccttagggtttaggctttacaggagaatttacatggttacccttatgatagggagatgattaggggtacacagtgtcctttacacgtatggccccaattgggctaaatggctcggccaattgatcttggcgaatccccacagggtcgcaacagcccgctgggcttcctcacagtggggtatggtaccttggcgaaacccatgccttcgggctgaagcttttcgcctcaccatcttcgcctgcgtggcctcctgacggggtccctgtccgacgaagcacgcgtacttcccgagccatggctttcgcccttatggtatccctcttcgaccttcgccgcttgcttccggtttgaacatgtcgcccaagttttcggtttcggcaggcccggccgaaggcctttcgcagtatacctccaacaagcccctcacgagcaagggtgagtagggagcttcggccgagaccgtgcaaatcgtatggtataccgcgaggcgccccctttcggtcg

SEQ ID NO: 67182 - DNA, 9026 bp, Oryza sativa
gaattcctgcagccctcactttttaccacttaacacgctccgtgctctctgcatttgtttgcacttcagctcttcgccacctctgtactctcactttctttcgcttctcaattcctccttcgccacggacctgatggctcctcgtaagcccaccaaggccgggtcgactggcgaagaccctagcagcctcggggaggggtggtcatgctttcttggcaaatcgcttgtcaaagaggccgacttggccgaattggtctcctccggcactctcgcggagggccaagggacatgtgggggcgaagccgttgtcccttcgccaggcgatgggcgaacggtcgtcttcgccaccttctttgccgccgggcttcgtctcccgtgtgacgatttcctggcgtccgtgctggcgacatacgaggttaggcttccctagctcagtccgtcagcaatcccgaagctggctgtcttcgctaggatgtgccgaacctgcaggttctctcccaccgccgagctgttcgccgtcctatttacagcatgtgccacgaccaaagacgtgcatacgccagccggaccaagaaaaaccgttttcggttgcgtgaacttcatgctgcggctggaatgttcggacgcctggccggtgcctgcatcgatgggcaaatgggaaaggaactagatgcaaaagtgactctacatcgccaacccctaccctactaaagacaacaaggcgaactagctccgcttccagtgctccgccgtctccattgtcgtgaagccaaacctagaggtcgatggaaccctcgagtcccggctcatactccttcgcaaggtcgcacggcggctaagtacccgtgacctttccgaggagttttgccttcttccgatctccccccttgctcgtgtctggggggtttccgtcaatgaggacaaagaggttctcgggcttccccgccttgttctccccaccggggccgaacgtgagtttttgcttttgctccgtgtcgtatacttctttttgcggaaatatacttcggcctaattcatcgttttccttttcctctctttttcagttcacaccttagaggacgccaaaacggaggcatcgaaaatggttggcgtcctaaccacagccaaattcgcccgcctgcttcagcgtcagaccgatggccgggtgaaccgagtttatgttggcgaactgccaggttgatcaatcccctctagggccggcgacgaggatgtcggtacgtcgaagaagtgcaaacgagcggttgcaaagggtggccaggtgcgaactcgtcgcgccgctaaggacgcggccgaaagcgatggtggggaggaggaagaagacgatagggaggccggatctgaggatgatggatcgcatggttatactcctagcccagctagggtgaaatctggggtgggctctcatgtttcgcccgtgcgcccgcaagacattgctggagcgaatgcccttctggcgatttctagctctgcggcgaagccgggagctgttgccaggaagaagaagaagaaggggaaggttgtgcaagttggctgtggcttttcggacagtgaggggtccgatgggatgcccacttcgccgattctgcggcgcattcctcctcgggggagactgtcacgtcctgataaattcatcccgaattaaaaatcattcgctaaaaggaataatagagttaattaaaattcgaaaagaatttggcaaacactaaaatacgtacaagaaaaattcgaatgtggcccggagaatttttgttaaattatccttggtctaaaaggagccctcaaattttacttgaattttcagagcaccggaaataattattaagcaacaaaaacaattatcaaagtttatttaaaaagaaaaacctaaaaataaccctccttcctcctttgggccaagtctggcccaaagtcctccctctctcccctcggcccgcggccgaagtctccctctcctccctctctttctctccctctccttctctccctcctcctcttgggcctcctcccctcccggcccagctccctcccctcccctctctctcccgggcctcctctccctcctctcctcctgggtcgcctcggcttcgcccggcccaagccgagccgcgcctcccgcccgtgccgcgcgcgtgcgcgcgctgacgccgccgcctgaccgcgtggggcccacgcgccaggccggtcgtccccttccaaccgcccggccccttcctctctctccctcccgtgcgaaccctagcgccattcctccctcaaatccgcgcgattcaagcatgggattcccaaattgattagggggaattaatcccctttccctcctctctctttcccccttaatttccccttgaatggtgcccccaatcgccggaaacggccgcgccattcccggccgccttccattgccgccggccggcttttccgccgccgttccccgctcctcccgtgcccggctccctcccccatcctataaaatagaaccccctctttgcgttctaccgttttagtctcctcccgggctctcccgtggtccctagccacctccccgccgtcgtcccctccctcccgtgccgccggccgcctccagccgcctctccctcctcgccggagcgccgtccggtcgcgccgtcgcctcctctagcatcgcagccgcctcctcttcgccggcctaccctctgtctcccgcggagacctccggaagtgcctccccgccggcaaccgtggtgttgccgccacgattccgcctccggtcgcctctgccgcgtccccggtgcgccggccgacgtcgccaccacctctcccggcaccggagtgccgtcctctttcccggcaaggccacggcgtcgcccgaatttcgccggaacgccgtcgcccgcgtcggcctctccttcctcctcgtcgacgtctcctccggcagcccccttccgccgggcccgtgcatcagccggcgctgccgtccctccctcggcatggtggcgtagccctccacctcgtccacccctcggtttcgcccggaagccgccgcacatcgccgcgaacctctccctccacgccgtgcaccggtcggccacacctccaccatcttcggcatcgcagccgcgacgtcgtcctcggcctcgcctcccctccgaccgaacaccgccggtgtccgtcgtcgtcttcaccgttcatcctcgccggctcgtcgtctcgcggtgccgcctccgtcgtcggattcgcagcggcgcgttccacgtcgtccccgtctccgtgcagctgccgccggctgccctcatcgtctcctcgccggccccagtcgtcgtcgtcgtcgtcctctcgtcgttctcggtcgtcgtggcgttcgtccctccgtcgagccgttctcgttcgtcgtcagcgttcgtcaagcgagccgcggcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcacgtggtggtaaggatccctctccctcgctgccctgtcctcgtcctttcggtgtcgcccgtgctcgttgtgcggtcatcaaccccggtacccgtgtaccggtgtcggtagtcgttcacgtgtgcggatggtgaccgtgtagtgtccgtgttagtgtgcccgctcggtagccgcgtggtttccacgtgtgcaacccgtgtggtgtctagtggagtccgtttgtcggctactcgcctcggttgacacacggagtccgcttccgtcgacccgtggaccgtctctgtgtacccggtctaccgcggtcctttaggttgacatgtggggtccgcatgtcaacggcgcagccttcctgtcttttccaggctagcgcttacacatgttttatggttgcaaagcctaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcattccggaggttcccgaagcgtggtttgcggtcgtcgccgaaggttcggaaggccgttctctctgagcaaggcaagtcacatcatccttgaacatattgaatcccagtttataaaattattttgatttaaattattgcattaacgctttatttaaattcccgcgtgatcactgttttatttagccatgcctatttacctttgttatgaccttaatattattgttattgatattattaccttgttcaccctagattaaacaaaaccccaactagtggacactctattcatggttccacaagtatgaatttaggtagatgcttcgctgattaattaggcaatattaggtggttttataactttagactttgggaattctcatatcacctggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacctagggtcgggttgccagttcggtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaaggtggagccgtaggctcgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacacaagcgttcgggaaaaggcaattttcctggtcgcgacaagctggtatcagagccatctcgacggtaggataagccaagtggataaaacctaaggacatattttataaataaaactattggcgaaagttcctttttctccttcccctaatgctatttgcaaaatggtttacttttttcttccttcttcaaatttcaactagtactagatggtcagctttgcgaagaagaagatgtcgccaattgtttgccgaagctccggaagactgcaggatccgctagcgaagtgtaggaagcagtgaagccagctgtgaagaaggagtgaagatcttggagaaccagttgcagaacctaagccgccctctagggtagagtcgttagttgtgtgtttccttgcttgtgtgtgtagcgcgtggtttgcatcagtggggtgtgatgtaaccatgctaggttgtttgcttaatcaacctgcagaataagcaaaacaaacaacacatcaacaaaaagagttagttcctttaaggtcttgtccctagttctggtcgattctttccttgtatgcttcccctctcaacctctaccttgtgacagatggataacactggtaacaaaggctatgggaatgatggatccgatgactcaagaacccaagccaatgggaatgagaaaagcataaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgtattcaagagatcacatgttcccgcaggaatgatcgcactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaacttgaaagtgagcataatcggatgacgaactgcaagagaaggattgtcaacatcccagtatttccaggtggtaaccaaagacagcgcactgagccacttcagatcaccggatcttctgttgtgcatcaagaattcctgcccgaagaagatggacgcaatgcagacaacaacactagcaatactaatgatgatgataccaccaacaaccatggttcttgccccattagtgaccacccgaataaagcgtgcaatgtcagtagcattcaccaagatgtcaacgatagtatcaatgttggaacccagaatgacaaccttagcaattttgacactgagaaagactccaatggtgatagcaactatggtaccactgatgccaatgttagcaaggatttccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccgtacctgtgaggcctcatgttaatcctaacccatagtagaaacaatgtaccgatgttaagcatcttcccttttttgtttaaggtagtgccttgtattcatgtaataagggagacatgtgtgataaaaacaagttctatgaggattattttggaagatgctgatatgggatcatgcgtataattgtttactgtcaaaggagacctagggtctcattccagaggaactatgttctaacctcgagttaataaccaacctgatgatggaaaagaaaatcaagcgattaaccaaagaaacatttgttggactaagagtttcagatgtgtctttttcggatcaaaggcaaagacagtcagtatagcttttggcgaaacacttcaaggtttcactggaaggcagcaagccaaaggacctcattgtcaccagaagcatccacaactctcggagtggagagtacttggttgacaaagtttaaaaggtgattgatagaagataccagcaaaggtgtttattaccgggcaaagaagtaggtcgaaaggtgattgataagagaaatcgggaaagaacacatcaaggttaaaggtgtaaaggaatacgttgaatgctaactgaggacaacctgaaggtaatagtgggaagtaaactgaatgtaacgaaagtaaatccgagctgcctgttcgtgggaactattcccagttatgaaccaagtgaaatgttcgaagatagtctatagaggtcagattaaaatcacacctaacaacgaagcttcagatttggcaggaaaatgatcagacaataacaagttcagcagtaaagtcatttgggaagacgtcaaagcatgtcaagtgggataatttggttaccttgggaaacataattcaaaggcaaaagttaccgaccctcacattgaatagaggaagtatctagcaccggagactaggaaagctaatatgaggcagttggtgcaagttagaagtaaatgacaagcatgatattcttatgatgacaaacatggtatcctagtaatgacaagctagtgttgacgcatgacatgaagtgggtaagttgtatgaggttgacgccaaagatatgaactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaaggagtcagacaagaagagaagaccgcccaacctatcctcttgctagcctcctcgaatctcggggacgagattcctgtaaggggggtg

SEQ ID NO: 67183 - DNA, 5596 bp, Oryza sativa
ttcctgcagccctccgtccattttgcgccgttaaatacattgttcatcctataattaacggcgcggaatggacggaaccctaatggcgatggcatttttgggacaaagttgtttgtatgatggcatttcttggaactcacacttatcaatggcatttctgggatttggatgcttgtcaatggcatttctttgattatcttataatatataatgtaggcttcgaaatacgcttaaacctagtgattcggatagatcggacaacatgccgagatagtataaaccacttatatctaaaggtactttgaagcaaagattatatatattcctagcaaggccttaggcaaatctaacatgtattggctactgttctgatactaatttatactaagataccagtttagattaaaagcaaaatttgctacaggacataaaaaacgtgtaattagctgggagacaccgcaagaacggaaatatgctatagggcatcgcaaaatattggtaattagctgctggacacccgcgggattattttattatatccggagaaattggagagagaaaaaactgtgtaagtacggttctacccttcgaatttttttcttttttttctctatccttctctgttccttcttttccttgttcttttctctctcattctctctctgctcttttcttcaagcaagcccgagggagagggagagcatcagctacagcgcggcgaggcgcgggcctggtgcggcacctcggctgggacggcactgcgctgtcacgcacagggctaccacggtatgcacatgcacgctgcctccaaacctagctcaagcatcagtagcagcgggccaacgacagcagtagcacggtgggttagtgggtgtcgctttcagcacctccatgttctcacttgacatggccacacccatctgctccctgccacgccagcaccacgcgaccgacctcgcttgggcgcccatcctcatcgccgctccgcccgcgggacttcaccctcgtccaccacgtcggcgtcggggacatcgcttgaaggagaatgcgtcggctcgtcgtcctcgtgcgagtacgccatgaaggtggtggactgccgtgcgctctccaagaagggcaagctgggccacgccgtcgcggagaagcgcgttcttgtaagttcaagtgccttaatttggtttggtgattaatgacaaatctaataatatgagactaacgtttttatgagcttttctttgactagtctcgtttcgatatgaaaataaaaatgatgagagttgtcaactaggttatttcccgatgatgagatgtggtagatatgcattctttggtgatggaccttaatcatgataaggataaaatgcatggagataaaacgttatgtaccacttcttatctcctactttttgataggttcatatatatgatttccatgttattgttatataagtgtgagactaacgtttactcgagtcgtatcttatttagtctcatttacattaagaacatggagatcatgaatgtatgtgttttatgttggtctacatcattactacatatgctttctctatgtgtacaggataaacccccattggtcattctctaattatgcatacacttgcatctcttgtatatttatttgtatgcatatatttagggggagcaaatcctatacatttattgtgcatgttgtagatccatgttgttcacctattatttatattggatctttgcatttaagcttgcatgtgagtatatgtcaattgtggtgttaatgaataatgaatactcaacaaacatattcatatctttcatatgcaactggttggtcatcaagtgcaagatgacaaccgatttgttgggactaatgttctcctttgagctgtgcaaaggaataggtcccaccgtgatgaggctaatagatgacaccatggtttgatgatcaccaagccaaggacatcgccatgttgacaagaatgaagtcaagattgtgatgagatgaaagtcttgacaaaggatggtcaagacctaggcataaacaagattcaactgaatagtcacatgtgttgatcttggttcaagcattgaccccaagttggatggcacaaggcaaaggtataatcgagcgaagatgttttcttagtctttttcccggtcttcgtgtttggtgtagaccggatttgctagataggcgccatactatcaagaggggtctatgaagcgagcacgtggatgatcttgtgccatattagttcatatgaatgtaggagcatttggtgggcttgtctagccatgtgtgatgagttttctcatgtcctaaacaaagagagaagtgagcaagtccaataggagcgagtgacatcttgtgggtatgtctggtggatatcctttggagtgtgagccctttatccttgacttaagttgtgtttcttgatgtatttttcatgggttggatagctccttgaataatctttccatagagtccaagaacatcaaattccgagatccaagtcaagagatatcgtcattttactgtcggtgggtcgtgctgaaaatcggtcggcggtcagaccgaccttgtgtagccggtcagacctcccgaaggccccgaaagcccgccaacggctagtttttttgtgcgttggactgagggccggtctgaccgggtttagaagggcggttagaccggcaagcacgtcctaaaaggtgttttagcctctaacggctagttttggtggttgggggtatatatacccactccccagcagcaagggtgaagttttggcactccattgcattatcttgaacccttgcaagagctctcacacccttgtgcacttagtttatctagtgaggtgttagagagtaagttaagccaatccaagtgcattgcttcattgttatagctagtgtggcacttggtcatcctcggcaagcatcctagacttgttactcttggaggttgccgcctcctagacggcttgtggaggtgttgcccggtgacctctcaaaggagattgtggaggaggcccggtgccatttgtgagtggtttggagttcaccaccttcggagtgaaggaagaactaccctagtgatcgaggcttgggtagtcctctccgtgggccggctcccaccatgcccaccccttgacgaagggggcgtgcggtggcttcgttgttgagcggtggagttgggctcgcctcaacggggattaggaatctggcgagtttccgaacctcgatgaaaaattccttgtctcttgtctcatttatttgttgcatttacatttgtgcaatttacatccatagagacatatttgagcccatatcacctaggtttgcaaaacttaacttagttgcttagttaaccttgcaccttaccttgcttagcaacttaggttagttttgtttaagtgccattaagttttaaaaccgcctattcacccccctctagtcggcctccttgatcctacaagtggtatcagagcttggtttctctttttatggacttaaccgttccgagagaaaaggatggcttctagagatatagtccacccgggtggtgaccctcttatatttgatagcacaaattatgcacaatggagaattcacatgatttctcattttagggccatgagcccaaaaatatggtggattgtagatgtgggcttttctcatgctttggatgaacgtgctcccacaagtgggcaagagaaatgcctacatctcgatgctcaagctactaatgctatattttgtgctttgagtgatgacatttttagtgaagtatgcaatctcaagagtgcacatgctatgtgggtaaagcttaaagaaaaatatgaaatgcccacacttgttgagaatggttgcacataaggacggatgtcgggtgaagacttcacctcctcaagagatgatgaggagctcccaacaccattcacatcatctcattacttaatggcaaatggtaagaatgaggtaaataaagattctcttgatattactattgaaagtagtaatggtgatgatgatgatgatgatgatggtgatgagccttcatatgatgaagttttggacatgcttagggaggctagtaaatacattgccaaagagaagaagaaaaattaaattttagagaaaactcttctctctttgaaagactcaaatgtggagctaataaattcttataaggaactttgtgattcttataagaacataaaagaagcttatgagtctcttctcattggcaatgcatttagtaagccaaaggtggacataggtatcatatgcaatttaattgatgatgatatgccatgtgtagctagctcatgcattacatctaagactaatatgtccacctcttgtgatgacttgcaagacataccttatagctcaaacatagatgaaaactcttgttcttcctcctctatgtatgttgttgctaaccttgtagaggaaaacaagcaattacaagccaaagtcaaagatttaaaagaagacttggatagaaactacataaggaagaacacacttgacgaaatcctaagcaagcaaaagagctcaaatgacaagtgtggacttggcttccaccacaaggagaatgctaagaagacaaggcacatgcctagatatacaaggaagcatgcatacttaagaaaggatggaaagaaaaatgtgagtaagaaccatcctcacattacatgttgtggttgtcatgagaagggacactttgcctcgttgtgccccaaaatgaaggatgaaaagtacaactccaaattgagacaaactggcaagaagacaagtcatagaggtcaaagcctaacttgctacaattgccgcaaaaagggatatattggtaaaaattgtctcataggtaatacttctaagcctaatattatttttgatgattatgtgcttaggaaaaataggcaaggcaatgtgtttgccagttatgttggtttacctagacttgcacctagaaggaggaccatttgggtgccccgtattttggtaactaacattgatggacccaattttgttggggaccaaaatgtgccaaaatgagaatataggtacatgagaggcattgaagttttggcctatgctagaaaatgtgattctcaccaagttcaagaattggagccaataatgaggatgaagaattcacatcaagaaccaatgccatctcggtaacatgcttttggtttgtaatttttttatatagccttatgtatgttgcattgcattctcatagctctttccaaaattaaatttccctctggtatgaaaatcgtcatatatgcatgttaagcataataaatgtggcatatgaagctataggtttggtcataatcacacatcatgtttgcctcatattgcttttgtgcttattgtcaatcatttttttatcttagttcgatcttgagtttattttcctatctttgttgagatgaagagaatatcccattaaggaaaagtattgcatttctggcaaaggcactacaattctaagaatgtgaccaaagtgatcaaagtgcaagaaaggttttcaaaaggtccattttgaccaaaagtcaattttttgagagggctgcag

SEQ ID NO: 67184 - DNA, 23257 bp, Oryza sativa
aacctttgcttgtcccgagcgaaggacgaaaggaaacaatgacttggttgttgattaggatttgctactatgctgaatatctcaaagatacaggtgcaaggtatatgtactctctctcagattaaataatctttggcacggtggcttacccttacccctgattcccacgagacactgcttctccttgccttgggcagttgaaagacagaacagcaattagagcaccaatcacccgatctttattcaactcttgttctagaagttttcaaatgattttggaaaagaaaactaagttcctcaattgattcactcagtctctctaagtgtatcagcattatttcctcaccaaaagttgccttgttgattcctactctaacgtttatatgtggagctcggtagggatttattactgagtcaaaaacttagagtaaggtttatatgtgggtgtatgatcttgatcatagagcatgagaagtatctacacaagtcacaagagtttgacaaagttcaatggaatagcaagcaactaaaatgtatatggtgtaatcatgatagcacatttttggctctggtaggaatttatatcaaatgaggaactttcaattttatcatttttgaaaaacaaaacatccgaaattcaagccaaactagtatctggatcatagctactcatatttactatctcatatctcgcaacaacttagacttagatcagcaagtacagcccatttacctcaggttcccggatagttgttggctacttatatctaacctttgagagagtacttaccaagaacccatatatcagagatataaaacagagcaactattcatcatttcaacaaagagaactaccttgtcttacctagcttgactcaaacctatcctatctttttggtattttctgttttgcaaatttttatgttgtttttatttctttataggatgcaattggaaagcaaatatgctattggaaagggaaatatgcaatgtgatacaagttacctcaggggggggggccaagtctccccccaagcttggcttttgcacagggtccttgataggatttaatccctgaaagcgaaagtacgcttgaaggtcatcgtgctgttgctgcatcatgttgttgatgttggcgaactgagcatcagcagattgttgccattcttgcgtctgagctatgtgttccgtgaggttgtactgaatctcccccatctgcacatcaagggtgtccattctcctagtgatttcacccaagtcccaacgagaggaacttgagcgccattcacttggggatggaggcacaccacttgatttggagggttggttgtccccccagtggatgtcatgaggcgcatgccaccggtcctcactagcgcttgcccaggttgagactctgatgctatggcgtgcagcttgggtccatccaggtgcatccccagttggtgcccaacctgcctcatacatctgcacaggtgtcgaggatgatgaacttccttgttcgttccttgtcatgttgcgcgtctccctgtatgttccacctgcaagagattcttctatggtctgcaggggaatgataagttcatggcagttgtacaaatgataccccgcatttggcaacgggatttcatttgtacaaccagggaaaaagtatatcaaagattcatctactccatatttcaaaatattcccttgcactagataggcctcatcaatacgcggacgagcggctgagataaaagcaattgggtcgctaacgacccctagcccttttgctatccgagtaatcagagaagtgcactcaacaggagcagagaactttatactttctaatcattgtcttatcatacatttcacaggagcaaatttgatctttctaaccatggcaaacatgataattaattcatctcccctaatggatctcagatcacttctaggaaacaaagtcatagcaatccatttgtgcatgagcctaagtgtaggattatgaatatcatttgttctagttttcttgcaaattggagcaccagaaatatcttcccaaaacctatttttctcgaacccagaaattcctttttggagatcggttttacaggaatcgtgaaaaccaagaagtgtactcaaacctttccatgtgagcgtgaactccttacggaaaaagtgaaaagaaataccatcttctatttctttcaaagtgcatagaaattgcaaagtaagcaaacgagaaccaggctcatctaccacagcaaatctctgccaaccaatagctttccaaatagaacgaaattcaacatccatacctatttttttcagcaactccggtgagtattctcgcatgtgagcatacttctggtcgctcagcatgtagtaggcttgtctctcccgatcactgacaaggtcgaggttgtcacgccctgaagtttccccctacttctttctttaaaatttgggttaaataaatcgtccggagaaatggttcaaattaacctagagctaattccctaactaatgaatgcaattaataattggaaatggcattgtgggatttttcttgggttccacatgtcgcaatacattaacaagatttttagtggaattttcagagccgtggaaataattttaaccatttaaaaatgagcaagtgcaatattttaaatcccaggaaaaatcctttcttctttttccttttcttttcctccttttttccctcttcttgggccgttggcccagtccaccccgtcgcccgcgcgcgcccctatccttcttgggccggcccacgcccctctcctcctcccttcgggacgccgacaggtgggccccacctgtcgggttgtccccaacctccggccgcccacgcccgcgccaaccgccgccgaaaccaccgcccacgccgccgcgtatcccgctgctcccgcgcccactccgcgccccgtgaccacgtcgccgcccacaccctcgctttcccgccgttgcatgcgcgcccacaaggggcggattcaattttgaatccccatctctctcctcctccacctctccacatcgtcgccgcggaactgccgctccctgccaaatccggcatccccacctctatataatcgtccaccgcacctctctccaccttttcccctctttcgccgcccactcccgagctccctaccgctcccgcaccgtgcacccacccaccgctgcttcttccactactccggccgcctctagccaccgctagggccgccgccgcaccatgccgccaccgccgttgggttcgcgcggccgaggtccacctcgtccaccacccctccgtcgagttccgccgccggagcccgcttctccccgcgcgccggtgagcttccaccattgccgccgccttcggccatggttctcattcgtcgcggagtccctctctccctctaacctctctcttttcctctcttaaggtatcccggagcccgtccgcccatcgccctcgtcctcccgtggcttgccgtcgccgttcgccgttgctctttccccacactggccgagcccctcggtgaggacccgactccctcccttcctctctctctttgtcgcgccgcccgccgcttagcgccgccgctgtccgccgctcgccgtcgtgcgccgccacttccgcgccggtcgccgcttcctcccgcgccgccgcttgccgtcgccagcgaccgctcgccgccgccactccccatggccggccggccggttttgaagccgagccgagccgtgcctagctgccgccgcgccgtccgatcggcctcggggccgatctggaccatcggtcccgtggaccggcggtggaccacccgcatggtcccggtccacggtagaccggcactgatgcggacatcacaacctccgatacacacaacaatcctccaacggtcattcaaggaccgataacaagagctcgtgcgcgacaattaaatttagaggtgagctcgttcctatgttcttctttgtatgaattcgagaatagattgctacctaatgattatattgtgattaggaacaatggaggggtaaaggagacacttggagaaggacttagagccatggaggatcatcgaggacgtccaagtcaaggtggagggccaaaccaagttgacgtcgggtgcaattcggagtccagatctagtctgcactaaaacgggcgcctaggtcgcatacgtactcggattggggcgtctttatatggatggaaagctaagaagataacctttccaatggttttggtccgacgtccaaattctttccgagtcaatgggaattgaccgaacaagttgacgtctagaatctgtcccggtgctgcgtcaccgtatttgggcctttggcccgtgtatcgtgttggaacccattatttgtggcctaaagaatttgttattcactccgatcacgaatcgcttaaatatcttcgctctcaaaataatttggatcgtagacatgcaaaatgggttgaatttattgaatcttttccttatgttatcaaacacaagaaagggaaagataatgtgattgcagatgctttgtctaggcgctatactttcttgtcccaacttgattgtcggatttttggacttgaatcaattaaagaacaatatgcgcttgaccctgattttaatgaagtgatgataaattgcaaagagggacgtacttggaacaaatttgtgatcaatggtggatttgtttatagagctaaccgtctatgcattccagttggttccgttcgtcttttgttgatacaggaggcgcatggaggagggttgacgggacattttggagctaagaagacggaagatgttttggccatgcatttcttttggccaaggatgagaaaggatattgagaggttcgtggcacgttgcaccacttgtcagaaagctaagtctcgtttgaatccacatggtttgtatatgcctcttcctgtaccttctattccttgggcagatatttctatggactttgttttgggattacctagaactaagagggggagggatagcatttttgtggtggtggatcgtttttctaagatggcacatttcataccatgtcataaaagtgatgatgctgttcatattgctgatatgtttttccataagattgttcgtttgcatggtatgccttctactattgtttcagatagtgatgcaaaattcttaagtcatttctggcgcacgctatggaacaagttgggtacaaagctattgttttctacaacatgtcacccacaaacagatggacaaacggagatagtcaaccgcactttgggtaccatgttaagggctattttgaagaaaaatttgaagatgtgggaataatgtttgcctcatgtggagtttgcatacaatcgggcaacacattctactaccaagataagtccttttcagttagtgtatggtttcaatcctcgtgctccaattgatattttgcctttacctactagtgagagggttcatcatgatgctaaggcacgcgctgaatttattttgaaaatgcatgattcaaccaagctcaacattgaaaagatgactgaaaagtatagaattgctggtagtaaaggtaggcaagaggttaagcttgaaccgggtgatttagtttggttgcacttgcgaaaggatagatttccggaattgagaaagtctaagttgatgcctcgtgctgatggtccttttaaaattgttgagaagattaatgataatgcatataaacttgagttgcctcccgagtttggggttagtcccacgtttaacatttcagatttgaagccatacttgggagaaaaggatgagcttgagtcgaggacgacttcaattcaagagggggaggatgatgcggacatcactaactcggatacacacaacaatcctccaacggtcattcaaggaccgataacaagagctcgtgcgcgacaattaaatttagaggtgagctcgttcctatgttcttctttgtatgaattcgagaatagattgctacctaattattatattgtgaataggaacaatgaggggtcaaggagacacttggagaaggacttagagccatggaggatcatttgggacgtccaagtcaaggtggagggccaaaccaagttgacgtcgggtgcaattcggagtccagatctagtctgcactaaaacgggcgcccaggtcgcatacgtactcggattggggcgtctttatatggatggaaagctaagaagataacctttccaatggttttggtccgacgtccaaattctttccgagtcaatgggaattgaccgaacaagttgacgtctagaatctgtcccggtgctgcgttaccgtatttgggcctttggcccgtgtatcgtgttggaacccattagggttgcgtcgagaggggtttgcacgaccctaaactctatatatcagtacccgccgccatctttaggtttttggattttgcttagattaatctgtcgagaacagtttcgccgctagatcggtttgtaagaccccaactcgtgagcttaattattcatctgcaacattggttgtttttctatctcgttcttgtttgtgttcttcgattggcaaacaggaattagccttttcggcgaggtcatccccgtttcgacacaggtgataactagaggagacgtggtgctgcgattgcggggctcaagagcgtgtgtgttcaagaagccggatcgatttgtgtcgcgactccgtccaaatcgttgtttatcagaacctttcggaagatcagaaaccctagtgcacatcaggcaccctttgatccgctgccaagtggggcccgcttgccggcgccgccccccctttcgctgacatcagccctgggcaatattgcgcaataaagttattaaggacttttcatccgagctccgtttaagtccattcaagtctcagtaaattcataaaaatccctagaatccattaaaaatggttttgttctctgtttcagtagtcttatagtgtgttttgcttgtatgctttgtttgtcgcatagatctcggccatttcgtcgatccgcggttcctcgaagacgttgctgaggtctcatcagtgcgagagcaaggcaagtcatgcattagatttgatcatattgtactcaatttacaaatatcctacatttctattaaatgttgcattcttttacaatgtcatctgggatgggtcctattactcagccatatattgtttaccttataccattgataacttgggtatcaaaatgactagatgttggtttaggaaatgcttagctatgtctagctcaactagtacacaaatggggatcacattattacatagactttgactattagcatagctttggattggtgccaccgcgatggtgttagttaattaaaatacactgaacggtgggctgtgggtacatggttttactggtcgcacccatggcagttaaggaccggttcacgggaaaccctgggagacttaccatgcttaccacaagcgggagtgggtaactgcttgatctgaagtatagctcgaccctttcctaggaaccggtggcgagggtgggcatgatggagttgggtcggccggggtgtctggttgtccagctgctggattcaccgcggcgcaagaggggactgcccactgccttttgaggggtgggggtgaaaccttagcgtggtgtggatggttaggggagggttatgcggagggtcttgtcacgatttccccctttgcagtatcatggtgatacttcggggcatggcgacatgtgtggaatcgtgtcttgtgggtacagctgtacacctctggccagagtaaaactattcgaatagtcgtgcccgcggttatgggcgatcaaccagattcaccgtgattagtctcacccctagttagctaatgaactggcgtagttcaggtggttggttgggcctgttgcaacgtgatgtagtgttgggcagtgattggttaatattgattaattactacaactgttttactactttcaactactgcttttaaatgcctgctttattgcaaatgaaccactagcctcctttggttatatcctgcatgacttgctgagtatagtgggtagtactcagtcttggtctcttttcccccacaccagagctgatgatcttcctagtgggagctgtcttgttgaagttggtttcgtcgctgccatcaaggattgcctgtggagtggagtcgccccgcagcagaagtcaagcctccaagtttagtttgttttatctttttccgctgcatttgtaatcttttctatttttgtaagacgtggatctgtatgtcaacaattattgtttgtgtaccctggcttgtcctggacagggatttaatgcacattcagcttagaaattccgattcgtgaatttctgggcgtgatagaggtcatcgtcgctcaggagttgttgcggagcgtcggcgtcttccatcgagacatcggctgatgagcaagtactagactcgtcatgacgacttgatggagagcctgaccccttgaatagacgagacagtcgcctcctcatactgcacaatggagcaagaactagctatctcggcgggggttagaaatgacaagagtttcacccgccggttagtttcaccaaagcaacttgtatgtatgcaactaaagatttgaacttgaggaaaactatcaaagcatgaatgaacttgaaagcaaactttggagagggaatgaaaatgtgttgaaatggggtggaattccctctctcggtcggctggcttttatagggtgcccacaacggtcaagaatgacatgtgggacccactagccgttgcctcaaaaagtgaggaagctgaccgttgcctggccggttcggccgaacacccctggtgggcccaaccggccccactttcggctgttggaatccaacggtcagtgcggtcgtggcacagtgaatttttattgaacaatttattttggtttgctctgaaaaatagatttgaataatttcctcaaaattcaaaaactcaaaatgcaattttgaaattcaaacatgtgttgatgcaaaaattcaaattgttgaaaacaaatatgcggatacataccaatttacctgttggcgaaggtcgcgtcatttaaagtccgacgtgcaagaccgtacctcctttcgattcagtgcgcggattttccacccgtctccggaggtgatggagcaggcgcctttggcttttccttccacacgttatttgatttcggtgcggaaaacagcttcttctgagccggctgctctaacttcttggccggtacaggtgattttaccggtgtcctccaataacggttcctgggcattgttttttccttttccaggaagttctgcatgaactctaccaggcttatccgtcttgggtggctccacttcgaccacttgaatattctgcgggttcggcccgtactagattctgaccatggagcattgttccgtccttagttgaaactcaaacttttcctccttcccattgatatggaaacggatactccccattcccacgtcaatgttggctcctgcggtgctaaggaatggatgccccaggattagcgacgtctccttccccgtgtccatgtctagcaccacaaaatcaaccgggatgaagaaatcccatatcttgacaggcacatcctcttctatccccaccgggcaatggactgacgagtcagccagttggaggcgcatcggtgttggtgccaacaccgtgaagttgagtttgtcaaagacgtctttgggcatgacgctgacgctggcaccaaggtcgcacaaggcctggtcgaattgttgtgccccgatcgagcaggtgatcgtgggacacctcggatctttcttcttctccgggagcttgtggagtatgacgttgctgcagtgttccgtcgttgggagtggtctcttgttgttgagtatgtccttgagataacgggcgtatgttggtacttgcatagcgtccaacaacggcacgttgatgtggatcttctggattacttcaacagaacgtgcgaactgctgacggtttcctactccgctgagggaatggcagcaaccgtgtgtcgcagtactcctgcggcacggttttctctggctgaatctccttgtcagccaagtcagtagatggcgtttcttttgacatcccattagttcctgcagggttaggatatggcggatcacgagtggacttacctcccctcgtcgtgatcgccttaatattttcaatggaggagtcgggttgccccggaatcctctcggattcatttgcagggactaaagatgccaactgagctaactgggtttctatcatcttattaaagctcagctggttttgaaatgcagaagcaaagccgtctagcttgacatttgtcgacgggggatacccatagaccggatatagagggtattggggtacgctggtacgaggatctacgtagtacgacatcaagcaaacaaaagatagggattatactggttcaggccccttaagaggtaatagccctaatccaattaatatgggattatatgatggaaatcacagattacaaagagaatagtggaactcgatgataccgatgagatcgtaatcaaatcggttcgactagatcacccagcgacttagctcttgcaggctccggcttcgtaggctgtggtggatgtgttggcagtcaaattcgatgccctaggtcctcccgaggggtcccttttataccgcaggttagttggtctccaagtaggactcggagacatcggaccctacacgatacagtgacgacccagttctatccgagtagggatccttcccatctgtgaactccgtgatgaatttccttaacgtgtacagagaacgtccgtatacgcgtagatataccatatcgatatatgacgtatatccaagggtagagggtatactttatctataaccccgacaatagcccccgacttctgcttaaatgaactcatatgaccgatcgcgacttctgatgttggggttgttgtcgttctcgactggttgatctcggtgtgagaaccgtagagacaaggagtaatcaacaacaccatgcgaagttcaacggtcatgagtgaatttaaattgaagtccgaaaactgccgcgcgtaacggacccagaaattttcggcagccatctctctcctttccttggaattcgtaccgtcggtagtgcgtctatttaagggagttttgggtatccacgttgaagtccacctgctgcgaaaaactttccagcctccaagcgctcctcgtcttctccgctcccgcaaaaagccaagcttgctcatctcagtctcttctccggcgatctacggcggctatggatctcgacaagtccacttccaccggtgcatccctgaagaagctgcaggaggacggcgctctccccagtcacgagaccatggagagagaactaggaggtattgaacccgaacctatcctgggccgcatggttgcggttgaggactatattctttgtggttttcttcctctgccttccgaatttcttcttcttgtcttgaatttctacggtctttcgttgctccatttgaaccccaattccatcgccttcctcagtattttttccgatctttgtgaggcctacattggggtagagccgtttcttgatctctttcatttctactacgagttgcgctggatggaacctaagaaggtatccggatgtgtcggtttctgacttcgggatggcctgaagtcgcgatacatccccttccagtgcccctcttctcatagcaaatggcgggcgaggtggttctatcttcagatagagaattcggatcccgtcttcgttgtcccagaggaacaaccagacaagatttcgtcttggaccaccaaacccgccttagccccctcccttcagtccttcatcgatatcatcgatggcctccgaattcgagggttgtcggggtatgaagtcgctgccgacttcattggtaggcggatccagccgctccaggctcgagcccacccagcctttgactattcttggccggaggacgggacccgggtttctcctcggggtatttttcttatatttcagattccattccttatgtgcatgttcctccttttttatcgaattctggttctcgatctacaggtttgaacagcgaaaccgtggagcgccgcgtcggtcaagtgatgatcaacggccccacaacggcgagcaacgtccctatccccctttgcgagaaggggacagccgagcgtgaagctgcaatcaacgtgagtgtactcgacgacccctttatccttttcttccaggatcgcattgtgattcatgtagtgcaggctctccctctgactgacgtcatcgggccgctcgtggaccaccaggcggcggcttcgttgaaagagggcgtcacccaggaggtgtccgacgttgctgctgctgctgccgctgccacgaccagtggcagcaacattccaaaaaagggaaggaagttttcctccgtggtttgtaaccgtcggaaggcgcccactccatcggtaagcccctttggtcacttgttgcgtagtcggaagatattgtcctcacaccgtactcgttttacttaggcctctcccacctcagcgacggcagaggatggtgacacttggcgagaagtaagtagacgaacttgaggtcttgttatttcattgaactctggcaggccgtcttgatggcaattacggcaatccttcatagggcggcgcgggcaaaggcggcgcaagacgggtctggagggaactccagtgcgtctcttgcagcggcttcgaccgaggttgtggtcgtgcccaagagtcgtgaggcgacgcccagcggctctgtcggcggccttgtgcccgctcgaggcccgctcgctgacatcctcacctggggggagctccaaatcgagatggagcgcatcctccaggctggtgctcgcaggatagggcgcgagattgaggaggcgaaggcggtggtgtcatcgtcggtgaacgaacgcgccaagctggcgcgtgacctggcggaggtccacgaggacctccagaagatgagggagctggtggtcggcaacgagcagcagcggcaggggctcgagcaacacatgtcggagctcgagaacaacctgtcggagatccgcggctcgctgtggaccacctacaccgggctgaaccagctcgccgtggagtgcggtgttacgaccaccatcccggcgaatcccgacgagttctcgctgatgacttcacttgcgaaactggcgacggcgatggaggagatcccctccaagcatgcggccaggatcggggaggagacgtccaatgggatctacatcggggcgtgccacgtcctctcgtgcgtaaggttggcgcatcctgaactcgacctccagaggatcttggatcagggggctgctaacgacgcgcgtaagggcgtgatggaagaagtcagagatctgggggagtctgttctccccctttttgaagaataggatttgagttcccctgtgctccttagtcagtcgtgcttgtaaaacttttgttggttccaactgcctttgtgtgtgtagtcatcacctttgttttctttagcattttgatctcgagtactttgttgtcgttgtagagatgtcgatgtcgaggatgtctagcagcgcgggtagcctgagttgcctgtaatcgttccggcacttgcgctcgagccgtatgtgccgcaggacgacgtagatcggaacttgcccgtggaagcgggcgtggcgacgacttccttaggttggttttttttgttttcatctgctttgctgatttgtcgggattgacttaatttgtcgtgttctcgagagagaagaacaacttgacttagccgtttccatgctgagcagacctcgagagtgcgctggccgaccgagatcgtcgcatccaatactggaggacgaagttcgaggtggccgaactggagaggactatggtggaagtgaagaaggatcgggctgtggaagcactccgaggtcgcgaggtgtggttcaactcgtacctcaggagctgttgcgcggtcatggctggagtctccagggaactccaggtaccacgcggggatcccgaggagtcggcggccggatatatctcgtggttgaatggggcctgtgcccagctcgaaggtatcgacaagcatatcgacgaggccctgaagcaggagtgccgtcgatagagccgatatgctggagggcatgtgctggcctgtatcagagatcaccgtccgcagctgcacctcgagttcctccacggagggttttcacgttctcggaggactcccgcagagatagataacttggcgaagtcgatggcgccgcttgcggagaaagtgttccagtcgatggactggcgctggccttcctggtagtctttatatcctgtgacaaatatatcagagagacatgtaatatattttgaaatttttacgaactgtaagaagtacttgtgaaatagaatataaatctatctaagtctccttactctggatgtggtgtgtaagagtgtcttctcacttcgcgacttcgatcaatcacttgagtcatacactctccctagcccccggccttgtcatcggagaatttttctcgaaagataaggctcttggacctttgacctgccttggttgaacaagcactgatcctagccaccagccgtgaagttagaaaacccaatttccgattacacggcttggttaatacgcacggtgagaactcttacacgaccagatcttacatggtcttttgtctctacaagatccgacaaggccttatcggctctgggcgtccccagccgaagttcccttagattcctcggaggccttgtcaagacggcgtaaagggacagtaggataggtttcaacgctaggtgtcatcgtggtaaaggatcgtcaggaaggaacaatttgattgtaatctttacctgaaaataaactttattgaagctgtaagatgtcttacaagtatgaatactattgatttatacatagaatttacgtaattgatcaatgttccaagaatttgccaactctcgaccatcgccgtctgcaatcttgaatgtgcctggccgcaagacatgcgtgatcgtgtacggtccttcccatttgggtgagagcttgtttcgccctgcttggctttgaacccgtcggaggacgtagtcaccgatcgaaagtgtgcgtgctctgatgcgcttctcgtggtatcggcggagggcctgttggtagctggctgctctgacggcgactctttctcgatgttcctcgagtaggttgacatcgtcgtttcgctgctcctcctgattctcatcgaagtacttctatactcgtgtactctgatgtcgtagctcagtggggagcatggcccatgagcgtacacgaggaagaaaggtgtctccttgttggacgttgtcggtgtggtacgcacggcctatagtactgatgggagttcttcgacccacttcttgtcgtgtgacatgagcctgtcgtagacacgggtcttcattccttgtagtactatgtcgtttgccctctcaacctgtccattaaactgagggtgagaaaccgaggcgaagcagatcttgactcctagcctgatgcagtaatcctggaagtcggcacagatgaactgggagccgttgtccgttatgatgcggtgaggcaatccatatctgcagaatatccctttgatgaatttgatggcgttgttggccttgatttcccccgtgggtgtcgcttcaatccacttagtgaatttgtcgatcgccatgaataggaacctgtagccgccttgtcctcgtgggaatggtctgagtatgtcgagcccccagcacgagaacggccaagtaagagggatagtctgaagcgcttgcactggtagcttagtgtgtttactgcgaaattgataggcttcacaccgctgaaccatgtcgcaagcatctttgagggcaatcggccaaaaaaacccttgtcgaaaagcttttccgaccaatgtgcgaccggcgacatgcgacccacagatcccttcgtgtatgtcgaggaggagatgtttgccgtcgtcgaacgagacgcatttgacaagtaccccgtttggcgccttcttgtataggtcgttgtcgatcatacagtagattttggcttgacgggttattttctcggcttctgcatcgtcctcgggcaactcgtcgctacttatgaatttaatgagcgggatctgccagtcgtctatggtctcgatgtcggcaacggcgcgctctgcctctatatgatgcgaacccgctagggtttatggcccgatctttcgatgagaggtaagggataactcgattagatgaagacgacgttcacggcccgactacaactgtccaaagacgctgcgccttagcaaccgatacaccgtctccaatggtcgccgcgaacttgtggtgcgcatcaacccggccacgagggcactcgtcctgcaagcaatcgaagaacaagcaagaacaagtaggacaagcactgaaattgctagataaagatgaaagtttcactatcaaacacaatatggtgggttccgattacaggcagacgggcggtttagccaacacgcgcgctgcgagccggtagcaagaagctatctctatcatcaaaacccgcctgttcttggcggccactagaggtataagaagaggggaagaacgaccatagggtcgtgctccaaccctagggcgtgcccctaatgggcccaacttggatacacagcccattgggccaaaagaggtgacgcagcaccatggacagaaaatagtcgggagtaaaatgacaattgcggccgctccagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccctgtgcgaatcctcttccctttggatcctctccatcgttcctgagtaaaacacgagtgcacgcgtctccggggtataaagacgaggaatatgaactcaagaaagaactcacctgataatttagttgacgtgcacgagcgcgggtaataggaccatcatgctgtacatggggggacgtggatgtatcgatggtgttgatgtcctcatcactatagcccccgagctgatgtcgggggcgactaggctatcttcattgtttgcctctttcactgatggctttgtcaggacgtccaaaaagttgccaggttcgagtggctcccgtctggacgcacgccttgctagatcgtccggttcgatgttgtcattgcggtatacgtgtcggacctcgattccatcaaatcttttttctagcttcctaacttctgcgaggtacttggataactcggggctagagcacttgtagtctttgtgcacctggtttgcgactagttcggaatccccttttacgatcagtcgcttgactccaagtacagttgctgctcttatcccagcgagtagtccttcgtattctgcagtgttgttggtcgccctgaagttgaggtgaattgcatgcttgaactgatctcccgaaggtgatgtcaagatgaaccctgcccctactccttggctgttgagtgcgccgtcgaacgccattatccatgtttcgttgtcgatttgactgtctgacctgttttcaggcatagtccaattggctacaaagtcggccagaacctgggacttgatggctgttcgtggcacaaaatggacatcaaactagcttagctcgactacccatttcgcaatgcggccaacaacgtctttgtttctcacgacttcaccaagagggaaggaggaaacaactgtgaccttgtgtgcttggaagtagtggcgtagctttcttgacatcatgattactgcatagagtagtttttggatctatgggtatcttgttttcacgtcgtggagagcttcgctgatgtaatagactggtctttgcaccttctctctctcgacaacaatgacagtactaacggagtatggcgtggcggcaatatagaggaataattcttcattaggttggggagcaacaagtacagggggatttgacaggtagcgcttaactgcgataaatgcctcttcggcttcctgtgtccatacaaatttgtcgtgtttctttagcagggcgaagaaaggttgtcctcgttctcccatcctagcgacaaacctacttagtgccgccatatatccagttagtttctgtacttccttgagtcttgtgggtgacttcatgttcttgattgccttgatcttctcgggatttgcttctattcctcttccagagacaaggaacccgagcagcttgcccgatggtactccgaacgtgcacttctctggattgagtatgaggcaatatcgtcggaggttgtcgaacgtttcccgcagatcgtcaatcaatgagtcgcttgtcttgatcttgacaacaatgtcatcgatgtaggcctcgacattgttcccaagctgatcgttaagtgccccttggaccgtgcgttggaaagtgtttcctgtggttatcagtccaaatggcatcttaacgtagcagaatacaccgaacggcgtgatgaatgatgtcttctcctcgtcctctttcgccatactgatttggtggtagccggagtaagcatcaagaaaacttaacaactcacaaccagctgttgagtccaccagttggtctatttgaggaagagggaagtgatccttgggacacgccttgttgaggtcggtgaagtcgacgcacatcctccacttcccgttggccttctgcaccatgactgggttggctagtcattctggatagagtacctctctgatgaagccagctttaagaagcttatcgatctcttctcgtatggcctgttttcgatctggtgcgaatctccgcagtttttgtgcgaatctaagtagatcccctacctggcgcgccactgtcgacgggggatacccgtagaccggatatagacggtattagggtacgctggtacgaggatctacgtagtacgacatcaagcaaacaaaagacatggattatactggttcaggccccttaataggttatagccctaatccagttgatatgggattatatcatcgatttccattcaaccggtgagccatttgtcgatttcttgcagtagtagcaaccttaggtggtgttctacatcctgcatgtgatgttattgacatgcatgcaatagaacgagccgttcaccgccgtgacgcacgggtgcatgcatggcgtcccgagcgcttccgattgcagccgccgcctgcgtcggtccagtcaccattggcgggggaaaagttgaggaatggaatctcaatgtcttgctctacattttatcttttgacctcgtccccattagagccggcgtttgccgccggcgagcttgagatcgagctcagccatggctgtcgctgcttcctgcacgagtggagaagaagttgaacctggttgtaagttttagaaatcccagggttcgacatgcaaaactacagtccaaaagaatctatcctttggatccacagtcgcctgggacccacctgtcatccggctcaaaacaaaccgcaccatccgcgcggaccacgaaagaaacgccgataaaaaaaagaacgccaaaaaaaaaagaagcgcatctaacctccgccctccgccctccgccatccccacgcggccacgccactcacccaaccccgccgccacctcggatccgcgtgtggccgccgtctccgccgctccacgccgctcggagccgcgggccgcgttgccgccgctactacgcgcccgccgcttcttgccgcctcctcgtgcgcgcccgccggttccccactccctccacctcttcacaatctcctcccgttcgcaaccgccggggcacctccgcccgcgccgtccaccgcgcgtccgcacctctccgcgcggagtcactgccgccgagcgccggccctcaatccgcttgcatccgccggagatagctgcggggacgacttcaggacggccaccctctacctcacaagttgagttcgccctgtaagtttcctcttcctccttcctatgtgatcgattgaacaagaattagttgaatgcttgcttgttccttcgctagctctgctgtaatggagtggagcaaagttcaatctttgggtacaatattttcatttgttgggaggatagcaaggatctgataatggcaatatacaccgaaacagtgcattgcgctcaacatttgtgctctatttacagagttataaagtaaacaatagtagtgatgcatcaatcatgaaattctcatagctgtatggcattgcatttatatagcaatctggttagatgtgcactgacattaactttactcttaattatttacttgaattagcaaggtgataaggtcatgtaggtcaatcctgtacatgtatatggggattgttgtttgatgttttctcatacagccatatttcaattatatgtggtctatgcaagctcatatggttaattaattctaacaattcttccttctgcctggctgctctgatcttttcttactacatcgagatacaatcagatcatgacatgtctattctcttcgtccattgcaaaaaaaattttgtgtgtgtttgttaatcacttcatctttttccagattgtatataaattatgcttttaatcactccatcttctgccaaattgtaagttcatacctttcatttcatctggaccctgtgaaaggaacatgatttcctatctagatttgtcttttttaattaacttttaacctttttctactcagtgtattgatgggtcagatggtgcatggaaacaggacgcggttctatccgccagtgaggtgcctgccctgccaactacttagggtgtgttcggacctctaggttcccaacccaaatccctcgttttctgcgcgcacgcttttcaaactgttaaacggtgcgtttttttataaaaagtttctatatgaaagttgcttaaaaaaataaaattaatctatttttttaaaaaaattagctaatacttaattaatcatgtgctaatgaaacgctccgttttccgtgcggaggcactgtgttcccatcatccacatgcgaacacagccttaggagtgtgccagtattctacatggttgtctcctccatgatcacttagcaggtcaatttcaacacttgcctctcacaaaaactagatatatgatattttatcgacaccggtagttgctcgatgttcttgaagaatagcatgtcaaactgaataatcttagccaagatcatccagcgatagatttattaagtttgatggttacgattgacagtttccttttcctattaacttatctgtgctatcaaataagctttagtgatcgtcaacaaaagcaatgtgtacctatgaagcaaagagcacaccagctagagctgatcatttgttttttagggtttactgcgtgaaaagtccaatagagatgtcaatttttatctccttactatctattggctattgctctctagggacaacatatattgttcagaatttttttggttggttcatcttgtttgccatcagattcatttgaggtttatctatgctttgacgatggccaaggaggatcagttccatttgagccaagcgattatagttttttttcctgtgcttcatgtaaaatttaattattatgcttgtttctttacaggaaagttgtgagatcatgaggagtggcatgcctaagttgactctcttgagcttgatatgatgtcctgaacatgcatgttcaggtgagcaaaattatactttaatgcaccagttttggaattcaaactcaaagaaacttgaaaaccctggttgtaacttcactaaacaaatgtacttatttaaggcatgaagattaacatcttgactttagttcaatgatgggtcattgtcattgacgatcacatggtccacagaggccttggtgtcttcgatctgccatgatttccaacaggttaagctttgtcatctcatcttctgaaatctgaacatttttatctctgcatttgtttctgatggtttaaacttgggtttggcactggatgatctggttcttgatcatttggtcatcatgtacttcaaaacttgcacatttggtattgaatgtagactcaaaacaggctctatatctatgtttgaaactacccagtcctaaaaatgcttgtaatacattacaactatctaatcctaaaaatgcttgtagtacataatttagaaattaagatggttctttcagtataaggtgatgtcatcagaattgcttcatgaagtacttgcaaagctatttatcaattcaatcctatgcttattgtaatccaacaatcttttgttcatcaaaatgaccctggaaatattatccttttactaagtgctgggattgaagcaggcgatatatatcgttaactttatattggattatctcaataaggccggccttatccttagttgtttactacggcttggttggaggttggccaaatagagttgttgctttcacgattattattattatgccattgccttgaaggtatgcatcatgtatggcccgatgaacgctgacactataatgtttgctgaattttcttacagtgctcatattctgcacgtgacattgaatccgatatattgcaggggctcagattggcgaggtacatcgaaacaattcaacaaggatgatataacaacttacaatatttcttgtttcctgcttcctatctatgatattcagatgctgattaaatcagttgtttggcaggaattatcaagtcaccatggtgttttacaatgtcaaatggcagatgtccaaaaacgtctcaggtaataaataacttgagctgtatatcgaattatatactctcaatggataaaaaatgcaacaaatatgcataaatgactaaattcttctattcagtgccgtattcagtaattgtttggtggcatatgatcttaaaaggaccccttaacacatatatattgcattgatgtcagaaatcattgtcgattctcatagataatagccagaaaagggaattaattgagtgacccatataacaacattacatgtccttcagttattggatcaaccacacgaaggttaacaatattgaccatataagaagaatttcgcttaagttctaaaagagtatctg

SEQ ID NO: 67185 - DNA, 4984 bp, Oryza sativa
aatggttggcctgggttggcttgggacgagctgggacccagggtcgggttgccagttcggtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaaggtggagccgtaggctcgctagtccgctgctgtttatttttgattgtcaggcctgaagccctttgtaataatgtaaatattatcgatataataaagatgtgtcttttatatcatgtttgtgtggtgtaccccggcttttcctgggacggggattaatacacaagcgttcgggaaaaggcaattttcccggtcgcgacagagacgcatgtccccagcgcttgctagtgacgccgaagctgcaacgagtggaagtgcctcggctccggccgctggagcgaacgtctccggggacgaataggttgaggcgattccttcgcaagctcgtcagcgggaaggaaaagctccggcggtcgaaatgactttgtcggacgtgacgcttactgccccgcacttcgttcccgtggatttcgccacgtggccggagatcactcctttcatggacggggtgtgccaagttatcgcaccgtccgatggccttggcctcttcaccgagctgaacaaatttggcgaaagttgcacggccgtggagagcttgtttgtgcgggtatgaattttctgtctgcagaattttctcatttcacctatgtcacgccataatgtatttggttccccttgtccagggcctcgccgcgcacttgagtgcggaaaagtctgccttggagaggccggacgggtaccgtcttcgcctccgaaaaaccgaggaggatctttgccacaaggaagacgaaagacgtgttgtggcggagaccataaaaaaggcgaatgcggaaaacaaggctcttacaggagacaacaagtctctccgcgccgacctagaggcggcgaactagcgggacgcagaacgagatcgccaacttgctgcggccgaggagaagatcaagtcccttgaggcccgtcttatctcggccgaagctgctgctgtgactttggcgccggcaacagagtcccccaagcaagtctgttatactctcaagctggctctgtatgacctcgggacacgggcggagggcgctccgggcgacgacgggacgacgttcgacttctccgagaggacgcaggaagcggccggctcagtcgtcgaagtggcaggtgcttatggtgactgttgtgcgcgtgtttcggcgggcttcatccttagccagctacactcacacggttgtgaccacattgggatctttcccgacctcgtgaaagaagaatgtcctgacaattcacagtgttccggaacggccttaagggccttccgaaaaggtttctaggaggatggcggccgggattgcgcgaagacacgccttcgcgagaatctcgagaggattgcaaaggacgaagccactaccactaacaccggaggggaccttgggccgtcggaaccgggcgccggacacgagggcaaaggcaatggaggccaagaccaccctgaggtgtgaggccctcgtgtgactcccaccttttttttctttgtccttttaggctttttggtagtcctactatgtatataggcgctttgcatgttcggctttgagccgttttcatcttatagccattatgacttttttattttattaatggaaaagttaatgctttcgccaaccttatgattttgttggaaagtgggattgatttcgtccacatttttccttttgcacttgttcttttgtgctttgtcaggagattcgtggccgaaaaatgggcattcggcccccacctgaaagttggcgaaacaagaacgagaagttcgtggcggttaaaggattgctgaagaccaagtgtcgttttcggcctgtttaccatgaaatgttaataaaaggcaacagctacatggttatacgggttgccgaatggatgcgtgcacaccccggtcgaactttgaaagactatgacaggtatcgtgtaacgtatcgcgaagatagcgcaattttctagcgaaactttaagaggtcgtttctccaagaggctatcgctcgtcgccgttacagcttagtttgcttttggccaccgtcccctttaagggttgtgtataatattagtagcaacgatgaacctaattcgccgattagtaacttaattgagggcgaacatgtaactggtgatgtaattttttatgaggtttttctcacgtaaatagaaaagttttgtgattttgtccgctcgaaactttgtgaattattgatcatagctttatgccatcgttcgcatagtcactctcgtgcttttgttatgtcggaacatgccggcccccactacgtactatggcgaaaaggtatgcgtcacaccgaaaggcgtggttctctcaatagttgttggaaaagtaaggcaattgtattgcttagtaaaaaattatttggggatccccctattacatggcctagaagggctatttataaccttattacaggttctctccccctagggtttaggctttacaggagaatttacatggttacccttatgatagggacatgattaggggtacacaatgtcctttacacgtatggccccaattgggctaaatggctcagcccattgatcttggcgaatccccgcaggggcgcaacagcccgttgggcttcctcacggtggggtttggtaccttggcgaaatccataccttcgggccgaggctttttgcctcgccatcttcgcttgcgtggcctcctgacggggccctgtccgacgaagcacgcgtacttcccgagccatggctttcgcccttagggtatccctcttcgaccttcaccgcttgcttccggtttgaacctgtcgccaagttttcggtttcggtaggcccggccgaaggcccttcgcggtatacctccaacgcaaacatgacatcggccgaacttcctccatcgatgaggatgcgccgaacttcaaaactagccatttctaccgaaacgatcaacgggtcttggtgcgggaaaagaactcctttggcatcttctggtccgaaggatattggctgtgaaaagtatcttggaatgctgtcagctgtagagacaatgctgagacaatgcctttgtgcttgaacattgccttgctgccgaatgtttcgactctgctcggtcgtgtgcgaagagcgtccgtgaaaagcgcattataagttgtcacgcccggaatttctatccaaaattccaaacgcttacatgtgtgttaaaccctcgtccaggaatcaaccgaggcacacaatgacaatttgataatagagtacaaataaataactatttaatactcgcaaataaaaattattacagaggtagacagttcctctcaaacaaaaataacattctacgcagcggaaatataaaacgataacaaactacggaacagctatggcgactccactccacaggcatcttaaccaagaacaagcctaatcctccagatcatcaccttcactgagatactcctcttctgatgaatgaatattgcaagaatgagcgtatgacatactcaacaagccacacagcaaatatgcaagtgcacaggataacaaaggatggcataatatagctcatttgcagaaaacagcatttaataaatatataagagaataataaaaacagttgaataattgatcaatattaaataacaccatacaacacacccatgttgcataggcccaaccacatttgaacaactaaccccagttgaacaaattaaacctccaaaccaggaattaaccattccaaaccaggagtcaaattatttatcacattattaacattgatgagtagtgtgaaactaatcacgaaaaacattgctcaactcacccataaccgcgggtacggctattcgaatagtttaaactctaatcagaggtgtaccactgtacccacaagacacaaccccacatcatgtcaccatgtgcctcaataccaccaccgtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgttatacaaaagataaagccgttgcccacgctggcttgtggttggcacgataaatgtttcacaacagtagctcgcgaaccggtccttaattgtcatgagcacaaccatcaaaaccatatgctcacaacccaccttagccaggttttaattaccaattaattatcatcacacgatttaccatcgtgagctaccattgaatcaccataattgaataataatataatataatttataattaacccctttagttagctaatgtttctaagcatggctaagcaaacttacatatagcatttagctgaaccaatccaatatataaggttcatgctaatcaaattataacccataggaaaataaagtcatcttcggccaataattaactgggaaaggttcaccacccgatgacattcgaaaacaatgcatagttgaaataaaataatagctttaaacgggttcaacatgctcaaagggttgtttgggatctgtgtgacttgccttgggcttccacaaacgcttcggaaccttcctcaacggaaacgctctcctccggaacgt

SEQ ID NO: 67186 - DNA, 6582 bp, Oryza sativa
tgattttccgaagttttaatctattagaaaattggaaaaaggaaaaagaaaaggggatgatgacgtcagccctgatgacgtcagcatgacgtcacccacggccgattagggtttgcgagctcgccggagctagggacttcggccgggcgattggaggacaccaacgcgaagaggacatcgagacgaacccgatggtacttaccacgacaacaaacgatgcacgatgacggccggcgacgagaagaggcggcgcggcggctcggcttgacggcgtcggcggagctccggtggtcggcggcgaaggggaaggggcggccgagattcctctcaccacggcgcacctaacggcggcggcggcaagcggcggcgacgacggacgcggcggcgcgacgtggccgaaagatggccggcggcggcggcgactaaaacgacgcggcgacggcgctacggtgcacgggaaagctcgggagagggggcaaacgaaagagaacgacgaggtggtcctttatataagcttggattgaagagatcgaactccaaacgagagcaatcgactcgggaaagattaaaactcggttttagggataaaatcaaaacgaactcgattcggatcaaatcctcaacgattctctttgattcttgggggaaaagaaagaggagaacgagaggaacaaaacccctcaaaaacccggaggaatcggggtcggattgaggcgaatttgagaggagaaggaggcggctcgtgctcggactcggctagggcagccggccggaggtaggggaaacacctgacaggtggggcccacctgtcagtgtcccacgagagagagagcggcggcggcagctgggccggcttgggccgcgcgggagagagagagagagagttgggccgaattcggcccaacggcttaggaggggatttttttaaactttttgaaataaaacaatttgtgaaatgttgtttcaattattaaaaatacttcccttgctcaaataattcccagaaaaatctagaaaataaaggagcaagcatagtatttaataaaattttatctagctcatttttatgttgaaaattttcctagaaaattagggtttagcttgtaggcttttaaattaatttctaaaaatgatttaaaatatgcatttttaatttagtcgatttttagggcgtgacataagtctttcttgaccttcttgtgaaaaggctgttgttgcccgcccgcttgctgggtgtcgaactccttgcggagggcttgtacctcttcgaccgccatcaccgttttgctagctcactcagtcctgaatttcttccatgtcatgggtgcttggttcggcctggggtgcagtacttggttcgccagagatgctgggtgaacttgaactggtgctgaacttacagcttgagcttggacctgagcttgggtgttggtttggacggcggctgctgcagctgttgctgccttgtcatactcggcttgaatttcttccctccgcttggtatcttcttcacctcgagcatatccatcaattatgcaaaagaggtgttcaagtgttctgggttctttacgcgcgagtttccttgtgagttctccctcgagcaagctggccaaagcggcatggataacatacgcttcggttatatcttgcacttggcaacgcgcttgcgaaaacaggcaaatgcactcccttgttgattccccttgcctttggcgaatgcccataaggtcttgttgtgttttcggctcctcgcataggtacctcgaaagttaagaacaaaaacatcgcgcaattactcccatgagtaaatgctattaacatgcaaattgaaataccaagacctggctatgccatcgagcgtgaggtgaattaccttctccttggtgttctcgtcaccatgagcggcttcaattgcagatgcgtagatggacaagaactctttcggatctgtttctcccgatataccgtgggaccggagggtacttgaactggggtgggatgggatgattattgattccccagctgaggggcaggcccttttcggtcctcggcttgatcatagccccttgctgagcaggccaattcaaatgtgggtacggcagcgcgaacggtgaagccatggaatccacaggctgttgtgctgtgggcatcgactgaagcgctatgttgaacatcattgcctggttctgctggtctggagaagtgacctgcgctgccgcggttgggttgaacgtggtttgattccatgtttgattcggtggtggggctgatccgtatcctggaggtatagcttgtgcaaaagttgtcagtgcttgggccattgtgcttgggtcaaattgtgaagatggaccttgaggcgaaggccctcgaacttgacttggctgggcgaactgtccaaccagaagccccgccaatgcaccttgtcttgggctcccctcggtctgaaccggaggtgaagctctttgtacgttgttgctgcagaaaaacttggaattgagcttgcaaggtcgaagctgcttccatcattgcttgcggtgtataagtaggcttcgggtactgggcttgaggcgccgccgggcgaaccggtgcttggatcacttgatgtgttgggtgaacggcagcggctagggctggcctggcgaagtacaccagtgcttgcgcgacataagaaggaatgacttgacgctgagcataaaactgctgggcattggccttggcttgtcttgctgcttcgtatgcttattgcagctcttgcatctggcgaagcgtgtcttgaagttttgccatgttttgacgcatggcccccatgtcagcttcggcttgtacttcgagagcggtgttggcttgtgaggtggtgatcgctgctgacgtcgaaatcggttgggcgaaggccgtggctgagggcgtccctagtacttgggaggacaagaccacgtctctaacctgaagggccttcgccgctgccaccgccttcgccgcttccgcatcagtcgaagttttgggcgccgaagaagggagaggtggcagccctgtcgaaggcagtgctgctccggcttcacccacggaggccgaaggatctgctccctattcaactaccatctctacttcacttccgccttccttccgcttggcaactttctccttagtgaccttcttcggtggcatcagtggttttgctcagtctcagtggtttcgctcggaggtccccacggtcggcgccagctgttgtcgaatagacaaccgcgtcacactgaaagacgtggttctctcaacagttgttggaaaagtaaggcaattgtattgcttagtaaaaatttttttgaggatccccccattacatggcctagaagggctatttataacgttattacaggttctctccccctagggtttaggttttacaggggaatttacatggttacccttatgatagggacatgattagggtacacagtgtccttcacacgtatgggccccaattaggctaaatggctcggcccattgatcttggcgaatccccccagggtcgcaacggcccgctgggcttcctcacggtggggtttggtaccttggcgaaacccatgccttcaggccgaggctttttgcctcgccatcttcgcctgcgtggcctcctgacggggtccctgtccgacgaagcacgcgtacttcctgagccattgctttcgcccttagggtatccctcttcgaccttcgccgcttgcttccagtttgaacctgtcgcccaagttttcggtttcggcaggcccgaccgaaggcccttcgcggtatacctccaacaatgtcttagctataacaatcgatacaaacattatcattgatatagttatatatgtgaagcgtatattgtcattgaactgccccccgcacagtgttaaaccgccctccctaagtgcggtaaggggccgcctgcaaaatggcaggtcccatatagccagccgtttggcatgagccaacggtcgtctgccacgtcacgaaaatcgccctttgggaggttgattttaaaaactgccctcccaaagggcggcgggcgactagttttgtcaatttttgaaacacaaaattagttttgtaaatactttaataaaaaaattaaaaataaaaaaaattcgagaaagttgggtagtatcacgagaatattaatggcctagaccatgggaagtaggctttcaaccggcccaggtaccgccgatcagttttaatgaattttatggaaattgaaaagaatttctatcgaaattcaaccgtttcaatgtaacccacgaagttttaaataagttgatctagatttctccgatccttcatctgtttattaattttagtagcacattaaccattgccacgtatacaaatgtgagaacaacgaccttggccatgggaagcagtggaggtacagctagttttttttggctgcgagcctgcgatgtctctgtaaaatgtagcaccacttgttatatataagtttcttgtgctagctattggttattataaattactccctcgtattttattttattttaatgtatgacgccgttgacttttttacaaacgtttgacctttcgtcttattaaaaaaatttatgtaattataatttattttattgtgatttgatttatcatcaaatgttctttaagcacgacataagtatttttatatttgtataaaatttttgaataagacgagtggtcaaacgttggttaaaaaggcaacggcgttatacattaaaatatggagggagtatattgtacgaattgtatagcaacaactggagtggagcgccctccaagcaaacgaattatactgaattagacaggctgtgccttgattactacaaggtcaacactctctggcttgttaacgaacgagagcatctcgactgccctataatatgcagagctaaattaatgggatatgaagtttgatagtttggatagcatgttcaaagctatcagtaaatagctagttagcgaactgatagattaacttggttggttagctaaacttttcctggcgaaacatgcctattggggttctaagtcttatactttagcaagggtgttcatttttttctatgattagggttaagaggtagtgcattacatatgtggggtatgctcagttaaacttaacataagtgctcgtatgttcgtaggaatttttcagcaagtagtacatacagtttagtgttaaactagctgcatgtcccgcacaattgcacggccagcacccatataaaattatctatttttctttatttgacattacttagaatttgttaatagccattatattgtcctataaccttaaaagatcgatccttatcatccttaaattttttaaatttttatttaaaagttacaccagtcattgcctcttactcttttatcacccttttatttgtttacccaatctatcatagcttttgtatatcttcctttaaacctttaaaaaatacaccttctaatttttagactcaattgtctcgttaggttcccttattataatttttaggagtgttgtcaaatgtcaatattgtatttatccatgatccgcctgttgtctcccatatttattgttgttgggatttaaaaattaaatataactattgttggggttcatcttttactttaaatccgcccaaccgccgccagcttcgccatactatactcatgtatttttattatcattgagattttaaaaaccgaacatgattgtcattgtgacttactttttactttctagaagttccaccaactgtcgtgactatgttgtttaacggcttgtctatcgtctctcctcttaatcatcattgagattctatttgtagttttgtttatagtttttagatgtcgcatcaactgccaacaatttacttctttacaggcctaatgtttctctcctatttattgttttctatcatcgttgagttctaggtggaccttattttgaaaattccatatttttcatttcgatattttcttatttgtaaagtgtcagggttacgggtaaggtataccctctacccttcgatatacgccacgtattgatatggtatgctcgcgcgtatatggaagttttcggcatacgttaaggtaattcatcatggagtacataaatggaaggagtcctactcggtcagaactgggtcgtcattatgtcgtgtccggtccggcgtctccgagtcctacttgaagacagttgacctgcgatataaaagggaccctcgggaggacctaaggcatcgaatcttagagctaacacatccaccacagcctacgaagccggagcttatcggagccaagtcaccgggagatctagtcggatcaactcgactacgatctcgtcggtatcgtcgagttccactattccctttgtatctgtggtttcgatcatataatctcatatcaactgaattagggctatcatctaccaaggggcctgaaccaatataatccttgtttcctgtttgcttgatgtcgtactacgtagatcctcgtaccagcgtaccctaataccctctatatccggtctacgggtatccccatcgacataaagtatattca

SEQ ID NO: 67187 - DNA, 4659 bp, Oryza sativa
tgtctcccctggttattggtattggaaatttaaaaataaaattgattgttattgcaatttacaagtcccgccaaccgtcgtgactatgctgcttaacatcctatctgtccttccaccacttaatcgtccttgggggttctacttgtgattttgtttacaatttttagatgccccaacaacgtgactatgctgcttgacgtcctgtctgtcgttccacccaacgtcctgtctagttccatctcttaatcatccttgggggttctacttgtgattttgtttacaacttttagatggcccaacaacggttgaccatcttattgttttacaggcttattacttctcccttctttatatataattttttatctataaagtgtattcctatttgaactcttataattatttttctattttaggaattaattttattttttattttgaatattacttatttttatttttctattttaggaattaattttattttttattttgaatattacttatttttaattttttttctcctaaaattttattttttattttgaatattacttattttaaattattttaaatttcgaattcagatatttctaaactgtattctacttgaacttttcttttctttttgtccgattaatgtgagaatttctcgcctccacagcgagaacgtggtgtcttatttcaaggttgttttaataatctatatctatacctattataaatattcatatttttcctgtcgtcacatcgctcccttcgtccggcgtccaatcaagtgtcccacttgtgcacgcgcccaaaaaaaaataaggaaagtccgattgaatttgactcggtgaaaaaattccgtaaaaaaggcaataaaaaacaaaaaaatccgtaaagaaaggcgaataaaaagtccgattcaatcaggtagataaggcattcaatatttattcaagatatagaactccaacaatattttgattttgattgaaaactttagggatggagaatgcaccggagtcactaccgcaacggacgagcgccgttgttgctcccccattctcatcgcgaagtgtagtccgctgtcatgccgatgggggttggggaagtgtagtcgccatcgagccaagggaggatgagcactgtcgccgtcgccatcacgccgaggggccgccgccatggagctcgccatccaacgagaggcagatgacgaggggagaggcgagcgctgacgctgaccccacggccccacgccgccgctgccgacggcttgcaccgcgcgtctgctcagggaccaatctggacaacaacgtttgaggagggacaggatgggagacaggattcgctaccggtctgcgtctccctccgactccgcttctccactctccggcgctagcgtggcgtggccgagggcgaggggcgcgggcgcgcggcagcaaggcggcggcccgtatggcgtgggggcgaccggccggacctcgcctccgccagatccggtggagtggaggcggctgctaaccggcaggggtaggaggggcggtggcccggacagcgtggaggcggccggccggacctcgccaccgccagatccggcagcgtggaggcggctgcgtcccggacggcagggaggcggccggccggacctcacctccgggcggccgccgctcctcccgccgcatgcgatcgccgccgctgggccgcactgtctccacccgtcgccaccacccatcgcctgccgcctcccctcttgcgccgccgcctgtcgccttggctccgagagagaggagagcgagagaaaagcgaacaagaggaccgagagagaggagagcgagagaaaagcaaaccaccagatctggcgaccccagcctcctcgctggctgatgcgacaatggtacacgacggtagcacggtgcgcctcagcggtgcgtcttggtggcggtggagggaggccggaggaaggagggtggagccggggcggcagaggagccggcgatggagatggccatggcagtggctcgatccaggcgaggaggggtgaggccaccccaatccgcttgacatagatcctcctcctcctcctcctcctcccctgctccctcccgagatctcacactccatccaacattttctctcgcgagcacaccaacgcaggagctcgccagccggccagatccagcgcctcatcaaagtcaagccagagacaccgagcagcggcatgaggatgcatggggaaggtggtggacagtggaatttttttgagaattaatattatttttatggaaaatcgcaaaagtagtggccaaccggggaaaatcgcgaaagtaggtccctgtcgaacgggtgcaattcgatagggcacctatcgaacgacgggcagtcgacaaagcccagtcgaacggctggcgttcgacacgctcacctgtcgaacggagggagttcgacagggcccaccacccggcgccacgaggcctgtcgaaccgggggcgttcgacagggccctccaccgaccctgtcgaacaatgggcgttcgacaggccggtttaaagccccgtccacccaggccgcgagttcgatttgttttgaggaccacatcgccagccaccaccgagagtcgccacatcgtcgccgtgagcgccggagggagcgaggggaggggatagcaggccggagaggaggccgaggaggcgccggccgggagcaaagggttggcaacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgattctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggtaatagtggtgcagaagacaacatgtgttgatcaatcgggggagtcaagtcatgccgtggtggaagaaactccgttggaaggtggacaagatgaaaatatttggcggactgaacaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggcggtagtggatcagatgaaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgaaaaaggtcacttacaagatgcggtgaagaggtgggcatttgtccagaagcgtgagttcagggtgaaggtttcaaataggacgacgtatgatgtgaagtgcatacagggtggatgtccttggagagtgcatggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagaatacggatatgagatatcgtacgacaaggcttggagggcaaaacagaaagcattggagatgaggtttggaacttatgaggattcttatcacaatcttcacccactattggaggtgatgcaggcaagaaacccgggtacacacatggctattctcgatgaggtgaatgaatatggggagaatgttcttcgtcgggctttctggtcatttgggtccatgatagaggcctttagaaattgcattcctttgctctgtgttgatggcactttcatgacaggcaagtacagaggaacaattctaacagcgatcggagtcgacgcggatagccatgtcgttcctgttgcttttgcatttgttgaaagcgagaacacatcaagctggctatggtttttgcggcacattaaaatgtgtgttgttgaaaacagaccaaatgtgtgtgttctgtatgaccgacacgccggtttgctatcagcgatacag

SEQ ID NO: 67188 - DNA, 1235 bp, Oryza sativa
tttgctaagcaacatctgaggggcctacaatgagttgttgcttgcgtaagaagtttcagcatcgaaattcataatatgtgcactgcaggtctgaggttcaaatatctgaccaaagtactaccccccttgccagattcagttccagaatgagacacagtaacaggtgacggaacacactgtcgtggttccatagcggttgcgtgcagagggcaagcagcttatgaagccaccccttgtttcatcagaggtgagattgagctaaaggtgatgaatttagaaacttcagtagctggcatcaactgaacttactagcaaatgctttattctgaaacctgacaagatctcaggaactaacaaaagaaaatccagtctttacgcacggacgttgggtgttcagtgagcagggcgttgcagagctaccattgctacttcagcatgaagaagcagtcagccaacaacatcggcagcaagcataggctgaaaatgagaatgttaatctaattaaatcaaaaaattagttcatgttatgtcattcatttagtgtagttatagtttgtccttgtgtatgcttatactgccatcagcgatcggccaatctatgccattaggatatgcatgtaagaactcagaagtggtgtgcgactgtctattatcaattgaaaatcgcttgatttttttcacacaaaataagcgtctgatagataaatggtctctggtttttttttttagcctctgtaagttgtaatatttgtaaaataatgaatggatacttgaaaactgatgtttgacattgtttcggtgtaaatgaattggagttcaagtttacaaagaattatgttcaaatcgaacactccaacgtgtttgagcaatttaaaacaatctcaaccttttttagagctatatggaataatcacatatttatgaatacacatatttttgttagtaccaagactgaatactctttcaaaattaactgcacgctcactagtaattgaaaacatacgtgaactaggaaaacatcaaaaatccataactaattcatcttaactcattttcaagtgaaccaaatttctatgtattcataaatttgtagtctttatgtttgtaaattaaaacattacaacttcggaactgaaaaagtcactaaaattgtgagtttcataaaaacacttatttttgcacctaggagttgtataatctctagaaactttatgctatatcctgggctgcaggaa

SEQ ID NO: 67189 - DNA, 5202 bp, Oryza sativa
ttgatcttaaagggagagaatatttgtgatatccttatgatcatagctataaaaggggaaaatattctaggatcccacatcatagcattacatatgcatcatatgcgtaagcatgtcattggcatatatatcactcctatttactcaatgacatgcatggatataaatcaattgccaagcttcaatacaatgataatctatatacttcatatccaaatgtggttattattaatgaatttgtcatcaatcaccaaaaaaggggatattgtaagttcaagtgccttaatttggtttggtgattaatgaaaaatctaataatatgagactaacgtttttatgaacttttctttgactagtctcgtttggatatgaaaataaaaatgatgagagttgtcaactaggttatttcccgatgatgagatgtggtagatatgcattctttggtgatgaaatgcatggagataaaacgttatgtaccacttcttatctcctactttttgataggttcatatatatgatttccatgttattgttatataagtgtgagactaacgtttattcgagttgtatcttatttaatctcatttacattaagaacatggaaatcatgaatgtatgtgttttatgctggtctacatcattactacatatgccttctctatgtgtataggataaacccccattgatcattctctaattatgcatacacttgcatctcttgtatatttatttgtatgcatatatttagggggagcaaatcctatacatttattgtgcatgttgtagatccatgttgttcacctattatttatattggatctttgcatttaagcttgcatgtgagtatatgacacttgtggtgttaatgaataatgaatactcaacaagcatattcatatctttcatatgcaactggttggtcatcaagtgcaggatgacaaccgatttgttgggactaatgttctcctttgagctgtgcaaaggaataggtcccaccgtgatgaggctaatggatgacaccacggtttgacgatcaccaagccaacaacatcgccatgttgacaagaatgaagtcaagattgtgatgagaagaaagtcttgacaaaggatggtcaagacctaggcataaacaagattcaactgaatagtcacatgtgttgatcttggttcaagcattgaccccaagttggatggcgcaaggcaaaggtataatcgagcgaagatgttttcttagtctttttcccggtcttcgtgtttggtgtagaccggatttgctatataggcgccatactatcaagaggggtctatgaagcgagcacgtggatgatcttgtgccatattagttcatatgcatgtaggtgcatttggtgggcttgtctagccatgtgtgatgaattttctcatgtcctaaacaaagagagaagtgggcatgtccaataggagtgagtgacatcttgtgagtatgtccggtggatatcctttggagcgtgagcccttcatccttgacataagttgtgtttcttggatgtatttttcatgggttggatagccttttgaataagctttccatagagtccaagaacatctaattccaatatccgagtcaagagatatcgtcgttttactgtcggtgggtcgtgctgaaaatcggtctgctgtcagaccgacctattatggccggtcagacctcccgaaggcctcgaaagccccccaacggatagttttttgtgcgttggactgagggccggtctgaccgggtttagaagggcggtcagactggcaggcacgtcctaaaaggtgttttagcctctaacggcttgttttggtggttgggggtatatatacccactccccagcagcaagggtgaagttttggcactccattgcattatcttgaacctttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtggaggtgttgcccggtgacctctccgaggagattgtggaggaggcccggcgccatttgtgagtggtttggagttcaccacgttcggagtgaatgaagaactaccctggtgatcgaggcttgggtagtcctctccgtgggccggctcccaccttgcccaccccttgacgaagggggcgtgcggtggcttcgtggttgagcggtggagttgggctcgcctcaacggggattaagaaaccggcaataaaaaattccttgtttcttgtctcatttatttgttgcacttacatttgtgcaatttacattcatatagacatatttgatcccatatcacttaggtttgcaaaacttaacttagttgcttagttaaccttgcacctcaccttgcctagcaacttaggttagttttgtttaagtgccattaagttttaaaaccacctattcacccccctctagtcggcatccttgatcctacagtcctgcgccggctcgaccaccctttcctgcctgccatgttcgatgactttgacaccggccagaactactcccccactcactccgccaccgcatgcctggtcatcgattcccagtcgcgttcaccaggttctacgccgctgaggtgctcctcgcgctcgagtttctgcacatgatgggcatcgcggcagagccagtgcacgcacggtcgagctcgttcgtcggcacgcacgagtatatggcgccggatgtggcacgcggtggcgggcacgacgtaggcatggactggtggtcatatggcatggagttcccctcggccgtcgctgcctcgccgcacgacgccgcgacgcgagacatgatttgcgcgacgaagagcctgccaccgccggcgtattctggctagccgacgcggcgctgtgtagggagagagaggggcttacatgtgggcccacgtggattcatttgagctaagggcaaatttgtctttaatgattgtttctctctcctattcctctagaaataataaaataaagcagtgggtgaccaggagctaattaccagttttttgcgatgccctacagcaaatacacgttctttcgatgtcctctagctaattacatgttttttggatgtcctgtagcaaattttgcctagattaaatatactaaacgagaatcaattcgatgttaggatagcctaacagactgatatcaggcttaatatattttatccaagttggatcttgatataaagggcagattcagtatatcaagtaaacaaataggaaacaagataactaaaccaggtaagatcggctgaaaccccgatactatccctattagcaatcatagagcaagctagatattatggttctagatattacttaatagatcaaactcatctgatgcagcattaagcataaagagaaacataagatctaaacgagccaatgagagccttttcgggaaggtggatatactatataatctaattcaacgatagtgttggaccctatcggctgttttcgatgatagaggctagacgacgagatcacatagtaaagtcgatctagattataaagcatatatgataactcgacgatttacatagacaggattagagtgtcgtaaagatgtttgcactaatctcgagaacacaagccgccataacaaactttacctcttgtcggagatagaaaccggtccagcccaactcgaaagcaagaactcgtcgaaaacaatgaaaagtaaaagggtggcgatgcgccgagagtgtattgaactgatgtttgtttgtttacaaggtatcgtgtcatatttatacccaaaatacataatatgtcattgtcggacatgactccacttctattacatctcgaaaatacgaataagtcccttaggcggactcttaccgaaaatatctctaaggaaactaccaaaatatcctaactaatactccctccttccaaaaatgtgaactatttcttttacaccaagaccaagaagcaattaattcattcaccatgtgacaaaaccaatgaacatgcaaccaataagcattaaaatggcttcttgggttcctatcaacaatttaatttagcacataatgactacaaataggacttagacttttggaaaaaccaaagaatgaaataggtcttagacttttggaaggagggagtagattcaattgccttcttcagactcaatctatacttggcaatacttgtatagcacttcaaccaatcccgacactggttctacaattatctcgccgaaatctgttacatcggttttgtgggcacctgaacattatatcgtccaatgcaatttgtcaccaccacataattttggatgagtgggatccatacatgcataaatagccactcatacctcagtgtgccatgatcacaatttgacaccattcaatataaaatccgcaatgccgaatgaacaaaggagatattgttcgaactcaacatgccaatcaacttcagcctgagacatgcccgtcaaaccacacgaagccgcgaccaaatgtgttacacatctcaggagactcgactcaaattgctaaaactctacaacatctcaattactcaaaattcatactcatgcttagctagtccccaggaaaagcggctagcctcacactttcatcggaagcaattgataagcatcacaaatgtataattatggataaaaggacagcaagatacatattttaaaacggggttcacaagcccatcatacaacacaaaatatagcagcggaagttttgcaaattcatataagcagaagtaaaacccgtggtgtgcaaacaaccccacaagggcaaccaaccggggcaagagcaaagctgcaactactcgctaccctcgccaccctcggcgggatagtagtagggcacaacatcaacaccggcatcctcacctgaaaatagcaacatgagtacgaaaggtactctgcaagacttacaccatatatgatagtacaaaggagtatgcatgtttctacatcaaagaaaatggctaagtggttcagattttgcataaagctaattttgttgagcaagtagtaagttgcaaatatagcatttgtaaaaataacataatctgaaatttaggacagcaagaaagtaaatctgaaattgaa

SEQ ID NO: 67190 - DNA, 8483 bp, Oryza sativa
gttagagtatcaccaacaatactccaatattatcctcaaaactgattttgagggccataaggaccgcatgatctatttcacacggatggaggaaaactgagaattttgttggtagtttgatagaaatgctcacttttatttttttaagataaaatttagtgtttctcttggagagttaagcttttttgtactttctatttttagtttagaaagcataaaacaaatttttagagagattatatataatctcttggtgatgctcttaaaaaaaatttcatcgtgataaggagcggagggaggggggaagaaaatatttttccaaacatctagtattacatctagtattacaattgacacttgcttagggtataatccataaattctggtttattttaattttttttctttctttctcacttaaatcccaggatggtatctctttcctggatgttggatgggccaagaattcagtcttcttaaataggagtttcaatatactccctccgtttcaaaatgtttgacaccgttgattttttagcacatgtttgaccgttcgtcttattcaaaataatttgtgaaatatgtaaaactatatgtgtacgtgaaagtatatgtaacaatgaatcaaatgatatgaaaagaataaataattatttaaattttttgaataagacgaatggtcaaacacgtactagaaagtcaacggtgtcaaatattttgaaacggagggagtatttgagaaaaaaggtcggtctatcatactatctttactggttctttatatggtgccgggatgaactgaacgtttcacttaatccagctctggccattaactgactttgtgattgtagcgatttggtatttttatatagtcgggtctgaatagccatcttttttcacctaaagcagcaattgtttatgaattttgcgatttcccgtaactatttgtgcgagatgttccctctagtatgaactagtcttcacttatctggccttcaactttgtttaggaacaatggttttgttataaaaccagctccgaaaacgacatcggaaaccaaacgcggaagaaaacgtcataggagatccaaaacgatgacgacaccgaggcacgatatttgataacggagttcagctgaagcctacatctccgaggcactgattactgacgctcctccccaatccagcatatacagcatatcagagttacaacgactcacgatcggtcgccgccggcagccgctccctctcgctatgctaagtcgtcatacggttataacaggcacgcccctctatttatgagagatcctaggatagagtccgactcatactctaatcctggtgacctggtgacctggtgactggagtctggagcaggcaaaaaaatcatgcttggagttggatcccatgcttgggtttacctgtaaggctgacgagggatttcacgatgccgagggcgcctttctcggagatcacaaatgatttctccttcacaaagctctgtatagcttcttggtgtcgtagtctagacgctcttgatgatctgcgacattagggaatggaagtcatcagtgttgtctcgaggaactaaatgaacacaaactgttctcaacagtgaagggaaaacatttcaagcgcctacataatcatagtatgcaagaacgtgctgaagttgaggcaagacctgaacttgtttaaccccttttgtgatcatgcgaggcgaggctgcatagagaatatgtggcatacatgcagggattcagctactaactttagagcaaggataatggtgagctataagcaagctatatgcttatgtggaagagagagataaagaaaagtggggagtgtggctctcatgcaagagctagctccacacaagctccaagaaatatacattaaattcatagtgagataaagagaagatgcaaaaataaagccaaccttacagctaacctattatacatgttagttttaacattgacttatagtaagtagtgggatgtactactaaacttgctcttaatgctatagttacgagatctcgtaatatacacgtcgttccgctggagatgtatttttgggctattggcaaatgtgagtaatttgagaagcacgacaaccaataatcctcctggttgataaacaacggcacgtgaataaatatgaaaacatgatcctcaatagacttaatggtagaggcctaactccaaaatagtaaattgaattgtacctatttgtttagttcagggaggtacctttatcaaaaacaatgtgtgctacatgaaatggaacacgagcaaagatatctgatcatggaaacattagccaggtatcctctttgggattgtgatttccgcgagtcgagcatatctccgtaaccagcagcttgccagaagttccttccatctccttcattataacctcgaagggagatggcacactagttttggttgtcctagctcttttccggagcgttgttagcgcttcctgttaggccattcacagtgctatgcgctgccattcggcctgaacgttccatgtacgtaaacagtgaaaatttgctgccacgttattggttgggcccagaaatctgaagcgtgcgtgaccaaagtttgctgcctgtgcttcgcttgaatcgagattggggaatgcgtcgcgggcgtcttttggaggctaaaacgcacttctgaccttgtgtcttttagagttcttaagtcctgtttggcagccgaggccgaacaaaatttacggcgcactgtgagtgcccttagaattccttatcttgtcattttccactaactgatcgtcgcagaataaacaaaaatcagaagtgatcagtatcaagactcatgtaatatttttacaagaattaggtcagtcagtagcacatataaacctgatgtcttgccagaagaagttgctctgcatcagtttcgatgtcaactagagctttttgaagttgcttcattttggggtccattataaactacaagataataccacttatttcaactacaaaataagaactacagaaatcagcatagcataaaaaatgcataaaaggcttcaaaatctttatagttccattttatataaatcccctttgagatagagccaagaaaagaatgcaaataagcgcaacggaaataatttgaaaaaaaattattgagttatgacttatgagccataaaaaagtacttttgggtttatgccaccccaaagtatgacagtttgaaaacgacaccccatagatgtaatggcattgatgccactccaaagatgtgtcactaaagttttggcccaagtgtggtattagatagtaccccagaatttttttgttattttttgaatttggccaaatccttgcactatcgatggaattctcgtccttaaaacatcccagcaaatgtccttaatgcaaaccatatcatgaccatagtattataagaatttcagtcaatttcaataattgactgaaatgatattgttccgtttctacatatattcttgactttggctagatgaataaaatgatatggttcaggatgacgggatacaaattttaagaatattcctaaaatagttatacaatcctgttcaaggaaaaaaaatgaatgacacagctcacggaagtgacgaatggacacagttccgaaatgcacaagataaaatgaaaaaatggacaaggaaactgaaaacacaagcctccttttttgccactaaaaaaaatctcatttaagacttttttttgtttcttgaatatattgaagtactgcatgcaaaatttctaaatttacaatgaaatcccaacaacattcctaaccaggtcataacaggtgtaggtcacaatggttgccagatcgtgctaggcttaaaaggcaagtcaagccctcaccaaagtcccaaaaggttgttttttccgtttcatctatcattagggccttcacagtgcaggtcacgtatttgctggatctgagataccacctaggttcaagccttttgaaagataaagctttgtgtgactcaaatagatccaaagccacgcatgacatacgaggaggagggtgcgcagagacgtacgaggccgaagctactcactccacaacgcgaccacctcgtgtgttccttcccccatgctcgaagaaccggtagccttctttggacgcgcacgcttcgttttggtgggcccggtcaaaagacgtggtgtgattttcccctccgcgtcgacgtgggacatggaggctgaatgccacgacaccgcattgtgaacacccttagtgccagacatattttatgttttctaaatcgttattcataatgaaattaatttttaatataagattagcttgtagattttataagactttgagccagacttatgaacctagtctcacccatatctcacccatttaatcaacctaatcctaccaactaaacaactccatagtccatacatacctcgcaaccaaacaagtaaatgaatgatttggttcataaaaccaaccaagcatggactttgtaaatcacatcccgaactattcatccttgttccccaaccaaaacaagcccaaaaatatacaccggaaggaaaatatatagagcatttcacatttgcagttcaaaatatattacctacctatattactagcaatcaaagtttcagccttttgggtattatgaccttcatctagtgtaatagagtagtaataataagctagtaatccagctcttccttccacaaacaagggcattgcaaccaagcaattctaagatatgttttgaacaagtgtcccacactgcaaaagagaggaggaatcgagaaggcaaacctaacaaaggggaactagagaagcgccgatactgtacgccgccgacaagaggagggtttcctggacgggagaaatgccggggccagcagatgcagccaagaagccgcccacggcgcacgcgtgattttctcgcctttgaccataatccgagcaacccctctgacatcagaggggaggacagctctagggagaacaagtagtagcgcggtggtcggcggcggcggcggcaaacgggatgtgagtggacacctcccgtcgtcgtggcgacgggtgaaatttcatgagactccctatgttctaaaacaatcacgtatttaaaatgtataccaaaatattctattaaccatataagcacttcaaacaatatttttgagactaccaaagtcttttctcctcgaccatcatcacttattttgaatttcttgatcaaatttctttgtagagtaaattgcatctctggtacacgaacttgttaggtgggtgcaatctagtgtacgaacttgtaaaatgcttgttttggtgcatgaatttatctggagcgtgcagagaaggcgaaaaggacactacacggctaattttattgatttaggggctcattaggatactatgtaaacatgtatctgagaaggttgctattagataaatacctcttcaataaaaataggatatagggatcatagaaaaagataaaaaaaaccgagtaatgatataagggttagaaatatatgaaattcattaattccatgatgaaggataaagtatagatcaaatttataaatattacatgtcttatatatactcactatacgtatgcacgtcacatcctaatcaacatccgcttcgtaaaattaacatttcgaagctattttggtcctcgttcgcatgaactaaacaagttcgtgtacctaaacaagcatgttacaagtttatatattaaattacacctacctaaaaagtttgtgtactaccaatgcaatttaatgagtaccatttctccataatattaatcattggtaaataaccagaacacttattttaaaacacagtgtacatatctaaaaccccatttgaatgtaacaaaaacactgagcatattagcggcacacgaaacaagactagtcattacctcatgattagttaagtattaaaagtagatttctttgatttttttaaaagcaatttctatataaaaaaatagagtagctaagacaactagttgagtcaaacagtgagagataaggtaaaatttgtattttttttataaatttaattctacatatgtagttttgtgaaataatatgtaaaaaaatatagttttgtgatattttttttaagtatatgcagtttaaaaattacttttacccaaaaaatcaattattcccatcaagcagctgatgcctgtttaggaattgaccctttgaactataatatataattactttatagtctattctagtatagtttattttggatcaaagattcaattgtcatttttctcatttcctttccctctgtagttgtatctcctctcgttaatttcttattaagtcaatatcactaaggctctgtttgcaaagaacaggttcccaacccaacggaaggcacgaaaaacggagtggtccattagcacgtgattaattaagtatttactatttttttcaaaaatagatcaatatgatttctttaagaaacttttatatagaaattttttaccaaaagtgcaccgtttaacagtttaaaaaacgtacgcgcgaaaaatgagaatagggacttaggaaccaactcttgcaaacagagcctaagacaataagtggttaagttggcaatgggcttatgggcctatttagcacagctccagctccaactaaacagtttcagctttggaaaagagctgggtggagcgctcccacaaaatgaactagagaggtgaagttgtgtttaggctactccacaactttactccagacacaactcctgaagctaaatttaggagttgaaaatctaccaaacagaccctatgtctatcattttggctatactcgctctctaaaattgatttgtcctggagtcgtggtcggtattttccctctcaagattgctcatccgttgctatcacttttcacgaaaacttttatagctttgacctcatttttcttttgctttgatttatattgcaacaggaaaacttggcaagattttcaattcttccaatctataccttcattccaaaatcctcttagaggaaagaaaaaccaaggtttttaatccttcttttaaaaaatcctctccatcccaaacaacttgccagcttggagccttggtctaggatattcggtatgtactggtcctgtagcgggaggctgaaggtgattggacttttcattttagcccttttgtaaaaattattttacaaatacatctaaaaactttattgtataaatggatccgaaactcgacgccaaagttgaggttaaatatctcgacatccgtaccaatgatcttataccatagtactcaatccgtttcacaatgtaagtcattctagcatttcccacattcatattgatgttaatgaatatctatctattagatatatatctatctagatccattaacatcaatatgaatgtgggaaatgctaaaatgacttacattgtgaaacggaggaagtatcaaagtgtccattgtgcgtggttggtgaggtggatggggacaacactagtctgtctgctgctgatagtctacacctatgtcattggtgtttgatctcccacacacttatcccaatagtaatcctaaaagtaaaagctaaattaggaatgatttaatttccatatgaagtccagtatcaaatcgacatgatttggagggaggaaggaatgaggagggaagaccgtaccattccccacaataaaatatatatcacgagagatgaatcgacatacgtcggtttatcgtttcccccttcttttcatgctgagatattaacatatcaatctccagcacacgccctttgtcaccgtgggtatccacgccaaaacacttcggttcgactgaaacacccaaggttatcgacgtggagctacgaatctattttttatcacaaattgcttaaaagggtctatctataaaaacaggttttcgaagaggatcaaactgtaaaaaaaagaagtcccctaccctacggtggtatagtacggtgcgacgcacactactcgtgtcttctcctgcgcgagagactcgaggactcccctcccccccctctccaaaccctcgcctcggctcccccgcagccgcgcacgccaccgccgtcgcctctcctctccaccgcctccccacccacccgctaggtttccgccgctgcccggggttctcgccgccgcgccgccctcccccacgctcgctctccgggtgggggtggtgccgcccctctcctcctccgtttccaggcgggtgccggccgggggggtctctcgccctcgtctcctctccccctggtcgtcggcaccggcggctgggaactcgccgacgcgtcgtttccccgcgaggccgccgcctagatctggaggagggggtttgggggtaagctcgtggcgattcttcaatgcccgttcgttccgtgctattttgtattattttttggggggggggt

SEQ ID NO: 67191 - DNA, 25435 bp, Oryza sativa
attcctgcagccctaatgttgcagtagcgaatgctaatgattttttcttctgtagttattagccagtgaaatttgtcagtatcttgtctatagctgttttgaaccatgctattgattttatttgagatttaataatatctgtttgtccttagaagaatgattttatttgttctgtttcgtttgccattgtacaccacctatacatgattagatacttgcctattctgttcatgtccagttcttttagtaatgcgaattgcatactctttttctgacatctgtagagtttagaatgcgtaacctactccccctgtttgagaatgtttgctgctaacaagtatgacgtgtcaatatggaataatcaaaagcttctaaattgtccacgacttttgaacagtttgagtatatgttattgccctcagacatttcgagaggaatatcctgtgccatcaccctgttgttttccggacgcccctcatagcttgttttcaggacatgtatttggagaacaacaggagatgcttccagaattttctttctaactgttcaagggcatgaaaaccaacctgaaccgcgtatcctcaaattggattaggtatctttgcctaactagaaatcaggatacttcaccattagccaatcttttggagttaatttactaatgttgagtgatgagtcttctgtgagcgtgtaaatggtcctaagtgatttggaactggtgattctatgaatgagccttcgttgcaagtatcaagtagcagaaggtcaattgtgtgggaacactttgaataggacttggtaatcattgatggtgtcccaaaggctatgtgtaaaactaacgtgcactcacccttctgactggaacagtggtttgtcatatagtctgaatattttgaagtgtgagcatgctgattttactgtatggtgtaagcattgtctaattcgaaaatatgacaagatatgcaagctataaagttttcccacttattttttctgatgcctgattgtgctcttgaatttttttcaggtaaaatactgtttgttagacaacaagattgagattctcaaacctgttggctggtgctatatcatttgcatttggttgaactcgaaaccaaaaggtactgtgaattgcaagaattgcaaacacttgttattctcttaatatgcaatgttagaagaatatggattggagttatattactgttgttttatttctgctgtttgccactgtatgacctaacacctatgcatgattagttacttgcctattctgttaatctacactctttttagtaatgtctaattgtgtactctctttcggacatatggagagtttagacctttgtctcctgtttgtgggtacttgttgttactaaatatgacatgacatcctggcatattagcaatgatatttggatagtttaagtatatgtggtttgggttggtttttatcctctcgtacagcctcaccctgttgttctccggatacacaaactcagagcttgttttcaggacatgtatttggagaataatagggtgatgctgccagaattttcttttgaactgtacagaggcataaaaccaacctgaaccacatatcctcgaattggatttggtatgtatctttgattaactgggatacttttccatgagccatgtcattttatggagttaatttgctagcgttgagtgatgcataagtatgcaagcatgtaaatttttcagaatgctttggaaccactgtcctgtgaatgagccttccttgcaagtatttagtagcaggaggtcaattgtgtgggaacactttgaacatgacttggtatcattgataatgtcccaaaggctgtggcaactactatgcactcagcttttttactagaagagtgatttgttgtataatctgtatattttgaactgtggtcatgctgattttactgtattgtaaccattgtctaatttgaaaatgtcacaagatatgcagtctataaagcttccccacttattctttctgattcttaattgtgctcttgatctctttcaggtgcaatactgttggccacataacactattcagattctcaaaccttttggctgatgctgtatcatttgcatttaattaaagttgaaaccaaaggtaatgcaaagtgcaaccaactgttagtcttgctgcatatattcctctttgtctgaaaagaagaaatttatctgtgttatatactagcaaatatacaatgcttttatctcctagatgtattattgatttcgctctttttttttggcccttggtcagcaattctctacagtactgaacactcaggggaaaaacacagaaattttaggggttttgtcaatccctattatacaaataataattttacgctcaccaagaaaatgctactcctttccataaggggggcatgatgcaggctaaaagattgtttaatcgtgttgaagttttatgttttgttcttgtaagtaggcctgctaatggtcttgaaaccgttctgaatccaaactacccaacaaggacagcttctcacccacaaatctattgatagaaaccaaaccaaaccattccagcccaagctcccaccctagccaaaccttcagtagtatgggtaacagcattacacccaattctcagcccgtttctaaccatggaatactttttatcaaaatgttgaagtaatcgaagcatctccagtcttcctataaggatatttttagtaatttgatctatgccaccactttaattacagttttggtttatgctgctacttttttggcaaattcagtctgccacacaaatgtgaaatttgtttgggccacactgaatttgttttggcaaacaatattgggacggatggagtattactaatggtgaagcgatattgctgtagatttagtttcttgagataggcaagaaggcctatttggcctttgttctactgtagtctgttatttatcaacaagtgtttttttggtccaaatggaaattcttaatcagagtcacttgttcaaattttgtgcaggctggcaacttgttaaaattggtgtaccatttgttatttgaagccatagcatatctcagctcctgaacaataaggtgctgtattcagcacagtttaagtgtgaaaaagaatggatagaaaaatcacactttgttgccactggtatgcttttgaaagaaattaggggtttggatctctatctattctagttacaatggattgcaacaaagatgaggctgttaaggcaaaagctttggctgaaaaaaaaatgcgggagaaggatttcgctggtgcaaaaaggatgattaacaaggcacaaaatctctccaaagatgttgacagcaacatttcacaaatgttaactgtttgtgatattcattgtgcttctgcaacgaaggttaatggagagattgattggtatggtatacttcaagtacctgtcacagctgatgacacactaataaagaaacaatatcgtaagcttgctcttttgctacatccagacaagaacaattttgcaggtgcagaggcagcatttaaattagtgggagaagcaaacatgacgcttacagaccgctcaaaacgttctgtctatgacatgaaaagaaatgcctcagtcagaattggttctgcaagagttccttatcagcaatcaaggagaactgcacctgttagacctaccactacacctgtgaatctccataatgtgcatcaatcacaacagcataagccctcaaatccttcagactcacaaacattttggaccatatgcccaacttgtggcatgcgatatcaatactacctttcaatattgaagaaagctctccgttgtcagaattgcttgaagccctttgttgcacttgatttaaacgagcaagctgttccttctggggcaaatcagaggtctgctggggtgtggaaaagttcaggagcaccacaaaactttccaggttcacaagcaaatgtaggacagcaagctcagaattctgccaatccagtccatgctaattttggttctcataatgcacatgtagaaacaaagaggggagctgatggaaacgaggctggtgggctaaagaacaaaagaaaatttgctaaggcaacagggaattcttcaaaagcttcttcagttgctggatcaaaaaagcgcagaaaagctatgtttgaatctagtgaatctagcgcttcagacaccagcactgatagcgaagaagagattattgaagatggtcctgctgcaagtaatgtagggccagatcaacatccccgcagatcaagcaggcagaagcaagaagttaagtataatgaagatagcgatggtgacgacactgactgtcacggcaatggtgatgatggttttgtgagttctcccagtttgaaaaggttaaggaaaggcggtctgtttcatggtggtgaaaacaatgaaactaagttgaatgctgacacaactgggcctgggcatgatggtccaactaatggtgttaataattacaataatacagaagacatagagagaggctctgcttgtgctgagcaaatcaagagggaaacaatgtctggtggaggaaatagtgctgagaaagaaaaattatcccattctgtcagcaacaatggtctagagtcaaactctgatgatgctccaaatgaggttatttgtgcggattcagaattttttgacttcaatcaacttcgacatataaatcagtttaaagccaaccagatatgggcttgctatgatagtcaaagctgtatgccaagatactatgctcgaattacaaaagtaaaacatgtcccgaagtttatgttaaatttcatttggctggagtttgatcccaaaaataaagcagaggctgcttggtcttctggggacctaccagtgtcttgtggacgttttaagcatggagtgtcagatacagcaaaagagagcagtatgttctctcatgccattttctatgaaaaaaacaagacaagaaactcttatgaaatatatcctaggaaaggcgaagtatgggctcttttcaagggttgggatattgattggagtgcagatgctgacaaacacaaaaactatgagtatgaagttgttcaagtcctctctgatctcactagtagcactagcatcattgtcatgccacttgtaaagataaaaggctttgttagcttgtttattcagtctaaagaggcatccccatatgtgatacctcaggatgacacactaaggttttcacattgtgtccctcgtcatacgatgattggaaccgaaaaagaagggattccagaaggggctattgaacttgatcctgcggcgcttcctctgaactttggagtggcttttgcttctgttgttccagaaagctgctgttcagtgaaagtgcagggttctggtgctgaacacataggttcatccagtggaaataactgtcacaagggatcggtggatgttggggagagccaacatgctacatgcgcaaatacagggttcgctacaaggacaacaaaggcagagatcaatgagcacaacgctcgatctgcagtagaaggtacagatgatgacgaggaacctgatgattttgcccaagcagaagtactatatcctgaatcagaattctttgaattttcagaaataagatcgatccacaaatttcaacctgggcagatctgggctctctatagtgatgtagataagttccccaattactatgcctgcataaaaactgttgatgtcaagaataatgaactgcaagtaagatggcttgatgcttgcccacagagtgaagaggagagaagattggtaagagaagatctaacagttgcgtgcggaacctttaagatttccagtttccatggtattcaaacttacaatggtacagagtacttgtctcatcctgtacaggccaaacctggtagaagaaatgaatatgaaatagttccttgccaaggtgatatttgggctgttttcaagaactggaggactggatggaccgcaaaagattataagaaatgtgactatgaattggtggagatatttggccacactgattcatccatacaagttcagcttttaagaaaggtggatggttatagggcagtatttatgccagacagaagagagggagctgtgaagacaataaggaaagatgagtacccaaagttctctcaccagattccttgcttccatctgacaaatgaaagaggaggcaagcttcgaggttttttggagctcgatcctttgtcagtgccagagatgtttcttttcaccgaatcaatctgagataagccttatcccaagttaatctgctagagcatttcttgtgatgctaccggaactaaaggttttccagaagttgggtagtccacaattcaatattttgcttagtgacagaagctgctggattttcagaatttgtatgtagcagtaatgttatgggccgcagcttttgcctattctccaatcctcactatgaaggcgttgtcaggcaatcgggaccgttttgcaagattagctgcagtctgaactgattaattttcctgcagctgctttacctagttaccgatagttgtatctagttctctagctggactatcaatcgtcctttctcttgtcgtactttgcattgttggaccatgtaaaattgaactgtgcgaggccagtctgattaattcggaaatctctgttggcctccctttcctggaacttaatgaattgagtccaacttctgtttaggttgccaattgatcatcataggggtaacgatgaactagattctgtgcaatgcttctgtgatgggaatggacagacaccctgctgcagctctcccaaggtatcattcgtccatttattgatttgtttctctgctgttttctttccagcaaggtacaggtttgttggcatccatttgatttgatcttttagttttggatgttggtatgctgtgtagctgttgctctatgaacagtttcaaatctttagaattgggatttggacctcgagcctgtgatttaggtcttgtttagaacaggtaggaatttgtgggaaatttagttcagttttagttgtatgaaccatacaaaaggttagacttcatctctgcttatccgaagtctttgatgtaatggtgcatctctgaacacaatggtctctaagatagattaaggtttaatctaagatctctgttgcttgatttcagctgatatactcggtcttaaaagactagcaagtagcaactggattgctttttctaatgatggtaacagagtagcaatttatgaaaagtttatggaccgatgccccttttaccggcagtgttctcatctctatttgaccaccatctctgttattagtatcatctcagggagccctggtttagagtgtgcacaaccacaatatcaataaaaaaatatttgttatccttcaaagtcaacagataattacttagtaggacaaaaccaatatcgtagctagatgctcatccaaacaaatctatgatgaaataagcattgaacctaatcgccatggaggcattatcttaatcatgaggattacaaagaaaatgtatataccattagcgaacctggcgcgtccacgaaagctacctgcatccaacctgccttagttgcagcttgcctctgctctctgctctagctgctatccgtttctgtctcggacaggacgagcttaaagctgcgtcgcccatgtcgccgttgctcagtgacaagtgtcgtcgcgcacgcgcagcgatgtcgtcgtcgccggcgccggtggagtccccgtggctgacgatgcgcgccatgcggcgcgttggcggcgcggacggcggcggcgggcagcggagcgcgctgatggtggcgtcgtacccggtgctgctgctgctcgtcgtcctcgccgcgttcgtcaagtacgtgtggatcgcgctggcgctctacagcgcgctcctgctgctgttctcgtgcgcgtcgcgccgcctggcgctggcggagcggctgccgtcgccgctgggaggaggcggaggaggaggaggagtcgccgcggtcaccgcggcggaggagctccagggcgcggcggcgcggggcggggtgtccggggagacgctggcgtccatcccggcgttcgcgtacgacgcgtccgcgcacggcggcggcggcgaggcggcggcgcagtgcgcggtgtgcctggaggcgctgcgcggcggcgagacggcgcgccggctgccgtcgtgcgcgcacacgttccacgtcgcgtgcatcgacatgtggctgggctcgcacgccacctgtcccgtctgccggcgccgcgtcgagcgcaagcacaagggcggcgtgctgccgccgatgccgccggagccggagacggagccgccggtgtagctcgtcgtacttcctgtgtcttcctcctagtgatgcagaagattgcagaatggcagacaaaatttgtcaaatttgtactacatgtttagattagaggtacaataggccagtttttcttgccactctgcttattctgctgtttgtagatgctaacgcgactcatctttgtgaaatctgaagcctgtcgcatacacaaattgtcaccctgttaattatgatcggacaattttcttaactacttttcgtctttcttcctctacagaaaaaccactccctcttaaaaaaaaaacgatccaaaaaacccgtgaaaaaacggcataaacaaaactcagtttacatttttatctcccaattcgacataaaagaaactgaactacatttttatctcccgatccagctgcaacgcacggtgcgttgcacgtaactagtcatggtctcatggacccatggggtgttagtaacagggttcgcaatctctgtgagtgaaaaaaaaaacatcttgggggcgaaacttttgatttttttttgaaacttaaacaaatttccactgaatttaaatattccttttactaaattaaagcacattgaaagtttttggccagaggcacatcgcaccatggtctatcagtagacccgaaatttctgaaatttcataccaaaaatgtgaaccatgttccggaattaccacaggtaaccactcctaagtcctaacctgtccatgatgtgaactgtggagtctgaattaaatttgggatgtcactaactgacatcagggttaagctaagaagcactggaattaaggcatgtgagaagactgagtatttctattttttcccctagaattttgcaaatctgcattcaacagcatcacctgcagcatgtttttgacattgttggtcagcacaaattatttcttaagagaagcaaatgctcatttgcactacaatcacttgaatacttgggccacattattaactccaagtggaataaaggtttggccgggtattgaagtccataaaaaaatatggtatacttttaaccgtcctctcactgattatttatttagggggtgtgtttgaatgcgttcgtaccttattcttctcgcacgaaaaacaagctaacttattagcgcatgattaattaaatactccctctgtactaaattataggtggtcctttttttggaaaatcaaactaggcacttttgattaataattacactaataatacgtaggtcaagtattattatgttatattattagatttgtattttaaaatattttcatgtgatagtaattttatagctgttgatgacataatatgaaattaattaatggttaaagtatgctattgaagaccgtctaaaaatatattggtcttataatttgagacggagagagtattagttaagaaaacgtgaaaaatggattaatgagatttttaaagcaacttttctatagatttttttttgctaaaaacgtatcatttagcgtgaaaaataagacaagtttcataaatgttgctttaaacgtatcatttagcatgaaaaataacaaagtagaagttggaaaagggtagtgttgaacatagccttaacagtctcaacataatcaagaattttgtaagaaattaaagaggctctaactttagggtgtatttaaccctacctaacttctatctctataatactacctccgtcccaacatatatgacgccattgatctttcgcataacatttgatcattcttttttattaaaaaagtaagtatgaatatgtaaaagttgtagtttctatgatgttaaaacaagtaaaaaaaagatatttatatgattattttgaataagataaatggttaatcattatgtcaaaagtgaatgacgtcctttattttggaacggagtgattacttcaaaagctgagcacctgatgaaggaataggttatgtccttcaagcaggacaatcatagcattttttaggaaaggtttgggacttcagaacacaagcattatcgacctatgaaaaaaataatgctaactaatttattcgccgccgataagtggataagttatttgcaacacagaccatttaccatactaactaattacaaaaagccacactcatttgggagaacaaaaactcatcactagtattcagcaaaagcttctcccaatttgtgacatcctcctacctctacctgtgttaaccagatgacaaccagaactagtgaaagtgtcaatgatcaggaacaaaaacagagactcaaccactagtaaaaatattagatgatctatcaaattccaaacacagggtcttcctctctagaatcttgcaaactgcctacgatcatcactgcctttccttccgtatgggtttgaagggccgataccatgcctcctgccagtgtttacattcctcttctttcgatgttttgacgcactgctctccaggtccagattcacctttggaggctcactaaaacagaacgaagccgctacgctctgcaagacagcgaggaataacacacaagctagttcaattttctgtggtgtcaaaccctctaattcggtatgcgaatgaacacacgccattttcattggcgttgaagaaagagtttaagaagcattagcatttatcttacaccaactgacaattagacttttcatcctcagctagcatgctaatctaacagtaaaattaagaaaataacaactgtgcttctacttgagaactaagattagatttcataagtgaaagaataatttaaaaatgaactaaaggaaagagaacagaaatatgccccaacaaacctgagtaacatttagtgtgaattcttacgtgcaatgaaaacaaaatgcagaggaaaagtaatgcgaacaaaccaaagacaaccctgagaaagaacactgtaaaattttaccgtcaaatcaagttgatggatagcaaaaatgtctttcatagagtgtgatttgtatgccaaaagataggatttgtaggcttctttcgccgatctgtttaggatgtaattcccaccaacaattttctcctgctcaaaacttgagtcataatgctacatattgaaataatgggattaagtcattgtagttatgtaaagagacactcacaaggtaaggttgcaattttggcacaagctcttgtctgaacacatattcagatacagaaatattagctgcctgcaggaaaacatgaaacatgttggggcgttttggtttgataccaaaatgttgccataccaattttttggtactttaaatagtaaatgtgatgatttggtttgaagccaaatgtttggtaatgcctatactcaatgtggcacaattctagaatattcttcaccacaatttaaaatttggctctcaattggcataaatccaaatacactcatttacaattctaccctaccgaaatattggtagtgccaaaacttgcctagagtttgacactaacaacatattggtaaggtactaaaccaaacaagcccgttattccctctgtccaaatatattatgggttggagaagtcaaatcataaaaatgtttatggtatgaaattatacaactagattcatattttaagtattttgtgagaaaacaattgtcagatgaattatttcatactttcaggtgaatgagcaactgtaattctttcggtagtaagaacagtattgcacttcctttgccattatcgccacgggcagtacgaccaactctgtgaatgtaatcctgcaaattaaattccaatgtcaagttagtaaaagtgaggaatagaaattttctttggcaccatttaaaatccctaacctttgtttcatctggaggatcatattgcacaatatagtcctaaacaaggcaacaaactcttaggttagtaagtggacaaaaataggagtggttaattaaatggtctaaaaaccacaagtcaaaaacctcaccacatcaggaatatcaagtcctcgtgctgccacattagtgcataataagatgccatgttctgccttgtgaaacttaaaaaatgtactagttcgttgatgctgctttagttgcccatggatatcataacactctatctggatgaaattcagaagttgtgcatggaatttgactgaattacatgatgaaaagaacaccatgaccttcgtcttctcagaaagtgccttttttaggaaagcatacagaaccagaaaccttctctcactaggaatgacacaatagccctgcttcaatccttcaacagtagcctgaaagagcatcgcaattatttctcacaccaaagaacaaaaaaaagttccactaatcttgtgttcatgatcatcatgtaattcagtcaaattccaacataaaaaaaacttaaaaggacagttaaacagttcaaaagttcaatacctttgattcatgatcatcaactccaacataaacaagtgttcgctgcctttcttctttgctcccaaatgttaacttcgcaaaatcttcaacctacggaatgccagcacataagcaaagacaccaatgaaggaaacagcttgaatgagctgaataacagatccactaaccttttcagtctgtgtagcagaaaaaagaacagtctgcctaccctgcaaatgatgcataataaattgcaggataaatacagtattatgtcagtaaaaagttaaaggctgcatgatgcatatgaaatgaaattgccagacgggcagatagatggtcatatacctgccgaggaaggagtttaaatatttgtttcatttgttcctcaaaattttgctcaagtatacgatcagcttcatcaattataaggcactacaacattaagatgagttatgtcaaagacagtgaagagggcgagggggtcagtcacgacattcattatattggacagcaatttcatggcattctgtagcttcagccaaaactacctgtccatatggcaacggcaaaagtatcaactagatttgactccatgtaacacccataaacttggtgcaactaataacaaaacaacaagaaatctgcaacagagctaacaaggacttgacagtagaaaattatcacccgaaattttgccaatttgacccttttgagaacgtgccaaaaactttattgcaaaaatatacaaccacctcagggccagacctgatggctctgagttataacgccttagcgccacaaatgatggtgttgacctcttatccgaggtgagtgtttgccagatcaacgaagctcaatatatgcgcattggcactgagatctgtactagctaaaaggggtgaatgtcttctttgactgcaaggtgtgcttggtatagtggtggtgtcttattctcttatccaagaggtcatgggttcaagtctccatccaaaaaattaagagaatgaggacttgaacccatgacctcgtgggtaaaagcaataagggtatagtggtggtgtcttattctcttacccaagaggtcatgggttcaagtctccatccaaaaaattaagagaatgaggatttgaacccatgacctcttgggtaaaagcaagaggctccaccactgcattagccgcaccattatatcaaataaggcatgtgcttccttttagttagtagagagctcagtgccaatgctattgatgttgagctccaatgacctggcaaacgccatctccaaggttaacaccaatggcgctgagttagtgatccattttcgcaataagtttttcaaatgggtaaaattgtcaaaatgttggaacctatagaaagttgttttagacatgcctctagtcaaacatcaaaaacctttaccatctgtatctttttaaatatttaaccgggcacatgaaaattatacgtatggacttgtaatgaaacaacttccgcaaaagtacaattctatctgtctttacaaacataatacaatagaaattattgttaaaagttgcaatttggagacagtacgaattaatgttaaaaaatacagctttgcatatactcagcaaaatctattttgaaatttgatttatatactctaattcagtactaacaaacacactggacagaataaagggtagatgcaggcacacaatttatatacgaaataatcaggtgattgattatgcaaattgcgagagaaacatgaaaatgcagctcgtactttttaagcaataaggaaattttaatctgcaaactatttcaacagacaggtttagttccacattgtaaaggaaagtgtttctttacctttaggcattcatatttgaaacttttggttttttgcatatggtccagaagccttcctggcgttgcaactaatacattgatccctttcgcgagctgctcagcctcgcccctcaagtcaataccaccaattacatatccaagagtttgtgaatgatacctcattaattccttggcaacattgtgtgtctagagcaattgaatcaatgagacgcatgattaattatactgaaatacaaagatgagccactaacaatacataatctgaaccaaaatttagatacactacaaaatgctgccttttaaagtttaagaatttgctaataattggcaacagcaatgtgaaaagcagctttctgtgcattcttaaaaataccttgacatgaacataaattgccttaacaaagctagtacaatcttatctcattttacatgtacatccaatgttgattttttattttcactcacaagtcacaacaagttcaattgttgaacaggcataaaacatgtagtataaaatggatccaaaagaaatactgctgcatcatgcatgaaaaattttgtctgtcaggtaccaacaaacgccaaacaaatactagcaatgcgtatgaaaatgcacctggatagcgagctcccttgttgggcaaagcacgataactccggtcccgttcctcggcgagaagcgcagcctgcagagcagctcgatcgccgggatgaggaacgcaagcgtcttccctgagccggtcttggctgacgccatcacatcgcttcccaacatcagaggcggtatcgatctagcctgaatctgcaatcaatcaatcaatcatgaaaaaaaaaatgacacctcgttacatatctgtcgagcactgaaatccaacaatttttcaacaaaaagaagatggataactgtggaatttttagacgatggatggtgacctcggtgaggtgggtgtagttcatgtctctgatggcattggcggtgaggtcggagatggggagatccgagaagagcttgtccgtcagaatccctgatcccttcttcccctccccctgcttcttcttcctcttgctcttctcctccttcatcttcttgttgttgtgctccctcctcttccccgtcgcgttgttctctccctccgaattgcaggcggcggtgttgtgtaccggctccggttcagattccggcggagtagcggcggcggcggcggggcgcttccgcttcttggacgacggccggggcgagcgggcacagagtttgatcgggtgcattgcgtcgggaggaaggggagggaagcgaagcaagccgatcgggtagagtttttggggcttggacgacggggtgaggaggcggcggggcggcccggcgccgtggaggaggatgcttgcaggcgacggcgatgtggcggtggcggcagtccggccgtcgaggaaggcagtcgggtcgtgggctgggcagcgtcgcttgagcgggccaagaggattttcgtgagggataagtccactatgactccctcaattataggcccagtctggtttgtacccctcaaccacgctaccatatatcttgcccccttaattattattattaaaaaatcggtgcaaaataacttttccaatggttctgaaggtggtttatattgaaatgacgtgtacgtgccacattgacttattattcatcatctaacatggcactacaataataaaaataatacgtgggacccatagttttagtgactgtttcctcattttctcctctctttctctccacctcttagcgctctttctctctctatggtcgagacgatggtgaggaccggtaggaccaggatgtcgcctaccggtcgacgtgagaggtggtggccatgcgcgccgagatcagccaggcgaggaggagggagaggaaggcagcgacgatgccgaggacaacaagttcaagtgggggagggcgttcggcggctttggtaggccaggagttgggcatcggcgtggctcaaagcagagacgtctcccaacgagaaggtcaagcggctacgatggctgaggaggccaccgtcgccacttgggtcgtgagtggcgtgggctgatgttgttgtgctgcacgatagtgtcgtcatcggggaaggtattcagctgaggagggagctaacgagggtacaacggtggtgctagcggtggtcacagggtactgcatcgaagaggagatggatgttgggtgcaaccgcacacactctccttgctgagcgtggcactgctgctccccccctcaattaacacgatatgagatagaaactaatatcgatggtggcactggttgcctaacttcgccaccctctcatcatcatcctcgtttcccccaaccaccaccgcttggtcctccctgttgtcgtcctctcccaccaaccactggttgcctaactttgccatcctctcatcgtcatcctcgttttttagtcccgccttggctagctaaggtaaaggagaccatcctataagataaggtgtccggttgaaaaaaaatccggttaattgttttgcactgagcgaggatgaaagcacaaacaaattaatttaggggtgtggttcgactagatgagttctggcatctacagcctctagaatctctagctgcaagaagctcctcaaatagtccagattttcactcggatttgaagaaactgtagttgtacaatccagaaaataaactagaaagaagctgtagttgtagaatccagaaaatgaactagaagacagaaactaggtttcctagcttctctagataagctcccccaaacagggccttaagtcccgcctcaactagctatgctgagggagacaaaagcgcaaacaaataattcagaggcgtggttcaatttagatgagttgggcctaaatccgtatcacaccccagatgtttcgccgggcgccggaaataggaaaagaagctgtcactagggctgtcaatgagccgagctcgagcgagcttgcctgcctaggctcgagctcgatacaagctcgagccgagcctataaaatgttcgagctttcaaacaggctcgctttgagctcgatcaagctcgagctcgactaacgagctcgatttttaattagaacaatgtatatttcaaaggataatttttaaaaactatttaatttatggtttatcatattagtgtaagaggaaaaagaataaaataaacatatgatgccaatacaaggcatacaaataacatatttgatctaccgatttgttaaatagcaacataaaatcatatattactaggctcgttagaagctcgagctcggctcgacaaagctcgcgagctttgggacaggctcgggctcggctcgtttggagctcgaaccgagctcgaatcgagcttaggacgagtcgagctcgagcagctcgcgagcctcgagctttttttgacagccctagctgtcactaaccaatggggtccacatattattttattgtttttattattgtaacgccatgttagatgataaaaactaagtcaacgtgacagggagacgccatgccggtgaaaaccaccttcaaaaccacagagagtcattttctatttaacggagcgtggggctcctcaccgggagaccgcgcgggcccccctttgccggttcggccgggggcgctaggtgaggttctaagcactcgatctgtggaatgttttgcgagagagcaaatgcgcaagacacgggcgatgtagacaggttcgggccgctgagaagcgtaataccctactcctgtgttctggtggatctgtgtacgaaggagttacaaagagctggagagcaagagagttcaaactctagaaaccctcttcctctttctctcctctacgagctcaggtcttctcccccttctttccccaactccccccttcttaagtgggcaaggtcctccttttatatctcaaggggatcccacatgcaccacttctacctactcttcttttgggtggggactcaccctatcttcccaaaaaagaaaaaactggcttgccccttcgcctggaagctaaatcacagcttgtctttgagtgaggcccagcgtcatcactcgcctgacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgaccggtcacacactgtgacctgtcacggaccgaacgagtgtgctgcgctgcattaaatgcggcgtggggcgctcgtccaacccgaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagatacccccggtcccatgtcaccgatactattggttttagtagttgagtgattaaactatctggtattatggttaagggatatgaattcgacctataattgaaggagtcaagatggactttttcctttttcgtgtagagaaaccgagaaaatcctaccggattgggcctccactatttattagcactagcccgtttacacattggagggacccatattcgttggacggggtttaaaccagcccaaatctaaagtattgataggagtaatctttcttgaaaagttattatgtaaaattatgtgagccatccgatttcccctctaaacaatatgaaaccgttagatccttgaactggtgaaatcttttcatggtactcgaagaaacttctttttacaagaaagtccttccacgtccctaagatagaaaaaaatcatgattccccggtaaaaaaatcgtgatggcgagacaacgtgcacttcccgtcctccccctcttcgccgcgtccctagtgttgtcggcctcttctctcacgccgccgcctccccatccctcctcccctcccttttctgcagcgccacctcttcctgatcccgtcgtcgccgtctcctagtccctggcaccggcaccgccaccatctactctccctccaccctcgtcctatccctcctagtttaaagtgaaaatgccaatatgacatcctgttataaaagaaatagtcattataacatttaaaatgtcaaacacattaaacatatttcaagccacgtcgccaatatactccctcattccctaaatgtttgatgccttgactttttttaaatatgtttgaccgttcgtcttattcaaattttttttgtaaaatatgtaaaactatatgtatacattaaaatatatttaacaataaattaaatgataggaaaaaaaataataattacttacatttttcgaataagatgaacggttaaatattttaaaaaaagtcaacagcgtcaaacattttagaatggagagagtatttcagtctatgcatcaacttgtccccataggtcttacacaaagtcacaaacaaccaacagggcctagatagcatcttcaagaggtgactaaaattagagtccaaaaatcttttattctctaatgattttacagttagtattaattaagtagatatcccactccactacacggggttacattgaatactgatagaacccacaaagatcttagcccaattacaatcattgtacctgcaaattaggagcgcagtttcacttaattttactgcgacgatacaacagaaacgactaccgaatcagacaggcggcagcacagcggccgacgccgccgccgcggccgccacggacttgcgcggcgggagcacgcggcggcagagcgggcaagtccggcggacgcgcagccacacgtcgacgcagtcctcgtggaacaggtgcccgcacgccggcagccgccgcaccatctcgccgccgcgcaagtcctccaggcacaccgcgcacagcacgccgccgccgccgccgccgggctcgtacgcgaacgccggcagcacgccgatcccccccgcgccgggcgccatcagcccgcacgcgcacgggcagctcagcagccgccgccgccgccccgacgccgccgccgcggcggagcctcctcccgtcgtctgcgccagcctgccggcgagcgccagcaggaggagcgcgaccgcgacggcgacggcgcccgccacggtggcgctcacggcgtaggcgatggagcagtacagccccatcaggacgttcaccgccatgaagccgtagcaccctagcctcgtcgagcagccatcaccgccttcctcctccgccgccgccgcctcgggcatcccgaccagcgatttctccgatgatttgaactgatttatttcgtgccaaattcctacgaaatgctacgaaattttcgaaatgcagcgacgacgccgaatacaagaaacactaggaaatgagtagctagcacacgatctgcatgaacatagctggcggattacaccagcagcgtcacgctctcgacgtgggcgacgagttccagacgtgtcaagcacgtccgttgctgttaccgtaccattttaagtacgtacacctgtccaaatcggttgcgtttgcatcaatcacaaagttagtagagtatattaatttgagagtttgtagagatttctgtattgtcctatgccggctaaattccaaatagccggtttggtcacaatcttatggaatcttggttgattattatgtcctgttgatcccgaaaataatgggttacagaacacggttacagggcacacttttctggtttggaaatgctaattagttagtataccaagtggtagaacattcggaattaatgtacagtgacgcagtaataacaacactaggtgatgttagtagtgaacaccaagcaaggtgaattagcgtttcacaccggcggcagcacgtcggtggaggagaccgtcgcggcggcggcggaggatttcgcggtgaccttctccggcgagaggtcgcggcggcagagcgggcaagtccggtgcgcgtgcagccacatgtcgatgcagtccacgtggaagaggtgcccgcacgacggcagccgccgcaccgtctcgccggccacgacgtcctccaggcacaccgcacacagcgcgccgccgccgcgcggcttgccctcgccgccgtcctcgacgtcggcggcggggggctcgtacgcgaacgcgggcagcgcgtcgatggcctgggcggcgagcccgcacgacgcgcaccggcgcacctgcagccgcaccgccggcgccgcgcgggcgctaccgccgccgccgccggcgttccccgcgtagagctcgggggccagcgcgacggcgaaggcgtccgtgggcgcgagccagccggcgaggccgagcagcaggacgagcaccccggtggcggcgaaggccctggcgacgccgacggcggagacgagcgcgcacagcagcagcagcgacacgcacgccaccacgatgccgtagcaggcgcgcgcctcgccgtcgcccggcggtgcggcgggccccgccgccgccgacggcgcaggccgcaccgccctcagcatggccgccaatcttgccgtcctcctcctcctcgcgatcgctagcactagccccaccaatccaccatgcgcgagcagcagcaaagcgttccaagaatccgcgggcgaggggtggaatggtgaatggaatggtggatgcggatggtggcggcggggcgcgcggcgtgtttatctcgttgggattgggaggcgtcgccatcgatgggactcggctgctggttggtggacctacttgcctttctcgctcgcttgtttcagttggatagacttggcaggcacgcacgcccacactcctcgtacgctcaaaatatcaggcgattcgcgatatttttgtcaccgtggccttttgtgttgtgggatcacgcagcacaggctgtttattactagaacacaggaattttatagtgtgtttatatagtttagttttgtttgttcgtaaccttgtaaattgtttcttggatccgaaaagcttttacatgattttcgtataaatcgtaataattcatacattcaataggtggttcaaaataaagtatttttttgggctgttctgctacaattaacggcacaaccacgtagccggttactacttattacttgctacataagtcaaatttgttagaggctgcgaaacaacaccgtaggcagctgaacaactccttcattcgcatagagatagtttttttttacttattatcctcttggatagcatactccaacaaattaaggggaaaatgactacctgattttttttaagttttatcacattttaaccgccaactcaataaattgaggggaaaatgacattgcggctcctttcgtcttttttttcttccccttcatctatatgtgaccatgtctccgtgatgtgtggcgatagcggtggcgaaaagaataggccagcgagcgtggcagagaagaggggtagtgggtgcttgtgtagttgtatgggcgcacagatggcggtgaggacgacaagagcgcagaggtgatcactactcatatgtaaggcaaggcaaccctacaccactcatattatatataaaccttataggttatagtcttatttcttttactatatttaatgaaactattcatggtctaaatgctggtttgtaaaaaaaaagaatggcaatagctaccaagtgtctaaatgtgtgtgtttgtttataatgatcatttctacgcgtgacgaaatagtttagactcagttcggctcagtatttggttgtggctattcacggctcaaaaaatggagcggattattagctcatggttaataagtattaactatcataaatttgaaaaatatttttttcatttttctgaaaaaaacttctatacagatttatttttaataaaacatgcagtttattgatttgagaagcatggtaaatccagccatatatttagaaaattttatttcccgcattttacttcacttgtaaattaatgaacatttaatataattctaacaataatttattaaataatttataaatcctgaaccaaaaatcaggattaagttgtacaaagagggtattttttataaaaccacagctattatagtttaagttgtacaaaaccaaaaaccacatagatttaggcatatggcacataagcctagatattttggtcataaaattttcacaaaactacactattgatcattttgatatggcaaattttgttataggatactcaaaatttgtgcaatttgcagatagacatcgaaaaaatgtgttacagctaaaagacactctaaacaactgataatttgctagaggatactctcgactcaattgaagaaataaattcttaagaaatacgagaatgaccttaggaccacatgcttcagacatggcattagagtaaaagtttagaaattatgcaactgtaaatttacaatcaacataagtaaatcactagcataaatcatatttcaccttcactctattctcagctcaaaagtttttgaccctaggggattcttgtctttttgaagaatttctctctctaattgaactgaaaaaaatcttccagcaaattaccagttttttaaagtgtctttcagtcatgacatattttaacgatgcctaccagcaaattacacaaattttaaatttcctgtagcaaattttatcttttgattaggagtatgtcaaaatggtcaatggtagggttttgagaaattttaaaaccataatcccttgagttatgttccacatgccaaaatctccgtggttttgtgctatttagatcataatagtagagttttatacaatttaataaaagaaaattatccctataggatggattagagagtactaattgtcttattaatcgcatccatttaaatttgttcaaatcttataacaaccaccgttactctttacattgataaagaagattataacttttttctctatcactaattttttctcctacaacatatattatttttatatatggggatggagggagtaaccaccttagtctttatttaattttccgcacaaaacttttgtagattccaatgttttatccacaggattttcttcacactggtggagaaaccatctttggtcggtcggcccaattccacaatagtcccggttccaataaaaaccgggactaaaaagcatctttagtcccggtttaaaaacttaggggtattttttgatctttagtctcggttggtaacaccaaccgggactaaagatcatttttactcccggttgaagaggttgtcaggtcgtgtcaggccccaattatttttagtctcggttggtataaacaaccgggactaaagatccatctttagtcccggttgtttagaacaaccgggactaaaaatcaccccaagccgagcgcgatgtttatctcttcgcgtgtccattgtctg

SEQ ID NO: 67192 - DNA, 724 bp, Oryza sativa
tcgcctaacactaagaccagcaaattaacaccaccgatgccatccaaaactcaaccagccttaactaagcagtactagtgaaaaggcacaatggtctataggatcacggaaaaactaatctactatttttttttgttggtcttttctggactataggaaaaaaaaataataatgacgaagggaagggtaaattcttcaccgatgaaccacgctctgataccacctgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgaaattgctagataaagatgaaagtttcactatcaaacacaatatggtggggttccgattacaggcagacgggcggtttagccaacacgcgcgctgcgagccggtagcaagaagctaactctatcatcaaaacccgcctgttcttggcggcgactagaggtataaaaaagaggggaagaacgaccatagggtcgtgctccaaccctaagacgcgcccctaatgggcccaacatggatacacagcccattgggccaaagaggtg

SEQ ID NO: 67193 - DNA, 26463 bp, Oryza sativa
gccgcgcggaggcggcagctgcggtgggcagccgatcagcggcgaccggcgcggcgccggccggcaggcgcggaggggaggcggcagtggccgccggccggattttttttcttttttttgagatgtgaatctgtgatgtatttttgtgtgagatgtgaatctgtgatgaattttttagaatcttgtgatgtaatttttttaagagtttgtgatatatttggagatgatttgtttgaggatttggagatgttctgtaatatgtaatgatttggatatgggatgggattgtgtgaaatcaatattcaatattaaaggcagaaaaaaaaaaaaaaatatctttcgtcccggttggtgttatcaaccgggactaaagatgctcccatctttagtccggttggtaacaccaaccgggactaaagattgatttttagtcccggttatttgaaccgggactaaagatagcgatctttagtcccggattcgtagtcccggttagaaaaccgggactacaggggggttatgaaccgggactagaaagcatttctccaccagtgtcaagatcagttcctgcaattgctcaattgtgcaatccataattaatagaccctgttgtatgaaaaatgtcagacagcaatgtaaagcggctctgttggacagctagcctagtattgtcgacttagcaaaacatgataccataagggccccatcagtaaccgaaccgtaaatcctcatttcgatttgaagcttacatcactaagggcctcatcgtacggcacatttgcaaacgaaaaataatttgtgaataaaatttttatacacgtgttcttaacgacctaaaaacaaaggctgaaaaataaacttcgatgaaaaaacctaaaatctttaaggctgaaaatttaaattttagctaataaatatagcgaaaagatgagtccgtaaaacaatatgaaatgcttagcatttagttataaggacagtgttttcatccatgagaccatgattggtacaaaggttgggagttcatcagttccgttatccaaaacatatcagcgagcacagatcgagcaaagatggccttggaattctttcggtcatctcactgctacagcgccaattttcccgtgcgggcgacaccctagcaccggttcttaatttttctgtgcgattccacttacaaaccgcacggaaataaaaaggggaggcgtccagaaaaatcaatcgtatagtagtgtcaccagcttgggtcttatgtacagttgaattctgtaagactgtaaccaaaagaacgaaccattgtgtgagctgttaaaatattagccggtctagttgcatgctggaaacctacctcactcatttgtttcacttaccgcactgtcatgatgcatgtatggcagcgcaagacctaactcaagacattatacaatgcacacatgtggataatgaaaaggacattacacagtgcacatttgtatgcacacttgccaaaatagactccactagaaaaaggtaaaatccaattttagcccttgtactttgctagaagctcattttctacggaactatgaagtcggttattttttaccctcaatgtaaaaccgaaagaaaaccttaagatatatttttattggtttgtccgaaatggaggtgattttgttagttgatactcttattcgcatattttgccgatgagtgactctgtgactgaacgtgcatctttactatgggatttgaaggtttatttatcttgacctcctcctattattttatcacatagcaaacgcacacgtattatatttgcgcaccactgtgctcgcacgctcgtgaatgcgtcccgcacacacaaaacttccaactcacgcattcacaaatgtgtctgctaatacacgttcaaagagatgaaaatcaaccgtgtatttctgatcttgctaattcctattaaaaagttatttgcatgtgtgtaataatctcgttgggtgaaattatgcagtggtgctgcttcccgacctctttctttttccgctcctaaagctccttcacctgacacggcccattgcaaactgtcagcagatatctatggacaatttcgttcttatccttgctttgatgtccaatattgattttgtcactgctttttagggttttcgtttttgtccctgtttttttaaatgaagtagatatctacccctgtttttgacagaagttagtggaccttgaattattgagctaaaaaaaataagaaaaagagggaatattgattatgtatttttttggttgacctttgtcctcctagggagagaagaaaggaagggagccaggctccgacgccattaccctcccaatcaattttctccaaccctaggggacctaggcggtgacggtgagtcggcgacggcggcggcgatcttgccggcggcaactagcagccacctccttccctggcgaggcagtggggagtaggcggtggcggcagcttcactagcaggcgaagcaagcggccactagcaggcgaagcaagcggccacgacgatgacccgatgtggggaggaggcggtggctactctgccaggtggtagggaggggtcttcgccgtggtaaggatggatcttggtggcggcgacaatgggaaagggtcttggcggcggcgacggggaggggtcttggcagcggcggggacgggaaggggtcttggaggcggcggtgggggagcaggaggccgcgacatcgtgccaacaagtagagcgcagagacggtgcaaggcgacgatgagttggcacaagggaggtgaacacgatggcgagcagtgtcgactaggcactaagacttgatttgcttgactttgagcacttggcatgggaggagcaagaggatgtaggattggatttacttcactttgtgattggaattttttgactttgtgatgctttgctatacttccgcttgttgtgttaagaatgtgtgaaacttgtgccattctatcttttttttttgtcaaaatgtgtccaattttttggcaaaattatgtgaaattttgaagcaaaattttgcccagtctggcaaaattgtcatacttgtgaaagtttatcagaattgcgagctgataaatagtaacaaatacacaattcatataaaaaatagtgtcaaatgtgtaatatatagcaagtaaggtaaggatgtctttttgtcaaagatttaacaccgttaagatacccatccaaaacaggggtaaattttggtttcgattcagaaaaacaaagggtaaaaagaaaaccgtaaaaaacaggggcaaaatcaatattgaacatcaaagcagggtaagaacgaaattgccccagagtacagcacaagttgcatgcattttctgcaatctattctctgtgttctctaactcaactttttatgtgcatctttttgcagatgcccatgttttagatgaagatatttcgagagtttcttcaagtgcttagttgtacgttcaccatatatgccaatctgaaacgaagacgctgattcattcttttttaatttccatgtctcttttcatagaattgaaagctcaaaattgaaaattttggattgatttttcacctgaaaattccaactgaaatggtcttggtatagtcgtacctataaatagcaaaacacgctgatttgttgagttacatatgcataattgtaaattggtcaattaatggacagttacaaacatctcgatcatttaatttgccataatacgtacgttctaatgattgtgtcaggttctggactgggcctcagaaaaaacgagctgaaaacgcaggcccaagctatgggcatcagcccggcctggtagactgtgagctggattgggctgggctgagtttgaacaggtagagaggtggacacaatgtagcaagggctgaaaatgattgcttagtgttttgggtagggtttatcttttccttttgcaaatgaaaaccgcatctcaccggcttaaaataagtgataaaaatgaacgatgttaatccaatgaaatttctccataaatcttttgatttaaaggggcccttaatgttgagaacccctgcttggcaggactttgtcatttccgttctatcaaaatacacacattcttcgtgtcaagacaatgtgatcaaggagcaaatctaagcccacaagctatacaagagacatacacaaaaaaaaaaaaggaagaaagaatcaaattgcctgtcaagctatagccttatcctggcgtctcttctgcagcctcgttattaatgtggcaccggcgacggcgacttggaccgcgaaccaccaccttcccttgacagcgccaccacctgcgttggcgccgacgccgacgccgacgtggttgcacctgcatccaccccttccaccacgccgacgcctctcgccgccgccgccgtcgtcgtctgcagactcagaccacctatcggtggcgacgacggcgacggcgacttcgaccgcacaaccacaaccggcgtcggcgagctcggccaccgctcgttcaggctgtggtacgccgtcggagacggcgaacgtgaggcctgcacgtagttgatgatcgccgcttgaaccggtgacgacggcgacttcgacgacgtcgacgtgatcggtccgccggtggtggtggtcgtcgtcgtcgaggtggtgttgcccctcaatggagaacgtgccaggatgtccgccagggcgcgcgacgccgccgtgggccgctccggcgacaggccgcaccggcgcagctgcggcagcggcggcgacacggccacgacgtcgctgagccgcacgccgtcgggctccgggtgcgcgcggcacaccgggcacgtggagtgggcgcgcagccagaggtcgatgcagccgccgtggaagaagtgcctgcacgccggcagcacgcgcaccacgtcgccgtcggcgagctcctgcaggcacaccacgcactccaccaccaccgtcgtcgcccccttccccttgccgctgccgccgcccctcctcccgccgccgccgaccagcggcgacgccgccgccccgcgcgcccggtacgtgaacgtggggagcgcgtcgatgtcgtccgagctcagcccgagcagcgcggcgcgcggctcgccgccgccgccgccggcctgcagctggcgccactccgacatcaccgaccggccgtaccggatcgccatgtacaggatcacgccgacgaggacggcgatgatgatgtacagcagcgtgaagttggagctcgccgtccccggcacggccgagccgccatcgccaccaccggagctcggatcagacggcggcgaggacatggcggcgaccaagaacaccacccggtttcaaggacatggcaatggtaaacaaaagcaatatcgatcaatcaaaaccaaaccgaaccaaccattcgatcgatcgaggagaagagggtggttgtgcgagatcgatcgaggcatgcatgcttcgcgcatgatagggttttttcagttgggtcgctagctaagctaagctaagctgggcttggatgatctatcgagacatgatgagacgccacgccatggagtattagtatttgattggttagaaggattattatatttttttaggacatcgttttgtgataatttcgtgttggattgggttgctgggtagtggtattgtttaaataaatttcatctattagattatctggtcatgcttgaattcaaatcattcggtggtgattttgtgcattttgttagtcatggttgattggtgactttatcattgtgaaattgcgagttgcttgacatatgctggtgaatgcctggatagggatcaaatataaggctgcggtcaacttcgcaaccaacagatgcacgtatcattttgtaaaatatattttgggacaattaagacagtgacatcatcgagaactggaaatactaaaaacatttgcaattagaacatcctaggcactagaggagtaacgttgaaaataatcaaatatggacaatattccatataaaattttccagaaaagcataaatattctggcccactaccccaaccatgtctaggagcctaggataggacttaagataggatggcagcaacgaagcagagacagcaagattacgagtgcattagggcatccacaatgtacactgaaagtaaccttagacattaaatactgctacagtacaacgcatttagcattgtggagtcagaccacaagtccgatgcaaccaaagtacaccttaagcttaaggtgtagcaacaaagctataaaatacaatacttttactgtttttctgtgcacaccaataaaatatacatgtcagttactaaacatagtaacgagtactactagccgttgctgctattccatttgagttgctcatttggtcccctagccgttgtcttcctccagcattcttctgctgcctacaaaaggaggaacaagtgagatgaacaacaatttttgatctattcagttttcccacatactaaatggagcctttcaaaggaaacttctcaaacctcctcaaccaaggttcctcaagccaagcaacaaatagtgaggcccaaaactccctttctacccaatttcccacaagttatccccaaaacttcagacctagttttctccaaaatttccatccttttggtcctccaagcaactaccagccatatcgacaccctccaatctttcaaggtgctcagcaacaagaatattatgggcaacctactccaggaagcttggaaggttttcaacttcaagaaaatctggtgcactcatctaaccaagcatttggatttgcagccaatagatcacagtttggtatgcaatatagtacttcaattagggctacagccaacacttcttctcatggatcagcttctccatgtcatacaagacataatgagaaagaagtagttgaggttgaagaggcaagtgatagcagtgaagaaggaagaagagggacacgcatcaattggactgaagatgacaatatacgactaatgagttcttggttgaacaattcagttgatcccatcaaaggcaatgacaagaaatcagaacaatattggaaggctgtagctagagagttcaacagcaatatgcctagcaatgggaacaaaaggaaccccaagcaatgcagaacacattgggacaatgtcaagagagatgtcactaagttctgtggattttattctaaagctagaactactttcacaagtgggtattctgatgatatgataatggagaaagcccgtgaatggtacaaaaagcacaacaaccaaaaacctttcaccttggagtatatgtggaaagatcttaaagatcaacctaaatggcgtagagtccttgaagagagtagccataataagaggagcaagatttctgaatcaggagcatatacttcatcgtcgaaccaagacacagaggaggaaacagagcgcaaagagaagcgccctgaggggcagaaggcagcaaaacagaggcaaaaaggaaaaggtgcaccatcacctttaggggataagccaagtcaaaatatggttctctttcacgaagctattacaactaaagcagcagcattgctaaaggcagcagaagcaacactgattggagcagaagcaaaaaaagagaaggcgattgcaaaaaaaagagaaggcaagggcagaaaaataccaaatgtatttaaaactgatggagaaggatacatcaacctccagtgaagcaaaactgaagagacatgaaaatgtattggaccaattagctagagaacttgctgaggaataaatgactagcaagcaatgttagcaattatgcttattttataatgtcagtattcttgtcatatattaaaattatgtactgtgttgatgcttgtactgtgaacctatttgtattgtactatgttatggtaatttgtataaatattgtgtattacagctatggaatgaaactacaatatccttagtacttgagaaatcaccttttcacatggatctagttggtgttgatggtttttcttccatccatgaccaatctgtttttttttctccacctgaatacatatgagcaataattaatagagaacaaaagcaagagggatgttgacaaaacctaggaaaatatagctgttgtaaaagactgacaaaagcaagagctagctgttaggatattgacaaaacccaggaaaatatagctgttgtaaaaatctgacaaatctagtcgttgtaaaatgtatcatctacaaataggtaatgtagttcagcagaacaacacccattctcattttgttcaacttcatctcaacagccttcccactttcaaaaaaaaaaatgtccagcaagtcaccacatcaatctagtgagtcagatgattctagctctagtgactaccttgaagagctgattttggaagaaatcaatgatcctatggaagctgagattgaagatgagattgaagctcaacttcaagctcaaatgcaagcacaacaaactggtcattctaatcgtcgtgggggctacaaacgaaggtacatcaatagagattaccaagacgaccacaacagattgtttgcaaaatactattccgacaatcctttatataccgatgatcagttccgtagaagatttcgcatgagaaagcatctatttttgcacattgttgaagctcttggcatttggtctccatattttcgtttgcgaagagatgcatttggcaaggttggtctatcaccgttgcaaaaatgcacagctgccatacgcatgttggcatatggtacaccagctgaccttatggatgaaacttttggggttgcagaaagcacagcaatggaatgcatgataaattttgttcaaggtgttagacatatatttggtcagcaataccttcgcaagcctaatgaacaagatatccagtgtttacttcaacaaggagaggctcatgggttccctggcatattgggtagtcttgactgcatgcattgggagtggcaaaattgcccggttgcatggaagggacaattcacacgtggtgattatggtgtacccactatcatgcttgaagcagttgcatctgctgacctatggttttggcatgcatttttcggtgctgctggttcaaacaatgatatcaatgtgttggatcagtcaccattgtttactgcagtgctacaaggaagagctcctagtgttcaatttactgtcaatgggacagaatataacatgggatactatttagctgataatatttatccagagtgggctgcatttgccaaatcaattactagacctcaaagtgacaaggctaaattgtatgcacaacgccaagaatcagcaaggaaagatgtggaacgagcatttggggttttgcaaaaacgttgggccataattcgccacccagcacggctttgggaaagggatgaactagctgatatcatgtatgcatgtattattttgcacaacatgatagttgaggataagagagacgattatgacatacctgatgacaacacatatgagcaatcacaatcttctgtacaactagcaggactcgaccatgggccaatccatggatttgcagaggtcctagacgcagacatgaatattcgcgatcgaacaacccatcgacgtctaaagtcagatttgatggagcacatttggcagaaatatggtggtcaacaacaacaaaactagagtttatttgtgttatgaaacttgtgttcttttttccatttttctttcagtcgtccaatttattcttattagtaactgagactctttactttttcatgcactaagagtaatgtaccagtaccattgccttaattagtcaagcacaagtcatattgaaaatatcatgtttttttggtcattttttttaatttcagatctgttggagcacaactaaacactctatgaaaattccatcgggatcgaaatcaacgattcacatgatgcatacgtacaaacagaaaaagaatctgtagtagcagcacttgcacatatttgatgacaaatttaatcgtagcagcagcagcacttgcacaaacagatataaatttaatcaccgggcaaaccaaaagcaagaagagattccacaacacggaaaaggagaggccacggaatcaatcaccttgtctctaacgcagaactcacggacgatgtaggcgaagttgagggcggtgaccgtctagtaggtgctgatggttgagagcagcttcaagtttgtggcgcagacgagacagagaagcacgcgtcggcagcgtcgcggccggagtagttcgcgcacgcagcgtcatcgatgggtgaggccgcgcacggcaacgtggcaccgaagccacggcacagcgaggtcacagccgaaggaggggaggccgggaggagcagcgacgttggcgcagccacgggaggagcaatcgtcggagaaattggggatccagtgcatgcgctgtgggagaatttggggatcgagcggagcgacgaagagaggaattggggatctgaggcggaggaaatggggatcgaacagagtaacagtggatgaggattttttttcactcgcgcgaacaagcagatggttaggagtgatctgtattctttttctcccgtggggcccagcgggacccaccttatttccatcaaacaaacagtatcattgtagagatttccttaataactattgctacctgtagatgggcccactcttgttatgcattttaccatatacattggccttgcccttagaatagcggacaaagtagtacacatacaggacaatcattattactctatcataggctaaagcagtcttatctaatgtttgcctaatcaggaagagggcccgaatatcattttacccatgtgcttagggctgtcaacgagccgagagcgagcgagctcgcctgcctaggtttttaaagtagaacaatgcatatttcaaggataatctttaaaacataattagtttcttgttcatcgtattaatagcagaggaaaaaagaataaaataaataataataccaatacaagatatacaaataacatatttgatatcctaattaattaaataataacaaaaatcatatattactagctaggctcgttagaagctcgatctcagctcgacaaagctcacgagctttgggagaggctcaggctcagctcgtttggagctcgagccgagctcgaatcgagcctaggacaagttgagctcgaacagcttgccagcctcgagctttttttgacagtctcctatgtatattagaagcaaatgccaatttactttaaaaaagcataaagtatttaaaggactcgttttctacaagatatggtgacgtggattttatcaaattgtagtttttagttttgcaatatatatatggtttgtatatttttagtgagcatattctcgaactgataaatgttacgattttttaaaataaaatatctttttaaaattaaataaatatattttctaagtttataataattaataattaattaattatatcctaatggttcatctggttttacgtgcaatggaaaagctcctcacatttgaacgcagcctggttcatgacatttaatttaggctttgtttagttcccaaaacaaaaattttcacgctgccacattgaatgtttggacacatgcatggaatattaaatgtaggaaaaaaatcaattacgcagattgcgtgtaaattgcgagacaaatcttttaagcctaattacgccataatttgccaatgtggtgctacagtaaacatttgctaatgacggattaattaggcttaataaattcatctcgcagtttcttggcgaaatctataatttgttttgttattagactacgtttaatacttcaaatatgtgtccgtatattcgatgtaacaataaaacctaaaaattttgcctaactaaacaaggccttagactatcttggtcctccaagctagtttgcccttggcgcaaagtggccctggggcacatctaaagtgccatctttgcaaggcaaccgtatgccaactttgatggtgaactctctttgagaaaacaactatgctccctgatcagctagtagtaaaaaagagtgaaaagccggtttgacttacctcatcatgctagcccacccaccatatatccactccatgcattcacttgtgctatgtggtttgactcaggtgaaggtaaatgggggcaaacattccatatatcgatggaaataaaagaacatataaatttagtttatttcataaattaatcataacattaaacttgtaaatactagtagaaccacatcatacgatctaagtatgtaaactagatagtaaaacatgaacatatcaaataggcgaaacatgatgaatacgtaccgaggaccgtggttgtgctgtgaatcaggttgacgaggagtagcacgcaccgcaggaacaacacacggtgttagatgttgtcattggtgcgcatctagagcatagaggaagacaagccgttatggaagactagtgagctgtcgtgcgaagcgcttgctaaaaacgccgccttctctcggtgtaggaggtcgaaggcgaaggttccgaaaactagctctaccgatagtcggtgcatgtcagcaagcaggacggaatagactacgagcgacaatgcaacatagaggaggaagaaaatcctagattgcttttcactgtcttgaaaggagacgatggcttggtttatatagagataacaggatacgtgatcaagatgcctgcacgatctccacaacgtgtaatcaaactggataagttgtgcataacctatacggactccactccactccacgcactggattatttggtgtgtttcaaaaaacaaacaccgaattttgcagcgaaacaaaactgcaaaagacatatcgaattttgctggaaaacaaaattgcaaaaggaaaccgtgtccgcccaaggattaggagccaattttgatgaatcattcacacacttatcatgtacatgcaccgccagacgaggtgaggtgaacaagcgcgtgtgtttctttagttctttccaccacacatgtctcaagtggttagaagagcactgttctttttaagaatgtctcctcttataatactgtcgaggagtaaccctctctagcaggaggacgtgagaccctcccctttgtgagtttggccaggggataaggcacgagtgatcaagagctgaccttagctgaggatttggttatggtggtcgaaagtgatcgggagtgaggccagagattatacaggctcgggccgctcggaagcgtaataccctactactgtgtgtgtggaactatgctcgagttcttacaagaaatcttgggctctaggaaaacctaactgtgcttcccctagagttcaagttctcgaaagtcgtcgtctttgctcggcgggtaaggtcctccttttataattcaaggggataccacatgcaccgcctctattcgtctcacccttcctggagaggggtctctcttccttgggttctggtcccgctcatgccttagaccaaaagcaacatggccgtttgctccgaggtgggtcccaacgccgtctcccatctgacatgggggacatcccctgtcattccctcattaagccttgaagacttttgtgggctcatgataccgggagcgcactggacgtgcgtgctgagccctaatggctgatgggacggggcatacttgcccccacgctgcctgacacagggcggggcgtgggtgcgctgccacccgtcccatccatctgtcaccggtcacagactggtccaagcgattgacgcacgtcaatcccttgggtggcgtcgcacgaccaaccatgccgcattgcgtgggtggttgggacgctgtccgtaaacgtgccagtggcgccccctcctccgcccgcccagccgccacatggcagctgagcgggggccttggggtggcgcaacccttcgggcccgaggggtgcgacgggataccccgaggcccctaggtggatgcggggcgcctctcggctacttacaggtggctaggggaaagggctcctccactccttccccctaacatgggtatcccgggtccatatcaccgacaaatactaaacatcctcatgcatatcttcttatgaagtgggattttgtgtttttcttataattaatctctgaatggaacttggcccatccattaattcaagatatataaggtgtttaatatcgttctaagttaaacttaattaagttttttgaagttgataaaaaaacataccaatatatataatattaaattaatttcgttaaatttactgttgaatacattgaatatgtgtttaattatttgctttgggttgaaaatggtatcattttctaatagaaatttgataaaatctaaataagtttgatttaaaacaaacctaaaacacttttacaatacgaaacacagcaattagaacataaaaaataatatggagcgaaaaaagactctaaaggagaagattctaagaagccaacttgtaagaatctaaaaacgctgaattttctaggttctgacatactccctctgttccaaaaataccccaatcctagatttaaaccttgacacacatattgatttttcttttgggacggattgggggaattctatcagctggaaattctgtgagaaactattgctgccaaaagctttctaaacatgctcaaaaccttgctgaacttgagggatcaaatttgttatttctttcgtttttatagacatgtaccatattgtcataattcctcctttttaatgatgatgcagcatgtgcttgagagaaaaaaaatattgctgaaatgaaaataagccttttttagcgcatcgtcgaaatgggttgataacctaaaatgtctgttctaaaaaaaacataaaatgtcttgtaaataaagtcaaagggtaggctacatgacaagtcagtctgttctgacaaatgtccacttgcgtaccaaataagcagtcaagtataggaaagaatcaagttgtcacgatcaccttcggcagcatgaacaccaaacaaacaagagtagaaaaaaaatgaatttttgtattatttctaacctcttatatcagcgtcaaattggtgaatgcacatttgagccaatcggctcatttgcttagatgaatttcgtggttataaacatcttaataactgaaaagtcaataatgtgacatcctcttgcgaaagcgtaaattagtacgcttccgtcattccgtgtactctacacttcgaccacgtgcaaatcggtcgtcgccgtcgtcgtcacgggagacggtgaccttgacacccgcgccacacgctccggagtccacgggcgagtcggcgacggcgacattgccggactacgggcggcggcgtcaatggcggcggccgcgaggtcgaaacgcgtgctcgatcttatcggggatggcgacctcgacgcggctgcggaggagtcatcgtcgttggctctcgacgtatcggcagcggcggcggcggcggcctccttgggcggcgacggcgcgcaccggcgcagctgcggcagcggcggtgagagggacgcgaggccgaggcggaccttctcctgccctgggctcccccggcacaccgggcacgtggcccgcgacagcagccaaacgtcgacgcaggtggcgtggaagtagtgcttgcacgacggcagcatgcgcacgacggcgccctcgccgagctcgtcgaggcagacggcgcagcagtccgccgccgccttcgcgtccccgcgtccgatcaggccgcatcggccgggcgaggcggtggcggcggcgtggtacgtgaacgtcgggagcacggagacgtcgtcggggccgaggccgaggccgcgctgctgctgctgcccctggagcgcggtgaccgcgtcgggcgccgcgccgggggcggcgtgacgggcggacgaacgggtgtagaagatgacggccaggacgacgatgccgacgatggcgacgaatgcgccgatgcccgtgtactgcagcgtcgacgacgccgagtcgccgggcatggcctgatcgatggccggcggcgtgcctcggagtcagagacgtcgcgtcggcgccggcggagagcggccgcgatgtggcacgcaggggacgtggcgggaaagtggtgggggggggggggggggtttggttgcgcgcgctatatggaggttgggcgcagcatgatttgtgtttgggattcgcgtgcggtggcgatcgagttccgaattgggaggatggcatggcaagcacgtagtgtatagagtggaagtgcgggaacgcggcattttgattctgttgaagtgttggctctagcatttcaaacagaccaaaaaaaaatataatcacttaaaaaactcttgcagaattctttctggcagaatcatttgattgaggttgttggaagttatagaaaagctagattcaagcgtactagtatggtaaaaagtttgtaataacaatttttgtgtacggtgtgtagcttttacattgtatttttagagaggtgtcagagcatcaccaagatattgacagtaattaattttcaaaactattttttttctcctaaactgaatataggaagtgagaaaactaatcttcctaaaattgatttcctacaatgaaaagtggaccctccctttaacaaattagttcttctactcatcctcccgatctcctccccaaaacgcacatcgcgcctggccagctcctcctttatcttgcgattttttctccatgtgcgcatgagagagcggttgggaaaaaaaatcgctcccttaaagtggagaatgagttggatatgatttttgaccaaaacttccttaatttgaggatatgaaatagaataaggaaataatgaaactgttggtcatgctcttacctcaaaaactgatgaaccgaaaatcttgtcttcgcaccagaaaatagtaattcctctccttcatattaaatgtcgtttgatttttttatcaatcaaaattttttagtttgatcaaatttatagaaaaaattagtaacatttatcacaccaaattaggttcattaaattcaacactaaatatattttgataatatatttgttttatattaaaaatagtaatatatttgtttataaacttggtcaaatttaaagaaatttgactaaaaaaatgttaaatgacttataatataaaaatcttcagatagtacgacgtataccacaaggtaaagaaatttgttggaaaaataccattcccgtaacttttgacggttacaaggacaagtggaccaaaaccgtacgtcacggttcgccgttgtcacccaaaggaaaagtggcagaacggaagagatggaaaatgggaaatgaagctgcctccagagtggctaggtgaagtggttacggaaaatcagaatatcacctgctgcagttcaaaccaaatgaaccatgacagccaaaggtggcgggagtgataattttcaaacaaatgtttcgacctatgctatgccaaaggcaaaagacatttcccttcggtacacaagacaatagcatggtagcagttgaatttttctgttccttgtagcctgagcttggccaaaatgggaaaaatgagtatctctagtagtggtggataaatagggggcacgacatggcgcaacccagaccggccttgccatgccgagccacgtgttaatgcctcggctcaggcacgacccagtgaggtaccaaggcgtgccgtgccatgttggcacgggcacataataggcacgtgggcggttcttagaaataagcaacaagatctccattcttggttgtgttgtgcatcctctttagcttagttcccagtctttgatactctctctcttccagtatataagcatttttagagttggacacagttattaagaaagtaggtagaagtgaatggtggagggttctaattagttgagtagtggaggtaggtgggaaaagtgtatggtagagagttatgattggttgggaagaaaatattggtggagaagttgttatattttgggacaaatcttgagagataaaagttgttatattttgggatcccataatataagcatttttagagttggacacagttattttgggacggagggagtagcattttcactacttcacaatgtagatatgttctggtgtcttcaatggttcatccacattgattgaagggcgacttagatgacggtagatatggtcatcatagtactatatatattttcttaaggtcacttttccatatcaatatgctgaagtcttgtgcttcgtggcagggtttaccttatcgcgtgcggttaccgcgcttatcaccggggcacggtaatggtttaccgctgtatggtttagatgaaatttgagcaaattgaaaattcccaaaaaaatcgaaaaactcatggatgtagttcttgatttgtagtggcatatgtttaagaaaatttttcaaagagggcaaaaccaaaaataattaagaaatttgaaaaaagaaaaaatgtattggaattagggcaaatacattgtgaacgattggtgtttgttgagatatgaatatttgtgaaataggtgaaatatggtttgctagtgatgtcgaaaatcagggacggagctagaacgaaatggaggaggttgcctcttgcttaatttaatctactttagatcaagtttaagctgatgcgtgtacctaagtttgtattgaggggtgcacacatagtgaaaatcggtgagttataactaaaaatttcttgaccaggttcctgggcacctcctcccatactctacctccgtccctgcggaaaatggttttgtagagttgatatgttatttgttaggtgagtacatatgctcatgtttagttatgaacatttattgttatgataatgggttattttgttgctcatgtaaaatattgtagtgatgtgcaagtaatgttaatttgtactccatccgtcccagaatataagaagtttagagttggacacggttattaagaaagtggtagaagtgagtggtggagggttgtgattggatgagttagtggaggtaggtgggaaaagtgaatggcggagcgttgtgattggttgggaagagaatgttggtggagaagttgttatattttgggacaaatcctaagcgctaaaagttgttatattttgggacggatggagtagttgttatgctatgaaatgttgaattggtcatgccgaatttttgtattttacacccaaaagttagttagtttgtaattgtcctatatattcttccaattatccccaatttctacacacatttaagggtttattagaattttttctactgactttttaattccatgtgttattgaaataaccttgatgtcgtctagagggggtgaataggtattcccaaaaatgatcacaacttcatagcatattagaatgataagaactttcggttcaaatcggaactttcggtatgggattggaagttctggtcttaaccgaaaagttcggcagataacagaataaaacactagctatgaacttgtagctcgaacaaataaaatatatatgaatcgaaaggtgacaaacaaggtatctaagcaagatataaggtcaccaactatattaattaagcatgcaagtagatcgagtaaaaataagctaagcacaatatgagagatggcaagaacgagcaaaccaagagatgagacatgttgatttgtttcccgaagtttggatccatggattctacgtctccgttgaggggccacaaaggccaggtatattttaaccctttcctcacgaggttgcacacatgtacttctcgatttcactcttgatttcttctcttatggaggcgaaatcgaagccttcacaaactttttgaggcacaccataatcttgggtgctcaccggcgacgcctagccttctaggaaaccttagtccccaagagtaacaattgaagatttgcttgctatgaactcgtgtgctcaaagtatggagtgaaactcactagctcaacttctcaatctctcaatccaactctctccccttctcaaatcccactacaaagaggcaccacaaaggtagggaaatggggaaggctatttagctttggatgtgtctaatattgcccaagaacagtagccactcgaagaagagttagaggagtttatatacccgagcctctcaaaactagctgttggaggccaagactgcaattttcggacaagttcataaatttatagtagccaatctcagtttcgcagccattttcggaatttccaaaatattttcagactttttgatattttttcataatttctgaaaagcatagagtaaaatgaccataaattttcgctcgggagtctgttttttatgatcttggactctatgtaaagctcactcagaggactatcaaactcaacaaaaaaggtctaaatccactcaaaggataggttaaaatttaggtttatctcaaggtagcactaggatagatcactttgagcaccgaaacatacacaaacacatcgacgttccatccctcttaataatacggcattcctatactcaaataaaaataggaagagaattataccaataggaatgccttctttccatcttccttcctttgtcttaagggatgccaacgccaaaaacatttcaccgtatattcttcaaatgattgatgcagttacttgttgcttcaaatggtctcgcacggtccatcatggcaaagctgtcacaggcccttcaccacctgatttggttcttcggcaccaagcccctcgcttgcccttcaccactgcatggtccatcgcgactgcgcatcgcttgcctttcaccgtcttaccatagtagccacttcatatcccacatctgcaatatatttgctttgttattcttgatattttaggtgtaatcatatcacttgagcgtcaacacctttttaatcattggaacctatttttctcattcaactcaatgaaattattagtctcaatgatccggttgtcaacctccacatgttgaccaacttattgcgtgtataaaagaatataaataaataatgagtattaatcaacaccataagtgtcatatactcaaatatatgatcaaatgtaaagatccaattaaatgaaagtgagtaacttggatcaagtacatgcataactaaggtataggatttgctccccctaaatgtatgcatacaaaatatttgtgtgaagcaagagtatgcataaaaagatatgaaacattgagagcttatcctatacaagaatagaagacatttattaaatataggcattaaaattaaagcataccttcatcgtctccatgttctcaatgtaaagaaactaaccaagagaaaatgctcaaacaaaacattagtctcacatgtatattatcattcacatggaaatattagataggaacatatgtgcatagagagaaagagtgatacatatagcttgatctcaatgcatttcatccttgtgatttaggtccactatcaatgctcgtttctatctgaactcatataaagtccgagagtcacctctcagaaattctacttccatatccacatgatactaggcaaagaaatgtttataaaaacattagtctcatattattgaatttatcattaatcaccaaaacaaaattaatggcacttgaacttttagttgcgttacacaaccggtgataaccgcgcagtaaccgctccaaaactgcgaaatcgtcaattttttaattcaaaattttggaggtgaattttacgtggtttttggcggttactgcagtaactgccctaccatgggtggcggtagggcaaccctactacgtggctgatggatgtcgctatccaagtaagccttcaacaccatgagaatctggagttgatgccgaagaattatcgtctcggctcgccaacctactacctcctcctgtttcatttatctatgtggacccgtgatgtgacaggcagtgtgccaatgataccgggctagtgcggtatgatggtggtggtggctgatgattgatgacgataaatccaaagacagataaaatagtacggaatgaaggaattcgtatctctagtgataaattttgataggcacacatattgtgtgtcaaatttaaaaggagtgcatatttggtggctaatagtgaattttgaattccattgtttatatgcttattatttgaatcgtttattagcaaataaaaaattatttgcgagtaaaacttttatataatggtccatatcaactcaaaaccaaaagttctaaaataagctacaatgaaaaaaaatgaaaataagttttaagaccaaaatgagtatcaaccaaacatcgaggcgctttgtggctcaacaaaaggacatcatatgtcctgcgtctcagtgacaacgtccaatgttcggcgcgcgcgcgcgaccacgagtcgccacggcgcgcaggcgtccgcctgcccaatttggcgcggagagaaccggcgcgctttcacactcctcgcgccacatcatcattcgcattcaaactgaaaaaaaaaaaagttcaaatctccctcctcgccgtgagcgcccgaaaaaatttgtcttctccctccctcctcgcctcggggccgcgccgctctgagctccaaatttccccaattttcccccaaaatttccaagattcgccggcgctccggaccaaatcggcgaaaccccaccgatccctccaaatttccttttcattcccccccgtccgggaagaactcgaaatctttcccctctccctcccaaatcccaccacatctcggttacaaatagccatggattcctcgctccctcccattccccaagatctcacacctcctcgcacgctcgctcgccgccgactagtgcctcgccgagcgctcagccacggcgcagcagcaggaggaggaggagtaggagctcccgtgtccgtccgccatggccgtcgtcgaccaccggggcgacaaggagaacgtgccgccgcagtcggccgctgctgccgccgcccgcctccacggcgccgtcgccgtcaagaagctcaagctgaagcggctcggcaaggagcgtaggcgggtaccgctccgggacatcaccaacctcttcctcgccgccaccgccgccgctgactctgcggaggctccgccgcggtggcagccgctggaggggtcgtcggagcgtccggaggcagaattcccgcccccaccggcgccggcgccggcgacggcgacggcgacggcgactgcgcagagctggtcgctggtggcgtggtgttgaagccggggagatgctctctccggaaggagtttagataggtggtggctgcttgtacagtctattctttcttctgattcttctcatttgatttatccaattactcattggattacagagaaaaaaaagttgctccttagattggattgatttgtttcgctactgctaattggtggcagtgaaagatttgttcaggggggaaaattttgtcataaacaaagttcagatttgttatgtttcagcatccgtttctcgcgccgcatttggatccttgataatttgtctatctgtcattcctgagggttgcagcagtgtttttcagccaaaagtctgagctgggaaaatctcctggtatccagttgcactacttgtgtacagcccattggttaagtttgatcatcaaaatggttagtttcttgtgcttgcctctgaacttatgatgaatggccagtttatctggaactgctagtctgatgatgtgcatacaccagtagggatagcctgataatgtagtccactactgtagataaactgtacctcatacacttatccagttactcgttggattactcagaacaaaaagaactagtccttagattggattgtttttgtttcactagggttaatcgatggtagtgaattcagggggaaaaaaatgtcatgaacaaagttcagatttggtatgtcaaagctacatttgaggtaggcttgcaaactgaattctaatgtttgagcacccgtttctcccgctgcatttggatccctgattctttgcttatctgccatttctgaaggttcgagcatggttttcagtctgaagtctgaactggtaaaagcatcttacatcccaatcgttctgtaatactacctgatgctgaagtttgataatcaaaatggctagttgtttgtgtttacctctggacttactgcaaatggctagtttgtctggcagtaattgtctgataatgtgcacatgccagtagatattctgcagaaaggttaagttgagttcagttcactactgtggataactgtacctcatttcatttgagctatccctggacttccttgaactggttgctacaatatctaaaccatttgttgtatcattagaaattatattatcggggaatggtgcttatttaggtcttttcagaacctttaccgatgactcccgctgctatttatgcagaaaattgttatgccaaggatcactgatccggtgaaactaggtgatgtttgtactttgtactatgcaataacgcaagtatctaagaattatgattaagttgacttgtgctccttatacttaactcttgtatttttcattatgaaacaaatctcataccgatgacatattagaagtttgttaatagacattcatttcaataatcttccttcatgaaaaaatgtaaaacagcagtcatgcgctgaattaccactgcataattcttggaatatctgggaaatgttcataagaagaattttcatttgataacctgtgggactaattttccagcttcacgtgtttataaattggtgttgctttgaatgctgtcccagtcccgaggaattcacctttcaatatagtcatctatgacaaagtacaatttgcacactaatgtatttagctgctaaaaatcatagtggctcggtggctggcttgctacacctggatcaactacatacacaggtagcctaagtccagttttagttgacattgatgacaaactgcattgtttctaaaatagttctatccatatactaaaaatccatatgttttacatgataatactatgatttgtatacagtagaaaatttcaagccatccctttgtcatagttgcaaaattcctcactactgttctggcttcctgtattgaattattgaatatcatctttcagaatgataggattgaagtgattgaaccaaggcgaaagcataaagtggggatattgtttgttgaggaggcatttttgtttgaagctgcatcaactgattttctttgaaaacagcctatgtgtacacttctggtctgaaccattcttcctcacagcaacaggtgttagtaataccggtgagtgtattgaaacatggttgatttcaagaattaatacctatctacaaaatcattatagctaagcaaggtgatcactactctttggtcttagatggtatatcatgatgttatttgacgtcttttaattcaaaatgggtgatttggaacatcttttcgtcaactgaatttcgctgtcaaaccatgtcttcttagggcactgatacttctaatctgtgaagcttatttgcatcaagatatgtctgaatgtgactactgttgtattcactgacctttgatgaaagctgttcatttgttcatccttgccccagagcttgtctttctagttggctaagtacgatatattgtcccttgtcataggtgcagaaatatgtgtactcatcaacagagcatatcacagttgatttttgagaaaatggaaacaaagttttccattgagatacaggattcatacaatatcttcattgttattctggatactaattaaaaccatcttatgtgtctttgggtgttaagataatgtttcttttagctttgacaaatacttgagatcttcaggattcaccttacagtgcccttgtttccagacttcccatagacgtagctcagtatcagtttatctgaaattgaaagtctctcacaaagtaaactgaacattttatttaacaaagtagactgaacataaaacataggtgtgctattaattaccatttgcatgtgcaagtttctgcatatgaatgtgttttcttactatatttctttctcttttttaggatagtgttcatgatgcacttctagtcttactaggaaaccaccgctagaacttcaatatgtaaacttcaaaagcagataccaccttacatgcttagtgggtttaggcttcaacttccacctgccaagattacaatttttgttttgcggcgaagcgattcactgactagcaatttggatgatgaactcatttataaattctttagtctttggcttttcagttatgtcccattcattcgtttcagttggaatccagatcagagtgtccatagcactgaatcagtatcaagcacaaagttatataaagaagttcatatctatcatttcatttctacttgtgatg

SEQ ID NO: 67194 - DNA, 721 bp, Oryza sativa
tggaacccctctttttaattagtaccataccgtgaatttttattgtgttgaagccacataaaagagggcgtatctcaatcttagctgcctggtctggtagtgcggacttgtaaccccatgctttggggggcatggagttggcaattgtgctagtcgtttcctagtaacaaccaaatctaaaagtcccttaataagggagacaccctcattttaagggagcctgcaagggttcgaccccacacaaagtaaaaaatgtgctggcgtcgtaaatggtttggaattgtggcagcaagtcagcccgcccaaactggatttcggcctcctagctagagaaaacgtacccagcctcttgtcaactccacatttttttcttctctctgtcattcataaacttcttgggtttttttaatgtcttcaccagcaagctaacccgctcaatatgtcattcataaacttcttgggtttttttaatgccttcaccagctagctaacccgctcaagaaaatatcaactccacattttttccttctctctgtcatttataaacttcttgggtttttttaatgtcttcaccagcaagctaacccgctcaagaaaatgtcaactccacattttttccttctctctgtcatttataaatttcttgggtttttttaatgtcttcaccagcaagctaacccgctcaatatgtcattcataaactttgtgggtttttttaatg

SEQ ID NO: 67195 - DNA, 930 bp, Oryza sativa
tgatggagatgtggaggtggcgaaaccggagcctacccgcgttgtcggagttggcggcgcaaggattgtcgatgtagagccatttctgcatccaatgccaatcctacttcggtatggacgtagggaccggccatgagtccgaccgctctggtcggaggttgaagttcacactgccgaagacagacttcttcggcccagcgggtgtgtgcacatctttcgtcgatgcactggcggtgaagaggagggcgaagagctccactataggagcgaacccggtcgttcggcacatctaagcgaagacggagagctttgcgatggccaaagggctgagttgcggaagcctcgcctcatacatctccaggacggagggcaagaaattgtcgcacggcagccagaagtccacgtcgaagaaggaggcaaagaccacggttcgcccgtcgcctggcgctaggacgatgtcattgctaggttgagaggcatggccttcggcagttaccccaacaagaaccattgcggctacatcggagtcgttaacctttgacttgcccaggtagcaagtccagttgttgccaaggctcccggggccatcgtcaatcgcaccatcttgggtaggtttgcgtggggccattttcatccgtggtgaaggagaaagcaccaagcgagtacaaaggcgaaaggcttaatgggggagaaggacaaactcacgagagcgaaaagcacaagatgcatgagagtgagggtgactgaaagcaactgtggtaaaaaagtgagaggtgtaaaggtcaaagcgatccgtcgggggggggggaggggtggttgtagcccgatgaagcgacgcttcgccttccacccaatcctagcccgccacgtgtcacaaggggggtagatgaaacggtaaattcccattggatcaggccacacagtataagg

SEQ ID NO: 67196 - DNA, 6805 bp, Oryza sativa
cattcttacaccacctcctcgtgattacagttctaccaacattaattaattaatttgagaagcaatcagcattaatcaaagcgaaggggtcaggttaaaattatactctcttgagttgcccactttcggtggtcggcaaccttttacccgtgcactagcttgagtgtgaagcgcacacgtccggtactgtacgaatccgtattatatccatacgacgaaaaacacatctatcctcgtacacatatacagaggcgggattacgattttaaagtatcgtgttcaaaatataaaaggttaaagaggattttatagctaaaagctgacgtgcataatatatatactaatggtataacatatttataacatatagtatacgaatactatactaattgcatatagtatatactctctccattctagaatataaccatttttagagttgaagaccgttattaaaaagatagatagaattaaatagatgagagttgtgattgaatgagaagttgaggtaggtgaaaaatttgtacagtgaaggattgtgattggttgagaagaaaatattgatgtagaagttgttatattttaagacaaattctagaggctgaaagttgttatattttaggtcggagggagtaagttttatatgaaattcttacatattcatctgaatactcttgagctggacctgacatatgaaatcctcaactgaagtttggtctctgttaagtctgcggctcaggcactcactcgctgggcaggcaagaataattgtcgttttgttaccctctcaaatatggtgccaagtgccaacgacatttaaatggatcgtgttcttttcccattttaccaacaaacctctctcgttttccgcgcgtatgttttttaaactgataaatgatgctatttatgaaaaaccttctatataaaagttgtttaaaaaatcatattaatatttaaaaaaaagttaatacttaattaatcatgcaataatatgagcttcgttttgcgtgccggggagaagggttccaaagaatctactccctccgttccataatataagacacatctattatttttttatgttccataatataaggcatgcctgcatgcatacaattaattatgacatcttcatattaaattattacttttttaaaattctccaccctcaatatctctaattctattggatgtatttattatatttattagggtggtctaaactaggaggtgataataattatttcttgatatttaggttaagactgattgtgccttatattttctaatggagggagaagaacaaatggtttggttcgagtggtgctacactcagactaggtagactggtagtcaaatgtcttttattttactcatggcaacgtgattggaaaaaaaaatacaacttgctggctacaatatatgttactctgttattagtactggtcagtaataagggaagttctatcatcatttatctattttttaaaaataataattatatgccttatgacttatatatggtgccattactgcatacaatcgccggatgcggtaaggttacatagtttttttttttgtaaaaaaaaaagaagcccataggtccggcttctattgaaagaccaggggaaagttttgggtgcagccccagacattacagtacagaggcaacgcctcaaaagattacaagaagttcaataaattttgtacaaatttttcaaccgctcaacggggtaactacacagttaccgcctgggtagggtcgataccactacaccaagcttacgatgccaataatataaaccatttctgttatcttaaatataggaaaaactataaatcgagcttctgatttttctaaaacaaaaaccagattttatttgaccatcggttaaacattaaattatacgtgataaaaaaatcaaataaacatttaattatttttcaagtgaagacacatgttaaaacatgttattaaatgaaacaatgaaatatatgattttccatcaaaatataaaagatttaatcaaaataaatataatgatgtgattggattatacatcatataagcagtttaaaaaaaatatttaaagtgagaaggaataaggagaagctagcttagctgcagccttgcatgcatgtaagtattagtctttactcgcctcttgattccgtggggagcaaagccgattccggcgccggcgccgtcgacgccaccaccacgaggttcgtcgcggtcggtggcctgtagaacggcaccacctcgaaccgcgtgtagcacgtcagcgagtaggcacgccctcctctcgtcctgcaccgcaaccatgtccatgcaagcttaggttgtatttggtcgggctatggcttttaaaaaattagctgtagactgtagcattttaaaaagtaactatgaaatatgggctgtgatttttgaaaaagctcatttgaggatgcccaccccagcattgcagtctcaatgtcaatccttacatgggcagcgacgccgcgatgctctggaggcagcggcggcagtcgtccggcgagaggtcgtcgacgcactgcacgaacgcgtagaggctgtcgccgccgtcgccggtgatgttcgtctgcccgaacgcgaaccgccggccacgggaagacgacgacgacgacgcggcggcgagcgcgaggcggtccatgagccggctgagcgcggcgccgaactgggcggcgtcgccggcgctcgtcatgttggggttgtagacgagaactcctgggccatgtccggccgcgccaggaacggcgcgccgccggcgtaccggagcaggcagttgttgtacagcatggcgccgcccacggcgcgcgggcaggcgagcgacaggttgcccgccgccatggccaggcagagccggcacacctccggcggcgcgtcggcgtagcagatggcgaggccgtgcgcggcgccgccggcgtcgttggccaccgcgtatccaccgccggacaccgcggcgtcgacgacgtccttcagcacgccgcggaggctcgtgccgtaggcgctcccggcggtgtagttctgcggcgagcactccgaccacacctgcaccgtctgcgcgaacgccggtggcgtggtgcgcgcgacgcagacgacggcgacgacgatggcgaggagcacggcgaggttggaatccatggcggtcgctgtgtgcaaagcgagtggcactagctctagctatatagcagtctagcacctctttagctatggagtagaatggagtattagatgtagttgatgatattataagtcgtttgacttttttaagttaaactttgttaagtttgattaaatttattgaaaaatttagcaatacctaaaatatcaaattaatttttattaaatctaatattaaatatatttcgataatatgtttgttttgggttaaaaatactattatatttttatataaacttgatcaacattaaaaaagttttattaagaaaaaagtaaaacgacttataatatgaaatggagtatgttattgtgcaccgactctgttttaacatggaccattaataaatttttaaggaaaacttagtgcttacatttataatacaacaacgtttaatttataagctctgataaaatagacaaatgataataaaattttaaatatgaatagcagtatagcactcccctataaaaaaaaaagaaagcagtatagcacccagtgacaagtatataatggaaagaatatgcacaactttttcttcctatatttgacagcacaatgcatccaactgtctttcaagtatataatggaaagaatatgcacaaactttttcttcctatatatgacagcacaatgcatccaactgtcttttagccaataactttatgccaaacttgttttgtgaatcatgtgttatacaatgctattctatatctttaaacaccagctgacaatttttacagtaagtagctagttatatatattatcgtacctgctttgtaagagaaggtgatgagagagaaaaagttagcaattcctaaacagtcgccaggcacaaaatcatcccaatacagcatgatgaatccaacagcctgctagccaataactttggcatactcaaatagtgaatcatgtgatcaagcctactccattcgtctcatattggaagagattatatcctcaaaaattaataaaagtgattttataattctaagacggtactttattcttcacctaccacctttgtaactaatttattccttcatatgatgttttttactaattaatttctccaatcatcactttcgtattgtcttttttcctttcgccactttcttattttttgcaaaaaaaaaagtataatcccttatatcttaggacggaagaagtataagtcaacgttagatcgttagtaatatatgacgtgaaaattttttgtaaccaacagtactactattgtgttttgataccatagatataacttcttgactttaagtgtactttctgtctacaccctaagtaaaaaaaaagcctaattgtagctataaacctgcatgtgtaaaaatctaatcttagctatgaagctgaatatgtgctcacattatttataattagaattggattttttttatgtaaggagtacatgtgagcaattaattagtgctgggctctccagtaatcattcatattaagaacattaataaagtggaatcctaggaatacttaggactggggtcagcgaggcccatgtgtcaatgaatactaacttaattctctgagacagtctcctgtcgaccaatagcaagcatgccgtctttgaccagacaagatgcaggtctcgtcaagagtcattttatctctggcagtttgctcatcattttttacttggctgtgtttagatctaaagtttggatctaaacttcagtcctttttcatcacatcaacctgtcatacatataatttttttagtcacattatatccaattttaaccaaaatctaaattttacgctgagctaaacgcaacccatttgtttcaatggagtgtgtacatgcaggaccaagaaccagctactgatcatttcaatgggccgacaaccagtcacagcagcagcaacgatacgtcatatattttagacgaagagtagtataataagtagaactggagtattccgctgccaatgaaatgaagtttattttatagcaagaatggatttatagggtggtcctcagaccacgcaaaaaattcgccaacccatatactaaatataggaatttaggaaaaaaaaaagaactctaacacatgaacacagcctagaaaatgaggtttagagtgcatccaatgaacatgcacttgtttccaatactccctccttcccaaatgttagacttatttcatattttaattttttttcaaatatgttaaccatatttgtagttttcatttatctaaaacttaaacgaggagataaattaaatgtttaatcggaacctgaagagtcatcttaacccttattagttgtctctttttaatctttattacatgccagatgtgttaatttctcctttgtcttggtgataaaattaatatgtttaactcttttggtgaaaggagtactacctatgagcccattaagaattatttttcaaatagaagaaagtataagagaacaagattatctaggaagattagtaaaacaagatatttagtcgatacattacaaaaaattacttttactaatcatccctcctcctcgatcaaccagccaagattcctgtccaaattaaaatgctataaccagttacttcctccaatctgcaatgcaattaacagaaacatacaacgattgtaatgacagtccaaatccacgtgcatttactcaacttcctgtacattttcatgaacattatattgtacttccctacgaactaaatagattcccccaacttccatgtacattttcaggtacattgtactgagaataagtctaagaaatccacgggagcaatccccttctataattgcatcgaaaattcttccttgaaaatgaatggcacaacagaggtactgagaaagaagtctaagaaatccacaggagcctagcaatcccttcttctataatggtagcagaattcttcctcgagatcgactttttactatattagaccagtgttacctcatcaaactcgagtggcttcggccacatgcccacatcctcaccaactccacctgctatgaaatcctaggaagatgagaggagaggaaagaaggcctgaaccctagatcccaaacagggaggggcgacggtaatggcttgccagaggaggaggagaaaaggctagggctggtgagaagggaggctcaatggtatcttgagtatcttgagcgagggaaattcccctctgtaaacatggtttggttcccaaggatcccacatgaaacgggtttggaatacctcatcccgtgggctttcaattggataagagaattggcccataaaattttctcgttggtcttttcttcgggaaatgggtcagaatctcaacagaattcaggctactaaatgagacatattgtggtataaaacttttctcccttgatcgatctcctccaagctctcttaaccgaacaagtagagacggggatcagctagtcccatatactccctccgtcccatataaaaccaacctaataccggatgtgacatatcctaatactacgaatctggacatacatatgtccagattcatcgtactagaatatgtcacatccgatcgtagatttattttttatgggacagagggggtataaggtggtgtt

SEQ ID NO: 67197 - DNA, 11202 bp, Oryza sativa
tgatcatgttgcaattaaagtatttactagctaatgaaaaatgcagtgctgtgttgtttaataagtaacagcaagaactcaagaagactttgctatctgttaaattatattgagcaagacaactttctttgacaaaaaggaaaaacatatttgaaaccaattttttatgcaatgcacgtttgtgaaaaccaaacactgcaaggttcgtcggtgcactaattctcaacgaaatcgacgttctccgatggattatgacgatggcagcgcctgttgccatgtctctgtcacaaaacagaacaagaccactgttggcattcagatcttgctatttgagtcagctagtgcaaactcagtatctgttgcaatccagtgtacttaactgctgaagattccatgtctgaaagggatgttgggagggaaacaaacatcagtaaaaggtgatgttaggtaacaaggttcttttacttcaccgtttgctttcagaatgattcatttcctttaagaatcatgcaagtgtattaatgatccatcattgtctagatcgaaaggaatacgatcaaattgtttggccgagaacgttgaagaggaacagcaactttcaattagtttggtgcatgcaagaatccagaaatgagcaattagcatctcaaacttttttcagatgaatcggcatctcaataacagtaatgcaactgaaaaatacttgcaaaaatggcgcctcctgttccagttcatgaattcaaggccatcacaagcaaatcattccttgtgttttggaccagccagacaagtgtaaacttatcttctgttggagaaaagaagattgcacctaaaaaaatccagggatccgtacactgataacgtcagaaacttgtattttgtttgatcaaaaatgcatgattagctggaacacaactgatgtttacacatctatggtcatcaactggatgctatttatgtgctgggtgcttgtctggttctttcgtcaagggtcctcaagtggccttaaggtcctatgcaaagccagcaatcttttgccccttgggtgtcatggaaagagatgccctctgcactgcaggtcgtcttgctgctccaaatcagtctaatgtatggacagtttgatttgaggaatccaaaccatcttgggtgaattggtccatcatgggattatatcatgagattttgatggtgtgaatattcattattgttccactaagaatatgtgttaagaaataacatggtgtttttgtaagaagttaaaaacaaagatagatagatagatatatttatgcttttttttcgttgatggtagttgtgcaagatgccgcaggcaacatgtattgttcatgatgtctagttttttttcctttttttttgttttcttttttacggctgtatgcatccttagttgttgctaagccaaatatttccattacttaatgtaatgagatattccattataaaaaaaaggagatagtatgatgacgagtcaaaccatctattaacttattaaaggaatagaaaaaaaagcatccacgttctctctcatgccctagaaattctcatattaatcggagaaaaaaaatcagagttcatacgggaatacaatttaaaaatagctgaaattcagaattaaaaataaggaatatagggagagaatactagagcccatagcggtatacaatagaactaatggaaattcgaaattaaaaaaagaaaattaaaagtagagattagaatccatatagaaatacaatttagaaataacgaaaattcaaaataaaaaaaaggaatattggaagaataatatagagtccatatagaaatacaatttaaaaataattaaaattaggaattattaaaaaagaatattgaaacataagtttagagttcatatagaaatacaatttagaaataatagaaattaaaaattaaaataaggaatattggaagaagagtatagagttaattcagaataaaaaaaattaaaagtagagtttagagtacatatagaaatacaatttacagatatctaaattagaaattaaaaaaaggaatattggaacaatagtctagagtccatgtaggaatacaatttagaagtaactgaaattcgaaattgaaacataaataatattgaaagatgagtttagagtccatataaaaatacaattagaaatagtgaaaatccataattaaaaaaataagcaatattagaagaagagtctagagtctatatagaaatacaatttataaataacggaaattcggaattgaaaaataagaaatattggaaggggagtctagagttcatataggagtataatttagaaataactgaacttttgaatttaaaataagaaatataggaataaaatttgtaaataatagaaattcataattaaaaataaagaattttggaagaggaatctagagtccatatagaaatataatttggaaataactaaaattcggtattaaaaaataattaataactatcacgtttatacaacactatgaatattacacatgattgatagtttggtcaagttagtataaaaattaaattatgttattattttaatatattttaataactagaaaaaaattctcgtgtgttacaatgagtgaaggctattttattgttatattgcttagtgaaggtgaaattcacagtggcaattcgtttggatgcatttttttttaaaaaaatcatgagttgcggttagaagtctgatcatttcaaattagcatgcgagttttttaaagagatttctcatacgacttcttttgtatttccataaacgaacgaacttaaaaactgactcaaatacggacatgtatttccaaaagcgaacgaacttaaaaaccgactcataaacggatgacgtaacaaaataccgacaaaaaaatcttcaatttttataataatagagataaaataagaaaaaatgtgctattatatgagacaaaacataaatatgctagccgcgcaatttgcgcaggccaccatgctagttctacttatagcaataaggatcatttcctacttgtgagaatattaattccttgtattcttaccttttatgttgataatttaggatttatgcataaacaacaaattaaatttgtatagaaaccactgtaaacatggcgaattattttgtgaacatatatttgttcatatataatatgatcataaatttatcctagcttcagaactaggacgaacaatgtcaaaacactaattctctgattcaaacattaatttatcatagattcctctagctacttaaattactttacaggttgtaaattcttgaacatcaagtagtcatcatggtgccatctaaacaaccaagcaccacaaacatagaatctattgtggcataaaatagatgaaagcacaaacttgagctatctagaagaagtgcgtggttgcatgaagactacagtctatattacaaaaccaactgcgtcattccaattaaatgtcccctttttgaagtataaaaaaaaaggtactacgaagaaacttgatgtcgaattaacagaaaacttaaaatatataggatctaagctgggcctaaaaggacatgaacttggatagtggtctccagtttatagggtccaatttttaaagcatggcgggaaacgaccttgcaagcatcattgtaagtatgcactgtcccttcttacttttttggagaggggaccagccctacaaaccgtatatatatagggggtgtttacatcacaccccaaaattttacaccttgtcacatcgaatgtttaaacatctgtatgaagtattaaatataggctaacaaaataactaattgcacagtttgcgactaatatgtaagatgaattttttaagcctaattgctacatgacttgacaatatggtgttacagtaaacatttgttaatgacggattaattaggcttaataaattcgtctcgcagtttgctgacggattctgtaattagtttttttattagtgcccacatgcgacaccctatataatatccgatgtgacacgccaaaacttaatttgcacccttgaatctaaacaccccatatatttatgtgatgtaaactatagaacagaagcttaggcagacgacataataacatataatatgtctgcacgttgatccaattggactcaagttaattaattaatttgtgcatgacggacgatgccctttctcacaataaattaattaaacgtataaggcagaaccgcagcagcttaacaaaactattacttcctccatatatagtcgcaaccaccactaacaaaccaaaaaatatttattatcacattctcgtttgcatcactccaataacatccaatgaaagtagtgatcttgatggaggattaaaaaataaattaaatgagaggggagaagctataattgtatgcatgtatgtgcgtattatattatgaaactataaaaaaaatggttgtgccttatgctgggatggagagagtaactcacacccgtgctaattttttttaagaaaactagctagaatatgcttattgagagacaccaaagtcttttctcctcaatcatataatatcaaacaacctagaaatacttgtattttgcaacaaaaatatgtgaaaatatgttttgaccgtttgcaatgatcatttctgtagtagaggttgattctatgcttactggaacatgtagatttctaatctacttaacatgatatgcttagcctaaacatgatcaccctaagaagttaaggaatttagggttactagccagtcttatgaaaccatggatgcgcaatttgtgtgatctcctctgtgatgtcgagatctagagtggaagtggaggactgtccttcgaaccactctggagcttggtgtaggcaaagtagtcgtagtagtggtggagttgtggtcaccggcttgatcgtcgtggatcagctgcaaggtggtggtgttctggtcgtcatctacattgctctgggacagttgtgtgttctcctttcaacgtctaagtgatgggatcagaggttttagggttttagggtttcagagagaagataattatgaaatgatagggtcagtggttttaggttttagggtttcaccggtctcccctattttatggcgctgaggaagactaggggcaataaaaaattaaatttttttatgctatcgatcacatgtagcctaatggttacaagagcctgagtagcaggtcctgggtttgattccacgtgggagcgaattttccaggatctttcaatggaaggcgacgtacatccgtcaatagcgaggcgcatgtggtgacttcgtcaatctacaggatgaattctaaaaaaaatacgcataatgtgtaattacagaaattaacactaggtgaattaatcacgttgatagtgcatgcaacggatgggaataaccgtgcgcgatccatgccgagaggtcaaaatttcccaacagaacgacccctagtaatatgttcacttgccaacaatgtgtttgttgaccaacattcagcatgacaaggcccttggtgggggcaagcttggcttcaactaaccaaactaacacgtagcttatattagttgtaattggaatcttggtcgttaagccagctcaagctatcgactaaagtcgagtaacttttgttaaatattccgatcgcgattgggacgtacacacagatcagctgagatcaagacgatgattagtcagcgggctcggctgcagcttgctgttggtaactccattactgggattcagtgcgactttggtcaagtgataaatatatatatacacatctccattctgctatatctatgttcagaaaattcaggcacttgatttctgcgtccaatgccgttcgagcacgatagaaatcgaaatcaatcaaatcaaatgcacgatctgggagagacctagctatctactaagtactaactaactagagattgatgaaggtttgagtactacatgcaatttgaattcagttagtgcattcgtggtaccagcaacctgttatctgaatatattgtagtacgggccggcaatagaacgcaaacctaactatacttttcggatcaggcatggcccaggattattggtccttctggttgttaggtttcgatcgctagctaactgttgtattgtccgcagtatgtgtcaaccgccatgcatcttgctttgtttacattagcgcccaaagtgctgcatctttgattatgtgtgcacgtacaaaagtcacaaaaagtgtttagtttcaaagaaaaggctagcatttcttttgttgtatataaacgctgtgggctatagactagctagttcgtatactgtgagtaacactacgctggaacaggtcaccagtgatgagcccaaaccatcatctccaacaggcaagaccctcgtcagagattagtaattagcagtgactttatgatcttatctgacggatgaaggtcaatggtgaccaacacctgatgggtaaaagaaaactatcactgctgactaatacctgtgacagaaaaaaaaaacccatcagaggcgagcctgaccatattgaattgatgatgttgtcacccatcacaaatactcatctacgaggggttaggttttttgacatcttagctcaattacgataagacctgtgtggttcatgagagttgtgtatgcatgtttagtaccaggcggaaccgatttttaagggcttgtccttccaatcataccactctcgggttaaccctttataaagtgatgatgaaagtataagtagggtagtatgtgtaagtgggcccgtccatcagatgagttgggctatgtggttctagaggaagagttgttatagttttgaccctcgccaccacccgtcattgtttgtaaatctctggcaaaagaaaaaaaatcacgtgcattgctagttaacaactcattcaccattcacaagaaaatctaaagccaaaaatattacagggaatcaagtgttggatctgcattcacactgcatttcacagagttgaaaaaaaatcatgtgttgataaaaatcatcgatgagctgaatactggtggcagtgatcgtggtcttcgctgttgccgtagtcttcaccaagttgaacggcgagcttggtcctgcgacgaccatagtgagcgagagcccgagcttaggtggaggagacaaggggccagtggagaggcggccgcctacactctggtgtgaaggagacgaggagatagcggccagagctcgaggggaagagatgacgacagggatggcaagcgatgaccttgggggaggaggcagagagcataagggcgttcagaacccgttgtcccctacaccaggaggttggatcttgtgtcctagagctcgggccgatcgagaggtgggcgctagcgctcagggtgaggaaggcagaggaggtgctatggggcagaatagagaactaccaacattggattgcgccaccacgaggtagggggtgatcagatccaatgtcccttgatcttggggaggctggatctagcgccctagggttcggcgacgatgacaacgaggatggtgatgacagactcttggggatggaagcgatggcagtggttgctccatggtacgcaaacgacaacgaaaatgacgccgagtgctcgggggcatagggggtgttgggtgcttgaggatggagtcggagaatatggcggtgaatgctctaggttcggtggtcgatgcgcctgatgagagagagagagaagaggacaagaaatttgcagtgtgtcatgctggctataggtagaggacagaaaaggagatggtcctgtggtcatctatgggatagaaaagatggaggcattaaagatgagtcatagtcatctttgactattgcacattttgtacctatcacaggtgagaggtcacctccgacggacctatgtgtgggcccgtcagaggtgagttgtgctgggtgcatataagtagcctgtcgcagatgatatcttatttgtgataggctacgccctacaaccttatctacaatgggctctattatggcttgttgtagatgaggtcctttgtgacaagacacttcagcccatagagatgggatgtcagagatgtgatggtctggagtagtgaaatgtgtagagttcatgtagggagagtgctgaacaacgagaaagacaaattagacaacaatgacaaagaagctgtctcttcaataaaaccacactaacccgatcgagatggccgaaaaacactagacatcataatttatttatggggatgcgcgtgcgcgcgcgcacacacatacacacacctaaggagcctaatatataacaggtggttctatttgtcagtttcttagttctctcttatcaatcgattaaccactttgatagtttgatgtttcatttataggagtggaaatggaaaaggatcatctctatgtcaacatcaaaaagaactcttgctgaatagtatggcttgctctgaaatcggtgtatccaacttcatgaaccaaccctaatgatgttcacctctctcatgctccttttctcctagtggcgtagctaggaatttttccttaggtagtcctagttcacaagttcacatcacatactaaaatttatgaacaccacataaatcctagatacaactacaaatttgattagaatgcgataaaaatgtagcaatagtcttaaatgcaactaacttattaacaaataacaagttcaaatgtgcaaatattacaagatagatagttcaattgttcacataaaaaaaatcttacatagaaatacaaaatgacagtgctgttaccatactctatgcttgctcttagccatgaaaattttaattatgtcttcttcactaactttggagaagatatctcgctcagtatatatgactaagcagtggttcaataaatcatcacatatattgtttctcaactttgtcttcactagactcagtatagaaaataccccgtcaatacttatagatgccaccagtaagatcaattccaatttaagaagcaaatacaaaaactcataaagaatatggttgtttgtctaaaaaaaaaagcctaatagagagctcaccaagtgtttgtataccttcaaatctgtaatctttcctcacatcatcaatagaagtgtcaatttggaattcaagtcttctcaagtccgagcttgaaaagtcattgggataaaacttcacaagcctaagtatcttttgtgcttcataggaggcaaatcttttcttgatttggaagaaaactgatggttttatctccttcctaattagtatcggcgatataccgataaaatcaaccaacaatatacaaactttaaacgttacgtgcactgttcaccatcgtatttgccatttcatagagtggtgaatgtcgacaaactttgtagtgtcaaattcttttcagattctctatgactattttcattagataaatatcataggaaccgagaaaacaagttatttttatataagacatggtacctcctaccacctactacctagaggctggaaagctctgtgcaccaaaaaagcacatgaacatagtatgcatagtgttagattgacataattaagaatattgtatatttttcaggacaataaaatcacttaatgccttgcattgtgttagatagacatatttgaggcataaaatggtgggcttgctacctggtgcagacactccagctccgttgctggcacacatgcccgtcagagctggcgcgtcttgccaagtcgacgcgtcttttatttcatgatttttcctttgcaatttttttaggtttttttgcacactctttttatttttttcttttttttcgtgattttttaatgcagtttagaatttaaatctttcatctcaaatttcataacattatattaaaaactttcaactcaaatttaaaaaattcatataaaaagtcaaaactcccaacttaaaatttaaaatgctttcaagtcaaaattcaaggaataaatcttgagttgaaaattttcaatataagttaaagattttctaatctgagttgaaagttttgaattttgacttaaaagttttcaaatcattttcaatcctgagttgaaactttttaaatttcaagttaaaagttttcaaatctcgcgttgaaagttttaattttttactagaaagtttactcgaattttcaaaatttaaattaatctaatatacttatatactctctctctgtcccataatataagtgattttgacattttgcttgtaccgtttgaccattcatcttattaaaaaaattagaattattatttattttatttgtgacttacttttttatccaaagtactttaaacacaatttttcgttttttatatttgcacaattttttttaaataagacgagtggtcaaacagtacaagaaaaatgtcaaaatctcttatattaggggacggaggaagtatataaaaggataagttggaaaaaaatatccagtgtggaggcccactaaagctagaaaaaaaaatatcatgtggaaaaaagacacgtgtgagagaaaaagaaaaggaaagagagtgggagagaaaaaaatgtgaaggaaaaaccggaaaacgaaagaaaaggaagtgcgtgaagccgtgaagccctggagaccatgcacgatttgagttcctcgcgcgtacacgctatctcgtaatatggctggtggtaatcaaactcctgtcattgatcagctagatgaagattaagctagctaggtaacactgctaagtgctaatccatgacagacagatgggtggcctgtagtcaaagagatcatcttcacattagacgcgcataattacacatttgagttgagatggaaacgaaagatgaaaggatttgacgtgggaaattaaaacgcctatatttttaaacatgaaaccgcgatggaaaaataaaaaacatatatatgcattcgtcatgcctaaagcaaatattaatatgtataataaacatcaaaatttcgcttttctttaatgttttgtaatgcgcgatgagttgcaaaagcgtgcagatgactgtgtggattacgttgaaacgtgagagatatacatgaattgggagtggattacgttgaatcatacgtatcatccgatcctgcatgcgttgactagggttccaacgaatcatctaccaacacatgcacaattcgtg

SEQ ID NO: 67198 - DNA, 28490 bp, Oryza sativa
gggatgtctcagtggacagagttatcatacttctgttgcctaaaattataagttctctcttcttggttggaaataaaacgagcatttttttctagcaggactacaccagtgacaaatgctacaaattcgggcatagatttgatgcatttatcttggagcatgtaagaaacaacacttctcacttttgtttatttctcttctccacataagcttatagccggtttatagcccactactatatatccttccccttgatacttttttttggcggggaaccttccacttaatatttaacactacacaaatgcattttttctccattttgcccttgtggctgcacagagaaggatctagaactatcttgggtgccaaaaagttacactagtgctaatccagtactatcatagttaccaaggaatacaatagtatcatctggatcaatacttttctcacaagaggtttgttagtaggggtaatttgaaggttgttcttgttcactttgatgcctaaatcaatcttaccaaatgttggcattgctaatatttggtaattaaagttgagaagtgtaaaagttgttgtttagtttgttaccattgtcaagatgttgtgagaggaagattctagaattaccaaaatttggtaatggaggcaagttttggtaatgtttagatttataccttgccaattttttgtaaagccaaaacttggtaacaagggcctgttcactttgatgtcattttcaaccttactaaattttggtaaagttgctaaaaaagttgctacatttagtttgctgccaaattttggtaactatataagaaatcatgccaaaattttggcaaattttggcaggtaaggttttttttggcatcaaagtgaacaggttgcaaatctccttggtctttatcttgtcaaaattcgattgcctaagtatgtgtgcattggtcaaaagtgtcaagtaaatgtaaacggagggagtatatacattaagctatgtgaacaaaggaatgttgccacttctgcataaattttgcatatatttacaaacagatagcttgtcaatttgagatatatcacaagtatttgaatcactgatgcagcagcaccttcatgctctcttttaaggcaaatcctgtacttaatcacatttttttctgccgttatttgcttggacaacattgtgattgtttttgaagattatgtttgtgtggtgattggtgaagaaagaaaggtttgcatttgatctcacccttatttcttaaaaactggacattaggtctctgaagctgaagcagtgttctgattcttgagcagggattttggtattctttaccaaaagaggaaaggagattcttcatttttgttctcagtactgattcttgaggcgggattttggtattctttaccaaaagaggaaagtagattcttcatttttgttctcaatactgaattactgattcttgaagcgggattttggtgtcctttgccaaaagaggataggagattcttcatttttgttaagctgccaatatgacgactgaagagtagagcattaacttctctggctaaaaaagtgaggccaacaattttgaattgtatattgttgtaagttgtaactgttgtcactgtcgtaaatggtctgttcagcgttgtacggacgtaacgtatatttgtcaattgtgtagtctgtctacgatgctgatacgatgattacttcgatggttcatccatatgttgaagtgttcattcttttaaagtttcttcgctgaatgaaagggtcttcgtctatgccattcaattattaacaattgctatatatcatcagtcatactcttgtcaaaccataagtttaaactttaaagtacgtcattatagtgagagtaagatggggacagggggagtagaataattggaaatttgggagaggaaggattcgtgggcagctgaatccgatgggcatttggtgttaatccaatttccgagcaaacaagcagatagtaaaacataaaagcacacagcaccagtcgagattgcgtaataagaacagtcgagattatggagtggtgtgtgatcatgtagatacaagactggacacagtaattacttggcaacggcaaaacatatacttagtctctttccctaaccattcattatacatgtagaagaacactctgcgtaattccatcagatttgcaaatggctattccaaaacaaaacagcatagtgtaagtctgtgactaactggcaaaaccattttccggacatttcggcagttactctagctgcagcacctggctcctcaaatcatgcattcctcaggtatagtggtccctggctacaagtcatcctagtattcattgtaggagaacaatcaaggcctggataacacacatgaacataaaaaaaaatgcagagcttattctgtgaaaccagttaatacaaacaaaactagttattttgacttcttctgatcaggtgctcttgatcctataatgctacagatgggttgttccggtgactgaagcaacctcagagctgggtgaactttgagatcacgcatcaacagtttctgtccgacatccaactcacttaaatccacctcaatgtatggtggcactatgtcagcagggcacagatacttgacagttcgttttatggtgttgaagtaagcccctgtagtttcaaagacagtcacattataatgcttttaaacagaaccttgatgaaaagaaaaggctcacgcatgaataatgacttggaataaagtgcaggaagaagaactaaaatggaatgcatctgcaatgcaggtcgacactaactgtgtggccagagttttcggaatggtttcttcacttagcatttcatgattttcaaatcgtgtaatttgacccagtccaggaggaaattaaagtttcccccaaaccccccttccaaagggataggaaaggtacactaaataacaccagactgtttagtgttgttcaagagaaatgagacattttcattagcactatacaatacagatgattccaaccaacttaaatagcaaatgtttcataatattgttccatgtaatacatcagatgcacagaagacattatgccaagctaccttaggtctaagccttttatgttgaaaaaaccaggagaacatttttgtttggcatctaatataagttttaagtaacacaggcgcaccaaatgaaatgtggaagcatatgctacatacctttcctgagaccaggcgatgcatcctctccgatgaacatcaaaggaacatctatcttgagtagggctgaagaaggggctctcatgaatgtcacattcagaggctcatcagttcctgcatgtaagtgtacctgaaaatatgcatgttcacataagtcttcccccaaaaaatcacatataacagagtgtgaggaaggattcctgaaaatctattacattaattgctacaggcccacaattgcacaacttattatagcattcacctttgcatagagatatttttggagatatacaggccagtttgcaactgatattgtaaggtagaaggcaatgtatgatttaatctgatttatttcttgcattctgaactagaagaagcccatcatttatacttcattgatcaaagaaccatgtcttcaagtagcagttaatattggttacaacagtaacaacacagtactgtttatcttattatgaggccatcattgacactagacaaattgacaaaaaatatttagggaaccaacacagccacacattgttcgtaaaaaacagcagctaagtagaatatgtaaatgatgtcgcattgcgcagattgattgaagaatatatgagcaaacaagcattcctatagattgattgatggggcatacaagttcaagaccccacagccccaaactgcgcggtatgatgcaagtctttcacttttttttttgttgggcataacagtctctgacgtatcaatttagccagaccaaaggataccgaagtggattttggccaacttcaaaggaaacgcatattcgagtttcagaggttggtctcagaaagccatttgtaggaagaaagctcatgttacttccctcaagagctatcgaaccagaaagggatgctcctaaaacaagaaattgacgagatttccgtaagacaaaggcattgagcatcagtcttcatgctgctgcatctaagagtttttgcggtgcatacattttcagttcattgagcactacatactagagcgcatttttcatctacactaaatcatcttccagtattctacagaccaaatcaaagtcatagcccaggctaaagaaacatcaccacagaacaatatttgtatctcgaggagaaagaagcaagttaggcgtatcaccaaaccttgcggggaaggacgcggacgctctcgatgagctccccctggccggcgtgctcggaccagacctggaggcggaagaggcgggagaggaagaaggagcggccgaggtggtcgacgagcttgcggatctgcttggactgcacggacaccagccgcttgttgccgccctcctgcccgttctcctgctcgaacacgatggccggcacccgcccggccttccgctccttggccgccacgtgccgccccgaggaggcgcgcggcacggcgaggatgagctcgtcgtgcttcgcgtccggccgcgggtggcccgggaggtagtcgaacggcggcgacaggaggtccgcgtcgtggtggtggtggtggtccgcggtgaccgcctccgcggcggcggaggaggaggagaggtggcggccgaggagggggaggatgggaagggtgtggaggggtcgccggagcagcatggccatggcggccggcggcgtgtggggtgtaggggtttttggggggaggagggaggaatggtgggtgggctgggtggaggagagtggggtggagtgtgtgggggaagaggaggtgagtgggccgtgggccttcgagggtttgggtttggtgggctgagattgtttgggcctaagaatatttcatgggccggaagtgagaatgggtccagttcggcctaaaaagtcatttttacggagaaaattgaaataagttcacttttggtccctcataatgaaattcgtcaccaaccataatagcagatatgacgcgtcccttaactcctaaaatcaatgcaaataaggtcaatcaatgcaaataaggtcccaagtcggtttggatagtggttttggctgacgtggcacctatgtgacattgacgcggcacatatagtgggacccacatgtcagtgataatataattaaaaataaaaaaattgtagtgggacccacatctcccattccaatcttctcctccccaacatgctgccgttgatgcgaaccgccgtcggcgttttcgatgtctactagctctgccgcttgcggcccccgctgtggcctctcgctagcaagccacacactcgcgcaaacagcctgtctgcccatgttgacgcttgacaacagccgatgaacatcgccttgggcagcacgaagtacaacttctccgcccgaagcaactcagcgtgggccaatgtcggcgggtggtcgtcgaagtagtgctaaaatgagatgaaaaaaaactgacgatggtgctaaaatcaggaatagggtgagcttttcgatgctatttaagtgaacaaataacatttggtgctatagaaccagaaacaattttatcaattatttatgaataaaacttttttatatgtattcttagtggtttaaaaaccaactctggaaaatagaccacgattaggaaaaaaactaatatattttttaaaaattaaaatttggttatcaacaagtaggcaattagaaaagcctggctgatatgaatttgtgataaatttatacataaaatatggcttatatataatatgaattctcatgtaaagtacatacacaaaaatggtttacattatggttacctttcgaaagcacttatatccatttttcatatagagttagctaaaaaaactagattcgaaaatacaataatcatgccaaccacaagatgtctcaaaagtaagttaatcaagcaagaatgatataaacctcaaattagtttagccaaatgccaggtactcttgcatacgtagctcccggaatccaggatcaatcaggcttcacctttgcaaccactaatcatacttatcagccgctcaatcagagtgacaacgccacatggaccaaccacaaaatagaccccctggacccacaatccagtgagagagacaccacacactccccacaatataatttcctccagcgtcctctctccgtccggttccgtaattcctaatgttttgataagatttgtgacaaatttttataattttaactagcaataattttaaaaatatgtagtttaaagacactagtacaatatatatagatttgtcttataaaatagtactccctccatttttatattataagtcatttgatacttttcttagtcaaacttttttttaactctgatcaagtttgtaaaaaaatatactaatattttcaatgcaaaataaacacattattaatttgtcttacaaaatagtactccctccgttttcatattataagtcgtgtgacacttttcttagtcaaactttttttaattttgattaagtttgtaaaaaatactaatattttcaatgtaaaataaatatattattaaaatatattcaatattagatttaaatgtaactattttagtattgtagatgttgctaattttttctataaacttactcaatcaaaaaaaatcttggactgtgaaaaaaaatcaaacgacttataatatggaccagagagtataacaaaagtaaaattttatttatttatttattatatatgttatagtaaaaatatagtgaaagttatattttgaaaacgtgtctgaaacattaagaactatgggtctggagagagtaatattaatttccatgtcagagaaaccaaaaaagaaagaagaaaaaaagagagcatattcctgggctggctgctcgttccagcagcgcagcagcaagcaaacctaacatctcttcctctctcctctcctccctgcgacccgcgaaccacccaacccaacccaaccccaccgcagccgaagccgaagccgcgggaggggagggagatcccgccgcccccccaaccaccaccgccggccacctcggatctcggctgcgtgctgcggcggcggaggaggcggagaaggaaggaggagaagatgttctatggggcgatggtgtgggatccgtggctgatcgtgtcgcagatcgtgtgcctgcagtgcctctactacctcgccctgggcctcctcatggcgctcctcgtcggcacccgcgtcccgcgcctcaccctcctctacctcttcgacttcgccacgctcaccccgcgcaccaccaccggatggtgcgtcatcgccgccttcctcctcgccgccgccgccgggtaacgccgcccactcaccgctcctcccccccccctggtctcgtgctactagtacggaccgagatggattctttctcgaaaaggaatcggattcatgcgctcgctgctagttgactacaggttgtaagagtaatgccagcaattagcaagttgaaccgagtgtatgctcccagatctgtgcgcttaggagaggtagtatgtcaaatttggtgccgttaaatcgagaaaacttgctaggaattcccccatttttcctaggtatatctgcttggtacctgctgaaattttacacccaaatcttccatttaatatgagggccaacaaggtagtataatttttactagtcaacgtgtacaatatgagcacgagggtaaaatgtttctcggcatagtactatttgttatgaatgtgattgtatgtatgggagctagcatatgaataggtgctcagttgatattaaagtagcatattcttcacattttcataaattggctaaatctttctagtttatttcagtttgatttggtactctcttcagtttcattctccaaatcaccctaggacagcttataacagagaacgggaactatacctccactttctaattctaccagcattcattacagatcgcagaatttactacccacatattacgcactattacacatttggtgattactgcaatctaagaggccctgtggaaaacaactcccttttgcctaatttcttcatgcattttaacaggttatcaacaaccaacttaaattaatcttgcaaactatatctatcatggataattgcagaaatcaaaaatatacttttaattatcaaggataagcctgttcttgacctttggtgtaactttgttttcatcaaaatatggttgaatgctaaccttttcatgctttcgcttttgcagtgctgctttcatgctttatgtgattgagagagctaagaagtgcctggactttgcagccaccctctacatcattcatctgtttatttgcattgtttatggtggatggccagcttcagttacatggtgggttgttaatattgctggtttggcgattatgtctcttcttggtgaatacctatgtataaggcgggaattaaaagaaattccaatatcacggcttcgtgcaagtaagcaattatctcctactggatctggcttggattcatgcttttcctctatataattattgtcttcatatatgtataaaaggtcctgtatgatttatttgcttaccctttagccttttgtactgaagtctgcatattgcttacacaatagtcatgtactagctagaatattagattaattcgccaatgaactaaggagcagtagcatgatagtatggtacaataattcttcccaatgattttaattttctattacttattttttctgcttgccacctatctgtgtcatcgtccctgtaactaagaccttgttccatcacaaatgcccacattttggaaaaaaaatatattcaggtgtatttatgctgttgactgattgggactataggaaagggagagtacaaaagttcaactagtgatgtaaagagtgtgggtggcaatgcttttctatttagctttccttggtacgtcacagacagattatttgtagggtgtacctcaactcatatgttccatgtagctaaatgttgtaaacccaatgccaaagaaaagaagatgaagaaactaacattattatgcaagtgcaagcatctcacaaactcacagttgtgtagttgcaaaaaattagtcacttctcacctgatatagaccataaagtatgtaagctcagcgtggagcagagatattcgtcagggacttaatattcttttcaatatggaagaatgctttctgaaaatctgtaccaagcttttgttcagtcactgtttgtggtcatcttgctagtccagttatggtgtttaaagtttttaatatgtgaaatcaagtatagcagggttaaggtgcttaattattagactgcttcttttctcttccatcatattgtgcctgttgtcttttttataaagcacagtgacaagtttagctagcatcatatgggattcccttggaatttctgaagtttgaagttcccatcatgtcgtgctgatcttagttacagcgttcacagttgtccttttctaacatttcttagtaaggtgcatattgcctttctgacatggattagtctcatgtcaataaggctcaatagtgtttggttaatgaaaagcctaatatattattctaacttgggcagttgggctaggccctccatgcacagataacttctgaaattgtttccggtgaggagcggactcagattaggcctgcaattagtattacattgattaactggccccaaatattctacttggattttggtttaaaaggcttctgggtcaagaaccattgggcacaattacagggatgcactgctgactcctggcttgggattttatgaacttgaaattgtgaaatagtatgggaacatgtgcccttagaagcgtacaaaataaactttgatagtttacctggtcaagtgcttaattgcttttatgccgatttcagagtggcttcaaaatcctcagtaaaaagttttagcgtgttgtttgttactgtatgttacaaacactatctataaataagatgccttcaccttttagatgccgggccaataataactaaatcaaactgttgtagtgaaattatgtactttcagttgatgtggttggttgtttcttttttttccttttgtggtatttgggattggctgtactacatgaacattgctacttttctccttccaagtcaccttctattggggataatcttctccagtcactttcaacttattagcctgcttaattattttgtcctgtctttcaggtgtttaatcttacagactaaaggagtatagatggccttcaaatgttgttaccccccaagagatgcttgttaatatgtttctttaggaatacaaagactcgtgatacatgctttcctctatggtttacgaccaatactcttcaaacctgcaaattgatgcatgatctcccagtaaagccaccaggtagagactgacagaacaaatcaagggttctgagaccaagcatagaatgccaactcaatttttaaagcatgtatcaactattcaagtcttctcttctctatggatagtctcattgaattgacgaaaaaagagattacttgacaatttgtatggctagataccagcaccttgaaacctgtgttctttagcgagggtctgtatcgcaccattcgattcttctttagctttatcctgcagataatatatccagtttccagtgcttcctcttaagctcattccagcagagttcagtttggcggccaatcacatgactactcgaacctccaaatcatgctgtccttctgaacatgtatgtcaatatatgtgccctgtgtgtattgcgtcagaggtgttgacatgagttggttaaaaatacatgcttgatacgaaattgtaatttccatcgcaggtgaactcgggcaaaaattttaaaatcccttgtgggttcgcactttttttttcctctagtgctgtgatacttgcagtagtttgttttatccttgctaagtattgtgatattgtcagtactacagaagcgcctgtaatctcaggtgtcaaaacccaaaatcacttctttctcttctcttcactaaggttaaatatgcattgacattttcttttgtggtagttttatcaatgtgcattggtttttatattatggtgtagatgtcaacttggttgtcatgcccagcatttctggtactcttatacctcggtatctagttacccagatttcagttctcctcactaaaattcactgaacatcgccgagaattgacaattttcaggaacgacaccaaccagtggattctgccaggtccaggacctgaacggccgttttgcttgtaaagtgcaaaagttaaagtgtaggttactgttttttttccctgttccagttcgcattaaccaacagaattctctgaatcccaaagggcctaccgcttttttttttttctgaataggtaaatgattttgtgatattattcaacgaataaattaattattataaagttgaagaatataattaaatatcttttaacagaataatatatagaaagcttttttttttttgcgattaggtttgtcgtctgagcgagaggccgaggcttcaacatactggatgcctgggtatatatgacacctgcttactgcacacagcaattgcaatccccgctgaagttgacctagttatgccactactaatttctaatccttaattatgcccagtgtcctgtttcatttctgttccataatcaggtagttggttgcataacaagataatctactgtagctttggtatgctttgagctgccactagtattttccatcctgatctgatctgatcagatgtcaaagctctacaatctcacgtttttctcacctaaattaattaagctcgcgttgacatcacctctagatctctttcctgtgcgtttctataaactgtattttgctggctcgccggtcaactggttgttaattaaaactccaggtttcggcgttccaggtgcctcagttttcagggcgcgatttcgccggaggatggccggccgccggaatagtcaatattctcatatagccaaatgcccaaagtttgacgagttaaaatggaggatctctcctatcctgaattcctaatgcaaagatagccatctctcccgcatattcctacactctaacgcaacctcatttgtaatatttattttttgaaaaatacaagaggttaaaatataagaatgaatagtttcgttgtcatttgaaaacgggaatattttttatagtataaactaagaggttggccaccatcatctccgaggcacaaaatgagcttggctcaactaatcagatttcttctattttccctactgttttgatagaggttatcactatccgatggtatcacggtttacatagtgaccaaaccggttaccgatggaaaccgtagagttctaaaaactaagatcatatggtaatcatgcggttttataaatctagtggtgaacctatccacatgggtgctcgtatcatatctatggctaattatgttttcaagtcacgtcgagttatgatttagattttattttttagaaacacaatacaaacgcagacgctcacaacacacactcacccttataaatgaatatgcacacaccctatctctattagaacctctgaaagactgtgccgatatatttaatgaatttacaatgggcgcattgctacagataggtacatcctctatcacggaaaaattaattagctgtaaatgtgagcatctgttttaaccacagagaatcttactagttgagttatgctcacttcgctagttttctttttctcacaaggaagagtttagaggtggttagaattggttttctgctaggagatcaaggccggcccatgttcggcattacgccagcacgggcgcatgggccgcatctggaattcggagttatcttaaccggatgttggctttagctacatttcttctttacaataataatcatttgaacagatcaaggccaccctgaaggcggaagcagaggcgtttcaattttttcttcgtgatacaataatgagtggcacagcaaaaggcaaagccagctagtcacattctgaaaaccttcatacatatacaaatctggttttcacgtgtgaaaaataaagcaggcatcactcatttccatctatgaatattttatatgttttctcaaaaaaagtgtttgttcattgttaatttagtttacgttcatatcggaacaattcacggtcccggaaaaaagtgacagataacagttcacattcagcgtttatagagaggaaaaaaaagagtgataagcatagttcaattgattaggtttcttatattagaattagcccatccgggttcaagttctacagcctgtttaggagagtttaagattttgataagccgctagttggtaaccaaaatttgaaattctaaaaaagttgagttctctatttctagtttattttctaaaattctacgggccaatttggtaaagctccaactcataaatttaactctaagagttgggtttggaatagagttgtgcagtagtctaaacccagctctatctctttattacattttgtgagagtgcttcgaccggctcaattcccgttttaggtggagctgaaactgtttagatggactctagctcctcctaaagctagagccatgccaaaacatacgccacaactacagcttcttaatatctggatgaaaaactgaattgtttatgggagtttctaattttgggagaagatgcagctgacagaagctctcccaaacagacttgacacggatgctcgcatttgtagctcattattcttttagtattaggtaacgtgtaaccattgacagcaagacgtccatggtccatctttcaaatatacttatagaggtaaatgtgccataagcatctgcatttgtaatgtatttcgaaaactgagattgcgtttatacaacgaatcactagactatatgtttcaataattcgatgaataaagtgaaaataacaaggccttagacgcagcggctgtggttaccagtcacacattaccttaagaaaaatgattttaacatgtgggataagcaaagggaatgattttctttttctaaaaactaacaatcccaaaggaggaaggaaagaaacaaaaaaaaaaaaagagcactgactttggcgtaaccaaacggcccaatgcaaatccatccccgaatgctcatcaacaacgagtgtgcaagcatccggaccgaaatacgcacgcattacacggatgcaacccaaacccaacacgggaagtcgcggcccaccgtattctctatctctctacgcgtatatatgcatacgcgcccctcccatcctctacacgtacggttacacaaatccatttcccaaaagaattcaaaatttaaaacgtacataccacgcagcagctagcgcgcgcgctatagcttttccctccaacacacaagtacgtatctcccatggcggcggtgacgccggacgagcacgagcggcagcaggacggccactgcagggccagggtgaacctgcggccggcggcggcgcggccgttcggcgcggcggcgcgggcggcgctgaaggacacgctcttccccgacgacccgttccgcgggctcggcgggatgccgccggcgcggcgcgcgtggcgggtggcgaggtacttcgtgccggcgctggactggggcgcggggtactccgcggcgagcttctggtacgacctcctcgccggcgtcaccatcgccagcctctccatcccgcagggcatcagctacgccaccctcgccggcatcccgccggtcatcggcctctgtaagatcagatcacgaacgaggaattcctcagaggtgttcgtccgcgacagaattcgatctgtttgttgattgattggttgcgttgcgtgcacagattcgtgcttcgtgccgccgctggtgtacgcggtgatggggagctcgaggaacctcggggtggggccggtggcgacgtcgtcgctgctggtggcgtccatcgtcggcggcaaggtgagggcgtccgacgaccagcggctgtacacgcagctcgtcttcacgtcggccttcttcaccggcgtcctgcaggcggcgctcgggctcctcaggctggggatcctggtggatttcatgtcgcggccggcgatcaccgggttcatgggcggcacggcgatcgtaatcatgctgcagcagctcaagggcttcctcggcatgacgcacttcaccaccaagaccgacatcgtctccgtcctccgctacatcttccacaacacgcaccaggtgcacacgtatatacttcgtgttattaattacaacaagctaagtctatgcactcacgttatttttagctatgtatatacactgtagatatagacgttgaatttctatctattattaaaaaatagcttgcgggatttgacatattataatactatgaattagcgtcacgtccagcgtttgcattttttatttcgcctaaaatttttgtgtgatttttgacacttttaaatttattgaaattttaactggatttgaataaagtttgaccaaattcaacaaacatttgataaaatccaaaaattttggtcgatatattgatttgccggtggggtccaaaatttcgaaacgaaattgcatttgaccaaattcaacaaacatttgataaaatccaaaaattttggtcgatatattgatttgccgatggggtccaaaatttcgaaacgaaattgcaatcactggtcacgtccgatactggttttgtttttaatgtgacggagggaataaattataactctagtgcatttgtaattgcagtggcagtggcagagcacggttcttggcgtctgcttcctcatcttcctcgtcttcaccgagcaagtggtgagacatgctgccattcttgaaactttaacctttttccacctgatgtacgattgaataccaattgattggaggaacaattcctttgcagaggcgacggcggccgaagctgttctgggtgtcagcgatgtctcctctgttagtggtcgtcgtaggatgcgtcttctcgtttctgatcaaaggccacaagcatggcatccctatagtaagttctagctgttgcgtaattaagctagtttgtaagaaaatttatcacctcaaaactcgtatgtttaatctgtaacttttgttcaggttggtactctgaagcgtggcatcaacccgagctcgatatcacagctcaagttccagccggagtacgtcggcgtcgccatgaaggccgggttcgtgtcagggatgctcgccttagcggtgcgcacgcatgcaacaactccttgattaatttttttggttttctttctgaatttgtttggcgatcgacatggctgatctttgatgatcttggcatgcaggaaggcgtcgccgtcggcaggagcttcgcggcgatgaagaaagagcgcatcgacggcaacaaggagatggtcgccttcggcctcatgaacctcatcggctccttcacctcctgctacatcaccaccggtaattaacccactcatccatggctcctcctgcgttcgtcgtcgccagcttagctcacggcggcgccgcgtgtgtgttgcggtgtgcaggtgcgttctcgaagacggcggtgaactaccacgccgggtgccggacggcgatgtcgaacgcggtgatgtcggtgtgcatggcgctggtgctggtcgcgctggcgccgctgttccggcacacgccgctggtggcgctggcggccatcatcaccagctccatgctcgggctggtcaagcaccgcgagatccggcgcctgtacgaggtggacaaggccgacttcgccgtctgcgccgccgcgctcctcggcgtcgtcttctccaccatgatcaccggcctcggcgtcgccgtggccatctccgtgctcagggcgctcctgcacgtggcgcgcccgtcgacgagcaagctcggccgcgtgtcctgcggctccggtgccggcgccgccgacgacgaccacgccttctgcgacgtcgcgcagtaccccggcgcggcgaccgcgcccagcattctcgtcctccaggtcgccggctcgccggtctgcttcgccaacgccgagtacctccgggagaggatcgcgcggtgggtggaggacgaggagaaggccgtcgccggcgaggacctgctctacgtcgtcctcgacatcggcggcgtgacggcgatcgacagccccgggatcgagatgctgcggaaggtgcacggcgagctggagaggaaggggatgaagatggcggtgacgaacccgaggatggcggtggcggagaagctggtgctgtccgggctcgcggagctcgtcggcgagagctggatgttcctctccaatggcgacgccttggccgcgtgccggtacacgctccagggctccaagcacggcggcgtccctccggtgtagatctcgactctcgaggccgctggatcggtacgcgcgtcagtatatgtacagcacacatgcgtatgtgcgctgtactgtacgtattactaacacattgtgatttgaaaagtacttgtataagttttcataaatattacggaacgataatagcgtatcatgatcatataactataattaggaaggtggcccacgcacatgcgcggacacttatattattatattattgaaaggtaagtttattgtttgttaaaaaattttgcctaataaattaagggcaaactaacgttcggataatgttattttataataatttaagggttctatttttcttaaagtatttaaaaaaatcattcataaactttcgagtaggagatggattgagtaattacgacttttgaatcatggttcattttctcgagtaaataataaactattgctagttaattattatacagttcatctatatacatatcgtgtagtacggccacaaatgaaaaatgctagagcgaactacttaaaatttttgtgattaaattgtctcatgaaggccataatatagtaaaaagggagaaaaacgtatgcatggaaaaaaaaagaagaaaggggaaaaagacaaaagcgtaacatgtacgttggtgcatacctatgccgcgggaggagaggtgggactatgaaggtggagagtttgtgaaggtggagagttcggacctcgtagtatttagtttgttctaagatcaatttaatctaacgatttataatattagacctaccgatttaagtgaaaattaagtaatatatactttgctttttttctctctcttagaatatatgatattttctctaatttattagagtgccatgtggtagcttgagagtattttaaggaattttaatggacttaacacatgtaattcataaattaaccgtgtaatatatatgtatgggacatacggtaatattcgttttagatttgtacatgtttgtttatatatatgtagagagaaattaattatgttcctaacaagccattagatgtctaattaatagcaattaattgtaacaactatttacaattgttcatagtagctcttacatattcatcctatgactttgattatccattgatcaccatgactcgcacgaaaaaagaatgtactacttaggggtttaggatagctgaaattgatgaattatttgatatatgtgatatctatttgaggatataaacgaataaattgacttctaaaaagttaaaaagttgtttaaaaaacatcatttagaaatttcaaaacatggaatcagaaaaaaaagagccttaaacttcattctagcacccttgtcttagtaagagttctattgatattcgttaatactatgctcatatttataacataatgatttcattcacctgtacgaacaaataatacagaatccaaatacaacataaaacaatatattataattattatggaatcaactgtcggtttcagcttaaacagagctatgtgttggaaacaacacaacccatggtgcttaattcttctctcactgcatcacacctttaatttttcttttcatgttattaacaaaattaatcatctccatatataatttatatgtggcaaaacggtagcgctgcagcggtcgtgatcaccttagatgcctcagacatgacgctttgtcacacgtacgaaaggtaaaggtgtagacgtgcattgtgcaaagggccaaaaagaaaacttcagacactttaattattagcaaacaatagatccgaagatttaaataatcggtacatgggtgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtcgacaggttcgggccgctgagaagcgtaataccctactcctgtgttctggtggatctgtgtgtgaaggagttacagagagccggagagccagagagttcaggctccagaacccctctagcgtcctttttctcctttcttttctcctttttggtgggcaaggtcctacttttatatctcaaggggataccacatgcaccacttctacctacttttcttttgggtggggacctaccctatcttgaccaaaacttggcttgcaccttcgcctggaagctaaatcacaacttgtccttgagtgaggctcagcgccgtcactcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaagccgcctgttgccacctaacccgcgatctggccggtctgtgaccggtcacacactgtgacctgtcacggaccgaacgagtgtgctgtgctgcattaaatgcggcgtggggcgctcgtccaacccgcaataaacgcggttaggtgagcgccgctgtgctcacctaacccacacacgtggcgccaaacccacaggggtcggggcgccccagccctcggggccgaaacgggagcggcccgacccctcggggagacagagggaggggcggccacatcaccctcgggcccgacccctccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacaggtggggccggtctccacaggcggcagaaacccagcggtcgcaaatcgcgcacatcggcaaggaaaaaccgaccgacaataatgagcggcttccttcaagaccgctacattacttaagtagcgcgcgaaccgggacgagccggttcgtttcgcctggagatgtgatgacggtgcatcggtcggcgagcgtagttaacgcgtgcacgatatgtcccatctcgactgccacggccgcacatccgcctcgtgcgccgcaaacgggcgagcgggattagtggaggtgggcgcgagagacgagggggtgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgtgccgattcatgccggaatctgccaccggccgggaggtggtcgcgctgggcgagggacgcccggcgccgcattacccggggtggtccgtcttcttcctctctttcgcaatggcagggctggtcccgccattctcttctttcttcatggatgttctggagctttatgatatccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggcgggtttgcgatcccaggggctcacgggggccatggtgttcggcgactaccttcgtcgccggatcgcgccactccagcggcgcgcccggggcgcctgggagtacaccgggtccgaggactacatgaggacccaccaggggggcagatgggactgggcccctgaggacttcaagatggtggtccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccgcgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatgggggggaccgaacgatgctggggaaaccttatctcccccccaaggtggtcgtttagtcgacctcctcgcaggttcgtccccgcgcccactgcggccgtattcattctcccaaggcgagttttcacttacccgtttctttttgtcttctggtttttcttccgctttcagcgagattccgtcgcgcccccctcgccattccaagtccggccggtctgaggccgaggagacagcgaccgcggaggcccggaggcgggaagctgtccggcgagaagccacggaccgcctccgggaagctgaggaggctgcccaggaagccgtccgggttcgccaggctgaggaggccgctcgggaggaggccagactccgccgggccgggaagtcagcccgggaggcagaggcgacgcgcgcacgccaggcggcctgccaagcccccgacccgactccgcccgaggcgacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccgaggcggctctcccctctgccttccgccgccccactgaacacagagcccctcctgcaggccctggccgccgcgaacacgacggtgctggacgggttaggtgcccagatggaggtcctgcaggcagagcgggcggagctcgacgcggcgtgggcgcgcgtcgaagaggggcggcgctcggtggaggccatggtggaggcgggccgcaaggcataccgccggcacgcctcagagctcgaggcccgtcggagggagctggcggagatcgccagggaggtggaggaggagcgggagactgccctcatcgccatcgccatgctcaacgaggcgcgggacgatctccgcctccaatacgggagtccttgacgccgccactgcacgggaacggcgggcgacggagaacgaggcagcgtcccggcggcgcgaagaggcccttaaggctcgcgccacggcgctcgaagagtgcgcccgcgcgagggagagggacctggcggaccgcgagaccgccgtcgctatccgggaggcaacgctggcggcgcacgaggccgcctgcgccgaagaggagtccgcactccgcctccgcgaggacgcactcaccgagcgggagcgagctctcgaggaagccgaggccacggcgcagcggctggcggacagcctgtccctccgcgaggcagcgcgggaggagcaggtgcgccgtaatctggaaggcgcccgcgccgagagggccgcactggatcagcgggccgctgagctcgaggcgcgggtgaaggagctggacgcgagggcgcgcagcggcggggcggccgcgggtgacggcgatctagccgcccgcctcgcagctgccgaacacaccatcgccgatctgcaaggcgcgctggactcgtccgccggggaggtcgaggccctccgcttggcgggcgaggtagggcccggcatgcttcgggacgccgtctcccatctagaccgcgccgggcggcaagcgggcctctggggcgagcggaccgcgaagtacgccgccaaccaggggggcctcgcccagcgcctctcagagatggccgggactctccagcggctccccgaggagctcgaggagacgatcaagtcatcctcgagagacctcgcccggggggcagtggagcttgtacaggcaagctaccaggccagggacccagacttctccccgtgggcagcgctggacgagttccctcccagaaccgaggacgacgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgactcgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcctagcctcaaacggcgcgggtcggggctagtgcctggggagatccacgtgtcgagactggccaggccgggagcgcggtgaccgagggttatggggacccgattgtaggcctttgccgattcccccccggagttcaccacgccccggggcacggctcggttctgggccccgtttggcgatttccgccggcccgggccaccgagggcagggtcgagcacgagcgtgctaattcaagccaagactcttcaaaaggaaacaatggcacagacacagtccttaggaaatcgaaaaagcttttattgaaatacggaagagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggagacgccgatcactcgatacggaccctcccacattggtgagagcttgctcagtccagcacgcgtttggacgcggcgtaggacgaggtcatcgacgcagagtgattgggcccggacgtgacgctgatggtagcgccgcaggctctgctggtagcgcgcggctcgaagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttctgcgttggcgcgctccacttggccattgcttctggggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgatagcgacatacagatactcgaacccgcccggggcccgtctaaatggacccaggatatcgagcccccagacagcaaacggccatgaaagaggtatggtctgcagggcctgggccggctgatgggtttgcttggcgtggaactggcacgccctgcaccgccggaccaagtcgaccgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagccgcgtgccgatagagggtcccttccaccagcacgtagcgcttggagatgcgctggacgcgttcactcccttcgtggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgacggctgggcaagcctttcttcaaaggcgctcggtggggtctgggctcgcgaggaagcgagccttgagagttcgtcggcgaccgcgttatcccgtctgggcacgtgccaaagctctatcccgtcaaaatggcgctccatacgccgcacctggcgcacgtaagcatccatctgcgggttagagcactggtactccttggagacctggttaacgaccaactgagagtcgcctaacaccaggaggcggcggatccccagtccagccgccactctgagtcccgcaaggagtccctcgtactctgccatattgttggttgcccgaaagtcaaggcggaccaggtatttaaggacatctccgctcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccttctcggttatgcaagatttggccgagcgggtaggacgtaaccaccgtgacctgacgcgcctggaaataatggcgcaacttcctcgaagccatcagaatagcgtaaagcatcttctgggcctgagggtatcgggtcttggcgtcccggagggcctcactaacaaagtagacgggccgctgcaccttttggcggggccgatcctcttcgctaggggccgcatctccagggcgcttttcgtccgagaggccgcgcggggcgcactcggcttctgtgtcgacgacctcggggtcggaaggcgacaggcgcggccttcccgcagtggccctggggccatcctgggggtcgggggctcctggcaccgtcggacaagcgggcagagggccagctccggtcgtcgggggcctcgggccgccgttcggctcgggggcctctcctccctgctctctcccgggtcgagtcgatacagggtgctcttcgtccgagaggccgcgcggggcgcactcggcttctgtgccgacgacctcggggtcagagggcgacaggcgcggccttcccgcagtggccccggggccatcctgggggtcgggggcgcctggcaccgtcggacaagcgggcagagggccagcttcggtcgtcgggggcctctcctccctgctctctcccgggtcgagtcgacacagggtggggatgcgcggagcgagggtcgtcctcgtcgcgctccacgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccggagcgtttgaggagcttaaataggggtagcgccttctctcccagcctcgatatgaaccgacttagggcggccatacagccagtgacgcattgcacatccctaagcttcctgggggggcgcatccgctctatagctcgtatcttctcggggttggcctcaatgcctcgggcagagatcaagaacccgagaagcttgcccgcaggcacgccgaacatgcacttgtcggggttcagctttatgcaggtggtgcggagactttcgaaagtttccgctagattcgagagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctacgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccg

SEQ ID NO: 67199 - DNA, 721 bp, Oryza sativa
gagtgtacctgaggtaccaatcggaccaatgcaattagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccaccttt

SEQ ID NO: 67200 - DNA, 1577 bp, Oryza sativa
  unsure (1)..(1577): unsure at all n locations
cggcggngtgagannnnnnnnnnnnnnnnnnnnnnnnnnngtttcctctttcttgcatctctatcagaggctgttgcatctgattcttcctttatgctagcatcgccttttcgatcactgtctccagctgattcttcaccattggcacgtccatcagtctcaatataggttcttgtgcctgtatcgcgttcttcatcagatttctcactatcagtcttagtaagatcaaccatggcgaggttatccttgtgaaaccagatttctgatgcaagcaacttgcggtattcagctattatagcctgcattttaaggcacaagtacatcaggcagtttaacaaaaagaaaagaaaaggaacctatagtgtgaaatagcactaacatcatcacagtcgtctatacttttgccttcagcaattctacttgcgaaccacagcataaagaaaccacagtcattactgaaacaattattcaacaatgtaagccaaatagagatataaatgcagcaaagaacgggagaagaatttcttcaaggcagctgaaatattactagttgttttgctgcttttacagacagctccttatactcgaattcaggaagtccaagtgacttcaagtatccatcagcttttgatacttgcaagaatggatcaaggtaaagaaaaagaagtgtttatcactgagtatagggacaaatatttggggaaaaataaccataccacattttctgcagcacttctctgcccatgagattgcaatgaatcaagtatagatttacaattattcaccatgtcaaacaccactaaaaaccaatgttcgctgtggaggatgggtatgaaaatctgggaaaaaacatgtttagttcatggcctaaaagaagaaaaaaataacttgtcttgggatagggggcacaaactagttttgtgttggggcgcacaattcttctcctaagccggtatagcagagttctgctgtcgcccttactcaacaaaaaatcctacaataaaattgaatagattgtaatattggataaattaaacacaagatggaaaaatgctaactgctctaattgatactccctcagtcccacaatataagggattttgagcgtccccncctggcctctgacctcgctgccgacgacattgtccgtggagcggtggtcgaccgcgacaaccgccgacgcgtgcagcgatggggttctcggaacctgcatgtggagaggatgcgattgcttgggatccttccacgagtggctgaactggggatgtgaatcggggggaacttcttgaaggttcttgacaagaagaactgtatggactctaccactcggctttcttcagaggttattcctttgctcggtcaatgggattgggagccagagggtttaaacttgtggcaactgacgcgatgagggaatgtgggggtctaggttattattacaccgcggaatggaacgccccgcggggatttatgttgggtttaattgaaaggagttatctgggacaatacgggttctttttcttaagtggaccccaagttcaaaaccattctcgcaatcatacggcttgttttccacg

SEQ ID NO: 67201 - DNA, 762 bp, Oryza sativa
  unsure (1)..(762): unsure at all n locations
agggatggatcaccnnnnnnnnnnnnnnnnnnnnnnnngtcctaaggacttaaatctatatcctgcaagatgacttgttgccacatcagcagccaaatcaataacctgagcatccgtagacagtttgtctcctgagtataagagctgcgaagtagatgaacagccatgtttcatagaaagggtagagcgattggcaggagtgatctgggcaaacttgatatagttacttcttttggtggttggattcacagataatgcagttctctggttctcatttgctgtggtgacagcctagcagaagaaagaatacgacctataagtaccagaagcatcaaactgaatactgatcatctatgtgagtgcaacaaaattaccaaagcagatatagtctcctgaggtttatgtttgtctgcaagcagtacaatattatctgcatgtaacagcattttcacaaaaatgtaaatcatcaagagaatagcagatcagcagaaacacaatatagtaattaaatttggcagccacagcaaccggagctgcaagaaatgtctggttgtccagccaatggttgcactgaacaattaaaaaatgttcagggcttcaggacagcaacacatgttgcagaattatattcagcactcgacagctaggtgaaataggtaatttaaagaggatttaacattcaggagctggatcttggccccatactctataaatatctctcaagacttaatagtacaaaaaaaaattgaagatttttctatg

SEQ ID NO: 67202 - DNA, 614 bp, Oryza sativa
ttcttccgacttcttctactttagtctcttcctattctaatatacaataaagtacactagagtctcttgtaattcagctcatgctttggtgtgtgtgaatgagggagaggagaggggtatttataggtggagagttgccttgggagagtggagatgctccaagcatcctatgagcatattccctctagcttcatgtcctcttgacaagtgtcctcactatgacggtttccaccggtagaaatggccacaaccgtcattgggatgaggagtacaaccgtcataccgaaaatgggctggactgggccagctaggggttcggccgaatcctggttggcttccctggcccacatctttcttcaggatgctgacatatgggccccacttcatgatgctccatgttttggctccaaatgattgcacattttatatattgtagctcaaaaccatgtgagttcatcagagcaaaatatatttccattctttatgctcattctctcccaactttggtggttgatcacctgcatacaaatatacaccaacactcgtggaaattgtagaaataaatcataccactatgttggatgtttcacatttatggttttatcaggtattga

SEQ ID NO: 67203 - DNA, 9547 bp, Oryza sativa
gccagcaggtggcggcggcccatcttcttccccatcctccgacgacggccacaaccggttgtggcggcgtctgcgttggcagcatacgggggcagcaggccacggcgcatcggcggcggcaggcggtggcggcggctgcgggcggtgttgcggtggccgcgacgggcggcacgcggcggcggcgtcggcaggcgactcgcgtgcgggggcgtcggcaggaggcagcctgggcgacggcggcggcctgtgcggcggcgcttgcgcaacggcttgggaggcggcggagatgtgtgggcttcccggcggcggtggctcgtgggctgaccggctgcggcggcaacgtcaaggcgacgcctagaaggtgttcgatgaaatggcgacaaaggatgtagaaatgtggagctgagtaatctagccaaacacttttttacctacctcagctcctagaggagctagctctcaccggagttggagtttggagttgggagttggagttaggagctctaccaaacggggcctaaagttaagtccctgatccaaacaccacctaatataccaacttaataattctaaaatgaggctgttttctgtcgagcatgcacgtcattgaccagaccagatgcaggtcaagcgtcaaaagtcattttatctgtgcttggtcatcattttcctttgatttcatttcaacggagtgtgtacatgcaagacaagaagtaacaagttgagataggccgacagcagtcacagcagcagacaagtcggctgagttcctttggacgagatgggaaccaatctgctcacagtccattagcacgtgattaattaagtattagctatttttaaaaaaaatggatcaatatgatttttttaagcaactttcatatagaaactttttgaaaaaaacatatcgtttagcggtttaaaaacgtgcgcgcggaattcgagagagagtagttgagaacatcgtgtgccgaacacagcaaactcactttggaacaagaaaaaaccaagggatactaagaatttttatcaaaaataatcatacagaaccctctaaaataaagaattggttactacccatttttaaaaaaattcctatgaaatagactattctaatgatttttttaaaaaaaaagtatgaggtctcacctcatatttttctctgcatgtgtcagactttctgtgttttttgtgtgctaatcgaatgatagttttgaaactttcatatgtttcataatctcaatgagtaggacattctattcctactttttttttctatttctatctttctttcaatcctacgtttcaaaggggcgaatatataatggtaggccatgctaccaacggatgaaagtattaatctagtcgttgtatttgaatcagaggttagcttgagcacgcataacgagatgagcaattagctcattaactatttaaaacttgaaaaatatatttaatttgtttttaaaaacttctatttgtatttttttataaaacacaatgtttagtagctcagaaaatatgctccctaagcatgataaattagctatgccattaacatgattagaactaagcgtaacaccttacaggtttacaccaacaaatattgaaggaggccgttcaaacatgatactccatcttatacagcatagatatatatttaaggtgtatatgatgaaactattttatatctttggtaagcgaaacacagttgtagtggaggcgtgagtgaataactccatccaccaaattaaatcctattgtcaattaatatatttgtgtattctcatattacagaaccagaagttatactttcattgtacataaaagggaaacatcacatctatttttttaattttaatgccatgttagtgtagtactgctcacaaagtcacaagttaggtcaattacctaggactatgcattgtgaagtacagagaatgtatgtaattgagaggtcatgtccttcgatattgtaataactctgtttaattaacaaaaatccccctcccaaagaaaattttcttctgagaaagaggtaatagaacaaaacaggtcagtatataccatggatgaaaggaagcctcagtagagattttttactccctggttaacaccaacagccatttcagcacaatagatcacgatttagaaagggtagaggcctttcatgttaagaagagccactatatacaaaatgttcagaccagaatggagatatatccacaaaatcgaatgggcacatagtttcacacccattccatccccattcacaagtccgaacccttaaaacattggatcatttcccctaaaatgctagcaagtctccagggaacaaaatatgaactgtacaacatcctgcaaactcatgatcaagacttctcatgtaaacagcatcttcagttgctcgatacgagcggagcggacttcatcgtcggtcagcgccccagagatcatcctctgcttgcacgcttgcaccttctgcatccgctcctcgaccgtatcctggaatccagacagaatgtgtttttatttttgctgtgctttctggcaaaagtgagcagatgttgtgactgggattgtcaatgtccttaccttgacgatgaagcgccttacttggaccgctctcttttgcccgatacggtgaattcgcatgatagcttgttcttccactgcaggattccaccatgggtcctatatgaatgcaaaaaaaaaaaaaagttgatgtgaccatttaggttagaaagttggtgcaagaataagtatttgcaggtcattggattgacagtgtatagttcaattaccattaggaacacattggaggcagcagtcaaattaagtccaacacctccagccttgagtgacataagtagcacctaattttcaggaaaaaggattttcagaatatgtgatgcttcaagaatcaaacgttgcagaaagtaaagcaagagtacaactagaaatgtatgtgcataccagcttgtccttgctttcactgaactccttcagaaccttttctctgtgtttctggctgagcttcccatcaaacctcaagaatttgatccctttctgattgaagggaacctcaagaagatcgaagaaggaagtgaactgactgaacacaatgctcttctccctcttctcctgaaggccctccaggatcttgatgagttttatcaccttacatgagtccttccagttattctcagggtcaacctggaatcgacactgactaggcaatgtgatcagctcagatttggtaatggggcttcggcaaagtgggcatggtcctccagaaggcgtcctccagctagagagcaggcactcacggcacatccggtgcgcgcatggtgtgagcactggatcatcagaagctgattcaaggcagattggacactcagtagttgcgccctggcggatttcttcaacaacctcttctacatacgcctgtgaaggtggcgcactgcgtctcgcggaatcacgttgcaccccatcaaggaacctctgtgctagctcatcgaggtcagtatacttctgagtatcagctcgactgcatatttagaatttaacaggagttagaaatgacatgatgaaaatgtaagggagcatatttctttgcaatccatgtctaacctgatcactagaaaagggtggtcgcagcactgccttagccgaaggagtaactcaagaatattagcgtagttgttaagaacactgccttgtgctacaaatttatcaaattgaacctgttgggagtaccattttgtgttagacaaaaacaaatctcagccatgaacattaagaactatgggaacaatggtccaaagaacaattcagtgaaggttccaatttcttatattaacccaaagtcctgaacaagaaaatttaaaacaaagatacctttgatctcctgaaaagcgcttcatagaaatcgcgttcatcttcagattgttcgcactccacaatctcaatattagctggtgggaggactagtatgggactggaaacaagcatttaattgttgtgagcaacagtacttccaagagctaaggcatggcagatgataattgatgcagtttattgtgttgacaaagtaacaaaataataaaatgcgtactttcccattttgtcttttgtttccttcgttctcctcagcatgagtggcctcagaatagctctgacaagtttcaatcccctctcatcaccattctcataaggtctttgaatcagcttattccaccttttgaaatcaaaacagcttgagtcagattttcaatcccaataacacatcggattagattttatgtagccagaaaatgttcgtaccaacttgcgtcaccccatggttctacatgtaggaagcaaagaagactgaaaaggtcctccaaattattctgcagcaaatgtgatacggataagttagcttactagaaactacaaaactattcatcaatgcttcaaattctggcagttcaacaggaagtattaaaataacaaatggcaatggttgcaaactcacctgcaatggtgtacccgtaaggcaccatctgcaatgagaagttaattcataagctgctcgtgctgctttggttctgggagatttgatcgtatgtgcttcatcgagcacaactctataccaatctatcctgtgaaagatactgctgccatcctgtaaatagtaccatttttcgttagttaaaatataatgaccacttcttgcaaaaaaagctatgaccattacactgtagagaaggccacagtccaaactcttacattcttgtgagctgattgaagaacaccataggttgtcaagacaacactatgctgagccatgaatctcaggtcagtggttctgtcgccaccatagtagacaaacacagaaagagctcctggtgttgaatgtgcctccaattcatcctgcaaagggcaatgatcacattactagtcttgcaaatcaaaagttcctagcagaaactagaaaaaggatcaaacaagctgcttgaaaatgcaaggctggaaaaaatgaagacaaaagaaagacaaacctaaaaggttcccctttcaattgttctcaagttgaaagcaagcaaaataaaatacaactataaaaccggaaaagtacaatataatggtaagcatagatataatttcttaccttccactggcctagcaatgccattggacagattataagtgtgcctcctcttacagaggatctcgaagtttgtgccttggtgtcacgatctctagtacccctcttatcttgttctaactccccccttgggtttgatagtattagagcaatagtcatgacagttttaccaagacccattgcatccgctagtatctgcaaagcaagagatgacacatatagcaccatcagattaggcagatgcaaatattcatattctaacaaaaatttcccctgaaaaacatgcatatatacaacttcctcagaaaaaagtgcggaaagtgagaaagcattgcaaaagcaaccatttcttcaaagtttgtaaaccccagcaaccattgcagtgttcatcaagcatgcaaaagcaaccatttcatttgtttatattaaagttctagtggtaatattaaaaaagcatataatgctgcattgggcaatctaatgagactacaaaacaaatcagggaaagcagaacactaccatctagaattgtcattaaaaaaataatactgtctatgtacagcctaaacaaggtacaatgcgtatacgagtgacccttaaaacaaaacaaacttacccctcctcttgctgactgagttacactttgaaactgggttgttgcctcgccagtgaaaacattgacatacactgcaggagctctcctggaaacaaacattacaacttgtgaatatttagttctggacattttcctaattaacatttcgatgcaactatgcaaatgaaactgaaggaacatacttgtcgacgattttgtaggcactccaacagggatgaagggtttttttggcttgatcaccatcaatacccttctccaattgagacatccagaacagagcttccttctggtatggttttagaacggagacaagagtgcttgggggctctgcttcctgtattccacagattgtttaaaatcataacattgttcatatacaaacattccgatagtgcagagtggcaatcaaatagaggtcttgttcttacctccaagtcatatgtttcagcagtgccaacaattttgtttaatgcagcctctgaaatagcttgctcatcagtgccttgctcaggaaatgtttggccagctgtgcgtcggttttccaatccaactatagccatgggttcatcttcatcattgtcatcaccctagttcatgtatccaaaacaaaaagatcaacaaaaagcacataactcggaaaaagatattacatgctagcagaaattatcacggtaacaattcataaagtaatttagatcaatgccacaacgaagtacattttgttttagcaatcaattaagtatatttaatcaaaggcttgctcttctgtactacatgctacagagacatacgattgaacaaataatcacagttcacgattggcaagagaaattgaagctcacccttagattccgcggtctctttcctgcagcaagctcctcaggagtgatatcagcctgcccatgacacaagcattagcatatacaatcatcaggatcaagagcactacaagaactgaagagtttcagggaattgacatgagtgctaccttggtgaatgcccttagcttgagcaatctgaacagcctgtaaagagggttagtggaataatcaacatttgcaggagcaagcaggtcccatgatgagttgttgccgcttgcggtgaatacagaacggtggatgtagaagctgcagaaaaggaaaaaaaaaaaacattaccatcaacaatttaacacaaatcatcacaatgacacaatacacaaactaaaaaaaagaagaaaagcaaacatgcataatcaaccattacctaacatacaacaaaatctcctgcatcaatctcaattccaccgtgggaaacacaatcttcccctgaatcttcaccttggatgagcttaccagtggcacgaggcacttggtccattctgtagatagcttcccaatctacaataacaatgaaaaataacagaaattaatacaatttctcacaaataaatcaaccattaccaacaacattattagaaatgaaatgatagcatcacaagagcagcaaacctctccagctcgattggtggagaagcgcacgatctccgccaaagcagccgccttcttgttcgacaccttgatcccaccataggtcctctccaatgaggggaacgagaaatggacgagctcgccggcgtccagcctccgcctcccgcggttggtggacaggccggtgacgtacgacctgccgacgaggaaccagtcgcgctcctcggggaactcgccgaactcggcatcaggcggcgccaccaccatcctcagatcactcgacggcggaggcggcctggcacgcacacgccgcgactcgagcatctccatggcctccggtggcggcaccgcccggatcggcctcgggttcaggtacggcaccgggtgggtcgccgtgaggtcgatggtgtccgcctcgtcgtgcacgcgagacctcttcttcggcctcggcaccaggcttatgccggcggcgttcgccgtcgccgcgcctcgcttggccgcgacgccgtcttcctccttgacccgatccggcatcggaggcggcgctttgacgagcagctcgtcctcccgctccttcttgaccctcgcggagcagccgttcgattcttggctccccaggggctcgtcgtcgaggacctcaaccttcaccggaggcggcggcggcttcggggcggcgccaccagcgtcgcgttccgccttcaccggaggagcagccgtcttggcacctttacccttcttgggctcgggtttgtcctcgacgccggcggtggcgtcatcgaggagcgcgttgatggcgcgctcggcgttgcctccgcagcgggagattgcggcgacgacgcgggcctcggggaggcccgcgccaagaaccgcgcggacggcggcgatctcgtcggcgtagagcacctcctgggacggcgactccggccagtcgccgtgcatgtcgtcgccgccggcgagaacaacggaggcgggtggatggaggaagggattgaggcggaggcggaggaggaggaggagaggattggggatggagaaatggcggggactcgagatgggtggtgggttttaaaggaggtttttcgcgggaagagaagaggagggaacccggaaatgtttttggcgcgagaggcaaatttttaccgcggttttttgagggagtaaatgggtgggagattggaaatgacagcggcgttggaaattgcactgctcggcctcggtccatgcgttggagtggactggatttgtcacaaatctgttcgaatttctgttgaatttttatcgcccaaatttagagcttcccctcacaaaaccgcccagtttatttttgattttgaaccaaactcacaaaatattgtgaaactcgttatctcgtcttgggtgttgttttctgccacgttgggtgggtgaattcaggttgttacatgttcttaactataaaaaaaatattgaaaaataaactacgataaaaaataatcccaaaatctaatccaaatttaatgttgaaaatttcaatttttgctgataaatagtataagcataagctaaaaatgaggccaaatgtctttagtgcgcgtgcgaaactattagtaatttatttgtctttagacctttacacatgttgttaaggatatccaggtagcacatgtgcatcttattatcatagtgtcattcagattccagttgactggctacttggttagtttaggactttaggtcagcggatcattgtcacgttgacttctcgtctgaccagtgaccacaaagggaaagaataataagggcatgtgtaaaaaatacaggaatataataggaatgcatgtgtaaaaaagatgattgaaaaatgtagaaaatttgtatgagttgatgttcggatggagtataccaaaaacacaggaatttttgttagataaattgaggccgttagaacaaaacacaggaattctcaagctaacgagctattctcagttgtccccatgcttggatgatgtgattagcagcttccccaagcgaaggaaatcaaaaaaatgagctgtgagtagatgggaactttcctgtgtttctgccatcaaatccgtagcaaaggaatattgcctttagtattcctatgactcgttccagggatgatccaaatgcggatagcctgatacagtgattcaatccatatgaatcaaaatcctacacttattatccttcattccaaaggaggcctaatacttgtacatgttcttgtgcaccgcctagcatatccagaaacatgaccacggtggattaacaatgagatactccctccgtccctaaatataagggatt

SEQ ID NO: 67204 - DNA, 14431 bp, Oryza sativa
atcccttatatttagggacagagggagtactatttaaagataaattagcatctttcggctgataaactgatgtatgaagaaataagtgtgtaaacatgttcacaatgaatccaaacgtaccgagaggtatattgggcaaagctcttctgaaaatgaagatccacttcaactttttctgagcggttggttcagatccaatccaacaaaccaggatggaccccaaaattccagttagagagttgttgccgaaggagcacccaggccatgatgccgttccaaacttactttgagaagaagaattggacacaataatcgaatgaagaatcccatggtttccatatcaaacttgctgatgcaggattgatcatctcccaaattgcacatggtatgcagaattgcagactgtatccccaaaggcattccacttccatctgactgtatcctcgaattgatccgccaaggacaagggtactttgcaaaagcagtttccaaatgctgagatatacggtcagaagattacttgagagatcatgtcaaatgtcttccacccgttgctcatttcgcatcgcacaaaagaccatactgttcttccttttttgagtgtttgtatggatttggctccaagcttttgaatggtcgcagtccggtccaatttgattgcaaaaagattgccttgtgactacaatgacaacatctgtgggtgcagcaaatagagcttggcttgtgtgattgtgtcattgcaaggagtcgatgaacctactgatgggttgtttcgagcacctcattcataccactaggccaagtggatctggagagctctagcaaatttctccaaatatggtacttgaagtcctccaaattccatacatgagcatgccttctgccaattcactttacattttccaccatgaacctcctcatcctcagccaataaaagtgccttctatccttgctgactttccggaatatggccaagacatgggccaaggaaggcaaaaactctacttttgccaacagccaagttaatacaattctaagaatgcgtgaaaaaaatggcatgacacctgctcaatgtgaccatctagccatgcagtcaagtttacatgtctgtctgtttaccagagtcaggcgaacaagcagagcaactcaggtgaggatcatcaaacagaaaagatactatacatagccctcaagcagcatgcatccatttacctccttgtgctccacatccttcagtggaaatgactagctcccaccaaacgccaggtgacctggccctttgaggctttttttagagaaaaggccgaaacgaccctgcttactgcttatatagaaagcaaaatttgtccttgctggggtttccagcttacatcaaagtgcatacatcaaccaaaggggacccctccggcccaactcaacaggtttagacaagagcgtatacagcagacatagcagacccctccaacaaagtaccagaccgtaagaaactctaactaacccaccccagttctagcatttcgcagttcagcacagcagtcctttagtcttcttgtcagcaactccagttcatcagtctccgcaactttgaagagtggcctccactgcattaacaaagaagtgatttggaaagggagtattagtggggagtaggttattttatcacgaaaaaccatgttatttctggtaatccaaagagtccaacaaacagcagcaagcagcgccaatttaacattcatgtgtttgaaaacagttctgagctgagctaaacagaaaaaatcatcgaagttgacaggtatccggtcccaacccagcacatctctacacaaacaccaaacaaaagtagccatagggcatctgaaaatgatatgttttgttgtctctggctccccacagagtaaacacaggactgaaccactccaacccttttttgctaaattagctgaggcttgaattctatctctcaaacctaaccagatgaagtgtttaatctttagagggcaaggagcactccaaagctgttgtaattgggtgtctatcatccccctgaaagttaaaactctgtaaagggactgggtagtgaaggttttattatcctttagagcccatctcaaagtatcataagtctggctagtgctaatgttctcaattatgactctcagctcttcccattcatccatctctcttgggccaaaagatctcctaaaagacagcccctctatcccagcctgtttgatttcagccactagtatagattgttgattgcaaatctcaaaaagtaaggggaaagatgtttttaaaggacaagggtgaacccagacatccttccaaaataaaatgtgtctaccatctcccactagccattctgttcccagtttcacccaatctctagtgcttagcactcccttccagaattgggagccctcctcagctctgcactggaacactccaccctcttgaaggtatttgttccttaggagggaagtacacagactttgatccggagattctagtttgaaaatccattttgccaacaaagcaatgttcatagctctagtttcagtaaagcccaaacctccaaagtcttttgggaaagccatatcctcccatttcaccatatggtatttcccatttattttgtttccagcccaataatatctccctctaaccgaatcaaatttgtggtgaacaccctcagggagggaataaaagcccatagcatatgaaggaattgaagataagcaggcattaatttgaatagctcttccagcatgggataggttacccatccatgttcccagtcttttttctaacttctgccctttgaggctttggtcactgtccagataggcaggagctccacaacaaccttctgtaccagcttctcctcctgaaagtttttcagaagatatgcaaagtctcctccagcctccctaaaatccaccaacacactacatagccctcgctgggcgagaatttcaagaatgaactccaagctcatccgatcaaggactaaaacttcaactcctggtggcttcacggtgacaggactgtcagtcagaactactgcctcagatgcgcattcttctctgagaaactgaatatttaattgggaatttcctccctgtgctatgatgatataaagaggctgctttgcaccagcttcatgggatgtaggcaaggtagtcatattgaccgaaatgcctgaaattatgactccatcatattctttcagtaactgtgagtaataccctccgggttgatcagctccagtcccaatttgatttacgacgactccattcacagagagcgtagttctgttattcatgtggcagacaaaccatcaccgaattgcacactgtatttcaaatgaaagggaaaaaaacagcatgatatgtcgtggaacagaagatgacaattattgcactaacatagcttaatcagttagcatcctaaatttggccaaaccacattgtagaagaactatcgcggtagatatgtaacattgtttgcttgcaaaaattagctacaatataatacgcgttagcagatccataattgcaaaccatgtgtactgccattacctaattaaataagtgcctcaagaaaaagaaaaagaaataggaatatggttgcatatttacctcaaagttgcaaaggccttcccagtaagcatgcaatggatataagcctcatttaggttgcggcataacgcttcttcctccatacacaccctgacatcaatcccagcactttggagcctttcaatccccttggatgccacaataggatttggatcagtcatcccaaccacgacatccttaagtttggcattgatgagtgcttcggtgcagggaggtgtcctcccgtaatggttgcagggctccaagctcacataagccgtcgcattctctgctaaatccctagcatctctcagagcaaatacctgcggttggtaacactactatgttagtatactagtatcaacttcgttataaatcagcattaagttttctaagtaccaaacggacatttttcttttccataatcatacactgtgcactggtttttacaatacagagctgcaatttcgctcgttgtattaatatctactaattccttaattttttcatacacacatcttacaatgttacagatggtgtggcaaaaatcaagattaggcacaatattctatcacacattgtgcgtgatgattccatctggattgaacggatgtgaaaaatctcgacattcttaatcttgcacgaagcaacactaattaatgaataataatgatataaaaaaaagccattctattattcatgtaccaaactctaaaatgagagttcgagaaaggggaggcaacctcggcgtggggctggccggcttcggggtggaacccctcgccgacgacgcggccgccgcggacaacaacgcagcccaccatgggattcgggctggtgtggccggccgccttgcgcgccagctccacgcaccagcggatgtagaccccgtcgtcgtccatgtcggcgcaggccagccgcggcgcacccgaccgggaggcgcgagcggcgaagggaggtggaggtggaggcggcggggcgcggggtgaggtggtggcggcgcgagagcgagacgggcgaggaggccatggccgcggcgccgaggaggagaggacgccgttggaagtcgccgcttccggcgaagggacgggcggacgggggtggcgccgcggcggaagcaaaaaaagaaaaattacgagacctgccatttcgttgatctcctcctctcttgtaatgacacgtggcgtttcacaatcttaaagcaaaacgccaacctaagagcaagtacagtaacgggctacaaatcggtaataaccacacccacacggggttaccggtgaaaaatcacgcactcgattgtcgatttccttccacgcgcaaatcaatcgccatcccttttccttcgcaaccttcctccgcacatcgccccatctgcctcctctgctcgccgcaccaactcgtcctagcgccatcaccgattcacctccagctgccgccaatccgcgctcgcctcaccgtagatcacgtcaccgtccgttatccaccgagacttcattaggtcatcgtcacaccacctcacccctatccccgccagtctccgtcgcgccgtccggtccgtgggctcgctctcacaccaacaccgtttcctataccggccctcacgtccggtctccatagctctatggcaagtttgcttctgctgtccagtttcagtttcttctccctcccagttcattattttcttttgcctatttgattttggctacgatgaacgagagcaaaactattttgtcctgcacaggagatgttcgattgagtgccgcataaacaatcgccaacactcttagtcaaacattttgttgtcgatggtaggacaattttaagggcatgtttagtaggtgaaatgaaaatttttgagtgtcacatctgacgtttaaccggatgtcggaaggggtttttagacacgaatgaaaaaactatgcaattagtttttctttttatctatatttaatgttccatacatgtgtctaaagattcgatatggtatttttgcaaaaagttactggggaatttaaacagggcctaagtgtccgccaccagtgatgtgcactagggttcccgatcttccaaaatgttctgataaacaacaatttgggcggagtcgcaacacaaatcgatccggcttcttgaacgcacacgctcttgagccccgcaatcgcagcaccacgtctcttctggttatcacccatgtcgaaacgcggatgacctcgccgagaaggctaatccctgtttgccaatcgaagaacacaaacaagaacgagatagaaaacaagcaaaattgcacatgaatgattaagctcacgagttggggtcttacaaaccgatctagcggtgaaactgttctcgacatattaatctaagcaaaacccaaaaacctaaagatggcggcgggtactgatatatagagtttagggtcatgcaaccccctctcgacacaaccctaatgggttccaacacgataaataggccaaaggcccaaatacggtgacgcagcaccgggacagattctggacgtcaacttattcggtcaattcccattgactcggaaagaatttggacgtgcgaccaaaaccaatggaaatgttatcttcttagctttccatccatataaaaaacgccccaatccgagcacgtatacgacctggcgcccgttttagtgtagactggtcctagactccgaattacacccgacgtcgacttggtttgggcctccaccttgacttggacatccttgatgatcctccatggctctaagtccttctccaagtgtctccttgttccctccattgtttctaatcataatataatcattatgtagcaatctagtctcgaattcatacaaagaggaacataagaacgagctcacctctaaatttaattgtcgcgtacgagctcttgttatcggtctttgaatgaccgttggaagattgttgtgtgtatccgaggtagtgatgtccacatcatccagaatgttaggtcaaccaatttctatgaggaatttgtcaacaaataaaaaaactccaatttagtctgcattacttgtgttgagcatgtttatatctcataaatgcagacccgcaagaggtttgctctgattgtgacaacacgtcagtaagcaaggatgataataaaataaaaataaaagcctgataagttccttgtgttttcatgaaagtattttttaaccaatataaggatctagccagatgcaccaagatgaataactaactttctaggcagcagatctggtacacacaaaagagatggttagcaaaaattgttcagagaaacataaagtttgcaattttgcccctgtgtttttttaaatgaagaggagttttgccgctggcttggatggctggtttttccacaggaatccggcactcccctcccctctgctggtgggcgaggaccgaggagtatatcgatcgcctcggattcgcacggcgtcacctgatccacaaatcacggctaggcggttttaatttcctagctaattgcgttggtaccattgcaaacaccagaacgtgatcaccacctgcaattctgcatgcccattgcatgcaagccgctagcaacaacctacaaagaacaaccagctggaggacgcaaaagctctcgtacgtctcgtttggcgcaagaaacgcatatatacgcacagctagcacacataaaggtctacgaaaacatggggggcgacgcaactgcgatcaaactgcaatcaggtctctctctcatgcgtcccagctgctacttctgctagctcgctccaatccgcgtatgtcgtcgagcccgcgcgggttagcacgccgatgggggagttggagacggtatcgtactcgctggaacccctctttttaattagtaccataccgtgaatttttattgtgttgaagccacataaaagagggcgtatctcaatcttagctgcctggtctggtagtgcggacttgtaaccccatgctttggggggcatggagttggcaattgtgctagtcgtttcctagtaacaaccaaatctaaaagtcccttaataagggagacaccctcattttaagggagcctgcaagggttcgaccccacacaaagtaaaaaatgtgctggcgtcgtaaatggtttggaattgtggcagcaagtcagcccgcccaaactggatttcggcctcctagctagagaaaacgtacccagcctcttggtcaactccacatttttttcttctctctgtcattcataaacttcttgggtttttttaatgtcttcaccagcaagctaacccgctcaagaaaatgtcaactccacattttttccttctctctgtcatttataaatttcttgggtttttttaatgtcttcaccagcaagctaacccgctcaatatgtcattcataaactttttgggtttttttaatgccttcaccagctagctaacccgctcaagaaaatgtcaactccacattttttccttctctctgtcatttataaacttcttgggtttttttaatgtcttcaccagctagctaacccgctcaatctatcattcataaactttttgggtttttttaatgtcttcacgagctagctaacccgctcaagaaaatgtacccagcctcttgtccacactgcattttcttttcttgactagctgtcattcttggatttcttaggtttttttaatgtcttcactatctagctatctttcttgggatttgttttgccgccttcgctagttgttgttagggatttaatcacttaggtttttttaatgtgttcactagctagctgtggttcataaatttcttggggtatgttttgccgtcttcactagttatagtcaaggatttaaatttcggtttgaaatttcaccgataagcagatatctcaacctgaaattctcggccaaaaagaaggaagagaacgaaaggagaacagaactcggggcagggttgcgtgtgcgagccaagtggcgtaggtgcatttaccaacaccaaaaatttggtgaaggccaaatggtgatagcgctcacctgatacttggactcgaaggggagcaggtagtgtctagagattttttttttcttttctgccttattcactcaattcatttcatgttgatagctagttcgcgtggacgaatgaggtaattcctctccatatagtggcacatcactagcctttccttagggcctatacggcaagagaagggaaagtgaatgggagtttgaaggaggggattgatggtaggattggtcatgagagttacatttttagtccccatccttggttttgttttcgcgtcgaattccctccgagtcgcacgaattaacatgcccttggtaagggatcggtgagagttggaccccttaattccctatcccaaaccctctcaaattcccatgtcttccaaccaaattacaggcttaaactctcagataacctaaactcccattccctatcaccaactccctccaaccaaacaggtgatgtgcgcaagggtgtcccgatctttcgatgagagggataagacgattggatggagcgacgttggcgatacgactacaactatccagggatgttgtgccttagcaatcgttacaccaactccagaggtggtcgtgaatcttgacggatgcacaatcacccaaccacgagggtatttgttcctgcaagcaatcgagaaccagcaagaacaagatgaataagcaactcaatttgcgaatcaaagatattggaatgaatcaacaacagtaacaagtggggttcagtaacaagcaattcggcgatctaatcgatcacgagatcaactcagcaaagtagcgacgctatactttgatctaaacaaaaccaaagtgttcttggcagtggctagaggtataagaagaagggaagaacgaccacagggtcgtgctcaaaccctaggacgtgcccctaatgggcccaacttgatacacaatccattgggccaaaagaggtgacgcagcaccatggacagaaaatagtcgggagtaaaataaaaattgcggccgctccagaatagatatggacatgtggctagatccatttgaaagtagacctgataagctttccatgaagtacttgcatgcacaaatcggagttcgcatgaagtcctggcggccgtcagaagttagcgttgtcctgcagtccgaatccaccccgcgcgaatcctctcccctttggatcctctccatcgttcctaagtaaaacaagagtgcacacgtctccggggtataaagaagaggaacatgaactcaagaaagaactcacctgatagttaagttgacgtgtacgaacgcgggtaataggaccatgaagttgtacttgtggggacgtggatgtatcgatggtgttgatgtcctcaacaggttgttagggttgggaactttttgtgacaagttgacaagcacgatcgcaacacttaaacgccttgcggtgatatggagtcgccaaccacctcggtctagccaaaaggccaaatcaagatgggtttttgtagaaaacggctaaaccggctagtgaagctgatttagagatcaaaatcagcctctaggccaatttagatcgatatgagataactatccatctcgtgggcaaaatggaaggttttcaggacaaacctacaaagaggtgtcgcactctcgtggcggcggcggactatttacggcgcaaatcgacaaagatggactaaaactatgataaaatagaaaatatggctaaaaagtaaaggtaaaagaaaaagcgattcaagtggattgtatgttcggggattacaattgaaccggccttatcccttaaataggggttggttttgccctctacaggccctcctccacatccaactcagaatagaaaccaaaggaaacccgaaaatacctttccaagcaagaaaacccaagacccgatgaaaatagactcgggctcgaaccctgacggtctgcccggccacataattgcggtcagaccggagttcaggccgcagtcagaccgcccatataccggcggtctgactggccctgacggagcgtggggctcctcaccgggagaccgcgcaggcccccctttgccggttcggccggggactcagggtgagattctaagctctctgtatgtggaaggttcgcgagacaggaaacacacaagacacgggcgatgtatacaggttcgggccgctgagaagcgtaacaccctactcctgtgttttgggagatctgtgtatgaaggagctacaaagtatgagccagcctctcccttgttctgggttccccctctcccccaaaagtccagtcccagtgggcaaggtcctccttttatatcttaaggggataccacatgcaccatttctctcttttttgtggggacttaccccaccttttcataaatggacggagatttgtatagttgccgtccgagtcaccttctgatgagacggcccacaactacctccactttcgctgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgtgtcacatcctgatttttgtttcaggatttataaattatttaataaattattattagaatttatattaaatgttcattaatttacaagtgaagttaaatgtgggaaataaaatttcctaaatttaaagcatggatggatttaatttttattaaattctccatggttaattatactctctggaatattctcggatttttcgaagctcaattcctaatttttaatcttacaaagagtatttcagtaattacccacatattaaattaatcattaaatggtctaattgtaatttttttaagtactttgagtgtccaagtattttcaggatttttcttgaaattatttgagcattggaagtatttttaacaattcaaagatcatttcattgattaatttaattggaaaagtaataataatcctcttcctagtcttgggccctttccagcccatctccctcttttgtgtgcacggccgtgcagcccaagtcagcccagccgagctcccccccttctctttctttctttgctttgttttcagccagcccaagacaaaaagtctaatttgcctccctcgacactgtttatcttctacctcaagcagccgaactgagaccgatttggctcggttttttctcctccaaatctgacctttccccttgtgtttttctaaaattagttgaggggaaatattcctcttatcctcctctatctttaaccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgaggtcatcatgatgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactatttatttggtttttattagtctttttctttgttttgcgtgttagcttgtcgtttccgtcgttgcgaaggttcgtgagtgcgtcaggagtgttcagaagattaattgaagaccgattattgcaaggcaagtcacacagatcctaaacacaataatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcatatggttttgagagtcgtgctcatgacaattaaggaccggttcgcgagctactgttgtgagacatttaccgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgtggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgtagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcacatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgttcagccaaaccgcaataaatatggttaggg

SEQ ID NO: 67205 - DNA, 6608 bp, Oryza sativa
ttcctgcagcccgaccgggcagcgtgtgccggtcagaccggcggtgattgagcggtcaaaccggccagcccgcggtctgaccggtcgacgctgtgtcggtttcggttttgggttgtttatttagatatccgtgattatttcatgattatgacttctagatggatactatacgtatgtaatactgttatttgctactaatgagtcaagttggagatagtttggtctcggaatatggtttatttatttatttcatgtgtaggtgacttgatgcctcgggagagtatttgcggtgatggaccgggagtcaacttagggataagacgacgtccgtggtggtcagagatcatgcgggatacttaggctagagttgatgcacgtggttgatggagattccatatggtatacgatggaggtattgtgtgcatatgggatgcggagtcgaatttggaaggagtccaaatttggtacgattggttatgtaaagtttgtttcttgtactagagggtttcataaggtatttaggactcctagtatgagtttggttcgtggctttaggctgcctacctcatgtataaatagagggggagcgtgaggcttctcgatatcgctttagagagcaattgagttgagttttgagttagggtttcgagtttagtcgaaatttttataaggagtgttgttggtgcactctgtaaacacagagagaagtaataaagtcgtcatccactttaagagttcttcgatttgtgtttcaccgggtttcagcggtctaactggcgatataccggcggtcagactggcggcaagcggcggttagaccggcggcatacgggcggtcagaccggcggcggcagcaggcgcggtaggcatctcgacggttcgaccgattgatctacatcagtcagaccgatgttcattaggcggtcagaccggtgcatacacttcggtcagaccgcgatccgtcgaattcgagggtaacttttatttccgctaaaagttttcggtttttgggtataccaaccattcaccccctatggttagcttagttcttgtgatttgatcgtacaaactgggggtattacgcaagtaatcatgactacctaaactatagttgtcgcactatcttgtcagaccgtctatttatttatagtagtagagtcaaatattatccatctcttctaaagccaatttttggaaagatgatacatctaaatccaaaaaattaacttaatcgattacacttgcactataatccttttgacactaggctgacatggcactatacattattttactgtcgacattagacaacccagaagtgtgctcatatttttggtacttcctatgtttcacaatgtaagattttctagcattgcccacattcatttagatgttaatgaatctagatatatgtatgtgtttagattcattaacatccatatgtatgtgtgcaatactagaaagtcttacattgtgaaacggagggaataattggagaatgatttagaatctaaactcaaaagaccaactttggaaggtgtagaggcaatttgttaggctttgtggcttagtaggaataacatagtttttaacagctacaatcatatttctttcttaaaggtgatattcaagacaactcattggacaaggttttggtctttgcttcttaaaaatgttgaaggagaggaagtacacatcaagtgcaggattctgaagaagcgagttatggatttttttcgaagaattgaatcttagcctttattcctctttcatcggttgttaaacttttatttgtatgttcctatgtaatgggagaagtcttgtgtactcgtgactagggttttggctgtatgcaccgcacaatgtgtagaggacgggtttaatataatccattatctaaaaaaaattagacatgtatgcatgcctagccgtatctcagaagaatacacgctgaacccacgttggccagcagctgcgtctcacgcacgatggccatttctctgtaacgcaaatcgtgcgttacgtacgaccaatcgatatgagtgcgagcttacacgaccatgcacacacaatttgatcaatatttccttttaaaaactcgtatgccgggattaattctaaatgcacgtactagctctgcagttcgaggcacccccctatatatacctaagctatccagctctagctacttcgcgattagctatagccatccatcgatcgatcaggacaccactgattaagccatggcaaagcttgccctgtgcttctgcgtcgtcctcgtcctcgtcctcgtcctcgcttcctcgccggcgccgctctccgatgatcgccgcgccgccggcctgctcggccgccgcggcctgcagcaggacgccattgtcgtcgacggcagcccgacggcggcggccaccgccaccacgacgacgacgacggcgtggccccggccggacacgccgccggataactggtacgacgggacgaagaggctcagccctggtggccctaatccacagcaccactgatgaacacatccatccacgcatgaattttgttgacagtgatcatatatatcaccactgtcagttaattacttctaccacaccattctctccacatgattttgcatcgctaattttaattttatagcaccggcgaagtaccagatcggagtttaatttctcgatcgatgtgcgtgtgtgtgtgtttccgagttaataaacctactatataggcagaccgatatttctgcagacagggactaaagatgggcgtcccaagagtgacagatgttgatttagcacttgatagaagtgtgatcactgaaaggaataaacgagagctatgtatgatcagttcgaactgatcagtaatttttcctcaatgttcgtgaattatgttctctttcttttttatatggaaataattaaatcctatacacaacaagatgcagtcagcctcaatatgtgatgacatgcactgaaacttttagttattcatgtttgtgatgacatgcaataaattttatgccaatcagcctaattaatgagtcttcttgcaattgaattttgagatgtgccgtgttgaacgtactcttaatttggagatctgagctgagtggtaattataatagtcaaatatagttttttgtttctagtcgctatagcttacatgttcttggagttcctttttaagcgagaaagtggaatgtttgtttgatccataggaccaccaaggatatgaaattatgcatgctttttaacttttaatcgtcttatgatccgggaaagaaacagcacctctgtcctcttgttctttccattcaaaagaaaatataaaacaatagagtttgaacactctgtgtcatatgcctcaaatcggattaagaaaggcatgagcaatggagaccacaaataaatactccctctatttcaaaatataagacacaactacttttcttagatgtttcataatataaaaagtgcatacatgcatgtaattaactagcatcttttctccaccaattattatcttgaactctttcactctcaaaatctctaattctattggatgcatgcattatatttcttaagatgatttcaaacgaagaggtgataataattgtttcttagtctttggtttaatgatggttatgccttattttggagtgagtagtgatctcattatgtcatgtggactaagaccacacataagttatgggcttcccaatgctgagtggtttgaagtgggcctattcaatccaaagcaaaccatggtccactgagcccatgaaaccactggcacctggcgggattatccactcaatttgatggactctcgtgaagtcgcgagtctccactcggtcgtagccatcacctcctcccccattgttggtattacttaactttatagataaaatttgcaagtgaacggaaaataccgatgtagcacttcacccgggagtattctcaggtatcgatttccacaggaaacgtgtgtgtcagctcttctccaggttcatccaaggacacaaagctaagataggcaaagggtagagaggattcactggtcgctttactacgtactcagatagggaggacttagtggtcttacctctacacctacctcacacctactgtgggatgcggagcaaagaccaatcaactatctactacgtacccagatagggaggacttagtgatcttacctcttcacccacctcacaccttctgtgggatacggagcaaacaccagaaatcaactatctactacgtatttggacagggaggacttagtgatcttacttctacacccacctcacacctactatgggatacagagcaaacaccgcctactgtgggatacggagcaaacaccggaaatcaactatctactacgtatccggacagggaggacttagtgatcctacctctacacccaaatcaacccttctgtgggatacggagcaaacaccagaaattaactatctactacgtatccggacatggaggatcttaatgatcttacatctacacccaaatcaactatctactacgtacccagacaaggaggacttagtcaaatcaactatctactacgtacctggacaaggaggacttagtgatcttgagagctgtcaccaggtctacacccacctcacgcctactgtgggatacgaagcaaacaccggaaacctctacacccaaatcaactatctactacgtacccggacaagaaggacttagccaaatcaagtatacacctactgtgggatacgaagcaaacaccggaaacctctacacccaaatcaactatctactacgtacctggacaaggaggacttagtcacctcacaccggaaacctctacacccaaatcaactatctactagtacccggacaaggaggacttagtcacctcacacctactgtgggatacgaagcaaacaccggaaacctctacacccaaatcaactatctactacatacccggacaaggaggacttagtcaaacctctacacccaaatcaactatctactacgtacccggacaaggagaacttagtcaaatcaactatacacctactgtgtgggataccaagcaaacaccggaaactgggataccaagcaaacaccggaaacctctacacccaaatcaacggacaaggaggacttagtcaaatcaactatacacctactgtgtgggataccaagcaaacaccggaaactgggataccaagcaaacaccggaaacctctacacccaaatcaactatctactatgtacccggacaacctctacacccaaatcaacggacaaggaggacttagtcaaatcaactatacacctactgtgtaggataccaagcaaacaccggaaactgggataccaagcaaacaccggaaatctctacacccaaatcaactatctactatgtacccggacaaggaggacttagtcaaatcaactatacacctactgtgggatacgaagcaaacatccaactatctactacgtacccggacaaggaaacctctacacccaaatcaactatacacctactgtgggatacgaagcaaacatcggaaacctgtacacccaaatcaactatctactacatacctggacaaggaggacttagtcaaatcaactggacttagtcaaatcaactatctacctggacaaggaggacttagtcaaatcaactatctctacacccaaatcaactggacacctactgtgggatacgaagcaaacatccaactatctactacgtacccggacaaggaaacctctacacccaaatcaactatacacctactgtgggatacgaagcaaacatcggaaacctgtacacccaaatcaactatctactacatacctggacaaggaggacttagtcaaatcaactggacttagtcaaatcaactatctacctggacaaggaggacttagtcaaatcaactatctctacacccaaatcaactggacttagtcaaatcaactaccagacaaggatacgtacccggacaaggaggacttagtcaaatcaaatcaactatctactacgtacccggacaaggaggacttagtcaaatcatctatctactacgtacccggacaaggaggacttactcacacaagccccagccatgcgcgataccattctgtaacgtcccgcctaggaggacttactcacacaagccccagccatgcgcgataccattctgtaacgtcccgcctctcctaggtcgggcccacttacgcctctcccagatcaggcccacttacatctgtaacgtcccgcctaggaggacttactcacacaagccccagccatgcgcgataccattctgtaacgtcccgacctggacaaggaggacttagtcaaatcaactatctctacacccaaatcaactggacttagtcaaatcaactatctaccagacaaggatacgtacccggacaaggaggacttagtcaaatcaaatcaactatctactacgtacccggacaaggaggacttagtcaaatcatctatctactacgtacccggacaaggaggacttactcacacaagccccaaccatgcgcgataccattctgtaacgt

SEQ ID NO: 67206 - DNA, 19935 bp, Oryza sativa
gtacccggacaaggaggacttagtcaaatcatctatctactacgtacccggacaaggaggacttactcacacaagccccagccatgcaggataccattctgtaacgtcccgcctaggaggacttactcacacaagcccagccatgcgcgataccattctgtaacgtcccgcctctcctaggtcgggcccacttacgcctctcccagatcaggcccacttacatgtgtaacgtcccgcctaggaggacttactcacacaagccccagccatgcacgataccatctgtaacgtcccgcctctcttaggtcgggcccacttacgcctctcccagatcaggcccacttacatctgtcgtgcttttataggtcttttctgcacactttgtcctcacccatgcgcacccgggaagaatttcccgatcagtcacccatccctaaattgctctaggccaagcacgcttaacctccgagttctttggaatttggctttcggaaaataagttgcaacttgttgagacgggtattctattaatcctattaagtcctgggacgggatgtcacatatattcaattaaagcagagtaattaacaagatacaaaaagtaagaggagattaccgacaactccggaattcctccgatttcttctaccttactctctcccaattctaatatacaataaagtacactagagcctcttgtaattcatgtcatgcttcaagtgtgtgtttacaagtgagaatgagaggggtatttataggtagagaagtgccttgggagtgtagagatgctccaagcatccaaagagcatcttctcttatgtcatgccaagtgtcccttctgatgacggttggagcactggaaacggtcataaccgtcatggggaggttgatctctaccgaactcaacttgggcctgggccagcggcctctgtcagggttcggccaaaccctggccagctctgttggccccggttttcggcctggacactcattttgggcccctcattctattggtcaagatggaaggcccatttggaggtgtttaattgggtttctgggtccaaaatttcataagtttggatacgcgtttgattctcctgctccttcgtgtatatttcttgtcaacttaggtagtttgtcacctgcataagaatatgtactaacactcgtggaaattattagaagtaaaccttaccactatgttggatgttctacatttatggctttatgcaggtattgacggtgttaatttggtacttaacagtcgtcaacacccatccctccactgaagtcatctttgtcccaatcgtctcctcccatttcctgacactgaagcctgatcaatctccgtcaccatcgtttcctgcctaatcaccactagagccgatattggagccaccgcctttctcattcttgccgtccgattggtgtcagaaacgtcttcttcctcatctttgctattggattggagctggagctggaggccaccaagcggctcttcttgtagatcggtgaggtcaccgagtagatttgcttgtagatcagtaaggccgataactaggtctgctcggaagctactcgtcttcacggtgatagcaacaatcttctcgttgtcaatagtggcaccaccgcacaacagaggggagcaaaagaaggagaagggaatagattgcgttgtgtgtgtgtgtgtgtgggtgggggggaggggtgggggggggttggggggatgacctaacccaacacgcggatccgtgccttggttctaggcttcgcgagctagcgtggcgagggaaggttaccatgaccttagcaggttacacagtcgactcttagccccacctaccgaggcaaacttaatgtatgcttttttattttggcctgtgaaattaaggttggggcctaaaataaaaatggcatgcattaatataagctaaggggcctgaacctatataaaaatccttgtctagtatatcttttacctcaatcttgggtgtaccatgtgtctgggttacgggtaaggtatactctctaccctttgatatacgtcagatatcagtatggtatacttgcgcgtatacagacattttcggcatacgataaggaaattcatcatggagttcacagatggaaggagtcctactcggtcagaactgggtcgtcattgtatcgtgccaggtccgatgtctccgagtcctacttggagaccagttgacctgcgatataaaagggaccccccggaggacataaggcatcgaatctcatagccgacacatccaccacagcctacgaagccggaacatacatgagccaagtcgccgggtgatctagtcgtaccaactcgactacgatctcgttggtatcatcgagttccactattccttttgtaatctgtgatttccatcatataatcccatatcaactggattagggctattacctaccaaggggcctgaaccaatataatccctgtttcctgtttgcttgatgtcgtactacatagatcgtcgtaccagcgtaccccaataccctctatatccggtctacgggtatcccccgtcgacagtggcatgccaggtaggcgcacctggtgctcaaggttctactactatgacatccagcttcgtcgacaacaatgtcaacaccaacctcaactaaggagttcctacttcaacaacgctggtgtggactcaagtcggcgaaatcgtcttcccggtttacaccacgatgccgatctcagctagtccatcaatggccggaaacgagaacgtagtgggtacaacccagaacaactccctgtcgaaggaccctcccgccggagcggagattggaacgtcgacgacatccgagcccgagaaggatcctagtgcggccaaaccttgtctttttgacaagaatcacgagccgacgaggatgacttccgaggtgacaaggtcctggtgtcctatccacaaaaccagaaaacacaccttgcaagccagctgggtttttctcaacgtccacgctgaaattcgtgcctgcaaagagcgtggaattcagcgtacttctccaactcgtgatgtccattgtcctattcacaaggcaaagaatcacgacatctcaagctgcaaggtctttctcagcgccatgaagacgccacctcctaaggtccagcagtcacgcatccccctcagggataaggacaaggaacaaggagcgacgctgatttcagatcgatttgttggggtaatcgatatcgatccccacgaaccatcagtcttgcacctgctcgaagactatggcttatcatcaacgagtacgccgcgcgaggttctggctatcgacgagtccggcacgtcagcgcgcgctaatgcggaagcggaaaatcaagtgactacaccagcccagcatattagggtcgtcaacgcaatactgagggaaaccccctacgatcccgttctgaacgacgatctcgcacgttggacagaatgactacgggaatcagtgaccaacctcagcaacgcgttcgaagaggtcgctgccgcagcacacccggaacagccaccaactggtgatgctaacggtgaaaaccctgaacagcgggaatcgcctcatcgagccacccctccacctcgcggcaccggcgatctccgcgatcacctgaatggccgccgagaggcgcgacgcacacgagacaacgagaaccgttcccgacgtcacgtctcttcacggcgtcacggtaatgaagaacgaggaggccgttcgagtgaagaccgaggccgtgataaccgccacaaccgccacgatcatgacgatcacgaacggcgggtgctgggcgatactggtcaaggacgtcgccataatgacggcgatggtggagatcggcgctgagacaacaacgggagacaacgacaggattctcgagaacccagccgacgtcctcgtaatcgtacgccggaaccaagcgacccatcgtcatcatcgtcatcctcctcatcctcatcatcagatagacatccacgaaggacgtatgatcgccgacaacccaccgcccccagcgctgggtgtagagctttcggtcgttcacttcgagatgtccgatggcctaaaagattccgaccaggaacaatagagaaatacgatgggagtaccgacctagaagaattccttcaggtttcttcaaggtacactacgatgccggagcggacgacaacgcgctggcaaattacttgccaactgcattgaaaggctctgcacgttcatggctgatgcatctcccccctactcgatctcttcgtgggcagacctgtggcagcagttcgtcgccaacttccaaggaacttacaagcgccacgtgatcgaggacgacctacatgcgttaacgcagaactcggatgaatccttgagggattatgttcggcgctttaatgagtgcaggaatacaatccccgagatcaccgatgcttctgtaatccgcgccttcaagtccggtgtcaaagatcgctatactacccaggagctggcaacgaggcatatcacgactactcggagattattcgaaattgtcgatcgatgcgctcacgcggacgacgcactgagacgcaagaacgacaaaccgaagaccggaggagagaagaaatcaaccaaggatgcacctgagtcaagcaagaagaaaaatcgcaagagtgggaaaaggaaagctcaaacggaagttctcgcaacagaatacgcggaccctcccaagcgcgcagacccacaaagcagcggcacgaagaaaacatggtgccctatacacaagtcggacagacactctctagaagattgcctcgtcttcaaaaagtcgctcgcaaaacacatggcatcggaaaaaggcaagcgagtacgcgtggtcaagaaggacgctgaggcggctactcaggaatcggactcagcatacccagattccgatctccatgtctcacacatcttcggaagttccgcggcatactcctcaaagcgagaatataagaaagtggaacgtgaagtctgttcgatgtggcagggagctgcgcccaagatgaagtggtctgaacagaagatagaattctctgaagaagaccaccctaagactgctgtcatcccagggcgatatccaattgtggtcgaacccactattcggaatatcaaggttgcacgagttctgatcgacggtggcagctcaatcaaccttctcttcgccagcaccttggacacgatggggatcccacgaagcgagttgacacccaccgatcaacccttccatggaatcactcctcagtcatcatccaaaccattgggcaaaattacgctgcctgtgactttcggccaagcaaataacttccgaacggagaagatcacctttgatgtcactgaattcgatacagcatacaatgccatcattgggagaaccacactcgcgaagttcatggccgcatctcacaacgcatatcaagtgctcaagatgccgggaccgaagggaacaatcactattcaagagaatgctaagctggtagtgcaatgcgacaaacggagcctcgacatggttgagcacatgcccagcccacctgccacagcagaaccacccaagaaagtgggcaagatgaacaagacgctgaaaccagacggcgcaatcaagatcgttccactctctagtgccaaccccgacaagaccgtcaagatcggggtatcactaggagagaaataggaactcgcgctcatcaccttcctccgcgacaatgctgacgtgttcgcttggcagccgtccgacatgccgggggtacccagggaggtgattgagcacaaactcatggtgcgacccgatgccaagccagtaaagcaaaaactgcggagatttgcaccagatcgaaaacaagccatacgagaagagctcgacaagcttctcaaagctggtttcatcagagaggtactccatccagagtggctagccaacccagtcatggtgcggaaggccaacgggaaatggagaatgtgtgtcgatttcaccgacctcaacaaggagtgtcccaaggatcacttccctcttcctcgaatagaccaactggtggactcaacagccggttgtgagttgttgagctttctcgacgcttactccggctaccaccaaatcagcatggcgaaagaggacgaggaaaagacagcattcatcacgccgttcggggtattctactatgttaagatgccgttcggactaataactgcaggaaacactttccagagcacggtccagggcacgtttagcaaccaactcggaaacaatgtcgaggcctacgttaatgacattgttgtcaagaccaagacaagcgactcattgattgatgatctgcgggaaacgttcgacaacctccgacgatatcgcctcatgctcaatcaggagaagtgcacgttcagagtaccatcgggcaagctgctcggtttcctcgtttctggcagaggaatagaagcaaattctgagaagatcaaggcaatcgagaacatgaagtcgcctacaagactcaaggaagtacataagctaaccggatgcatggcggcactaagcaggtacgtcgctaggatgggagaacgaggacaacctttcttcgccctgctgaagaagtaagacaaatttgtatggacacaggaagcctacctatacttgttgcccccaacctaatgaagaggcattctttgcactcaagcgctacctatcaaatccccctgtacttgttgccccccaacctaatgaagaactattcatctatattgccgccacgccatattccgttagcactgtcattgttgtcgagagagagaaggtgcaacgaccagtttactatgtcagcgaagctctccacgacgcaaagacaagatatccacagatccaaaaactgctctacgcggtaatcatgacatcaagaaagctacgccactacttccaagcccatagggtcacagttgtctcctccttccctctcggtgaagtcgtgagaaacaaagacgttgtcggccgcattgcgaaatgggtagtcgagctaagctaatttgatgcccacttcgtgccacgaacagccatcaagtcccaggtactcgccgatttcgtagccgattggaccatgcctgataacaggtcaaacaaccaaatcgacaacgaaacatggacaatggcgttcgacggtgcactcaacagccagagagcaggggcaggattcatcttgacatcaccttcgggagatcaattcaagcatgcaattcacctcaactttagggcgaccaataacatagccgaatacgaaggactactcgccgggataagagctgcaactgctcggagtcaggcgactgatcgtgaaaggggattccgaactagtcgcaaaccgggtgcataaagattacaagtgctctagccccgagttatccaagtatctcacataagtcaggaagttggaaaaaaggtttgatgggatcgaggtccgacatgtataccgcaaagacaacatcgaaccggatgatctagcacgacgtgcgtccagatgagagccacttgaaactagcacctttttggacgtcctgatgaggccatcagtgaaagaggcaagcggcgaagatagcccggtcgcccccaacatcagctcgggggctacaaaggcagagcgcgccattgccgatatcgagaccacagacgactggcgcaccccactcattaaattcataagcagcgaagagttgcccgaggacgacgcagaagccgagaaaatatcccgtaatgcaaaagtgtaatgtatgatcggcaacgatctatacaagaaggcaccaaacggggtactcctaaaatgcgtctcgtccgacgacggcagacacctcctcctcgacatacatgaaggggtctgtgggtcacatgctgccggtcggacattaattgaaaaagcttttcgacaagggttcttctggccaaccgccctcaaagacgcctgtgacatggttcagcggtgtgaagcctgtcaattccacagtaaacacacaaggctaccagcgcaagcactccagactacccctctcacttggccgttctcgtgctgggggctagatatactcgggccattcacatgaggacagggcggctacaggttcctattcgtggcgaccgacaaattcactaagtggattgaagcgacacccacgggggaaatcaaggccgacaacgccatcaaattcatcaaagggatattctgcagattcggattgccccaccgtatcataacggacaacggctcccagttcatcagtgccgatttccaggattactgcatcaggttgggagtcaagatctgcttcgcctcggtttctcaccctcagagcaatggacaagtcgagagggcaaacggcatagtactacaaggaatctagactcgcgtctacgacaggctcatgtcacatgacaagaagtgggtcgaagaacttccatcagtactatgggccgtgcgtaccacaccgacaacgtccaacaaggagacacccttcttcctcgtgtacggctcagaggccatgctccccaccgagctacggcatcaaagtacacgagtacagaagtattccgatgaggatcaggaggagcatcgaaacaccgatgtgaatctactcgaggaacatcgcgaatgagttgccgttcgagcagccagctaccaacaggcccttcgccattaccacgagaagcgcatccgtgcacgcacgctttcgatcggcgactacgtcctccgacgggttcaaagccaagcagggcgaaaggcgaaacaagctctcacccaaatgggaaggaccgtacacgatcacacaagttctgcggccaggcgcattcaaaattgcagacggcgatggtcgcaagttggcaaattcctggaacattgatcaattacgtaaattctttgcataagtcaatagtatccatacttgttagacatcttacagcttcaataaagcctattttcaggtcaagaccacaatcaaagtgttccttcccgatgatcccttacccaaatgacacctagcattgaaacctatcctcatgtccctttacgccgtcttgacaaggcctccgaggaacctaagggaaagaccatgtaagatctagtcgtataaaagttctcaccgtgcgtatcaaccaagacgtgtaatcggaaagaaactttccaacttcacggttgggggctaggatcagtgcttgttcaaccgaggcaggtcaaaggtccaagagccttatcttccgagaagaattctccgatgacaaggctgggggctagggagagtgtataactcaaacgactgatcaaagtcgcgaagtgagaagacactcatacacactacatccagagtaagaaagcttagttagatagatttcttttctatttcacaagtacttcttacaattccatcaaaatccaaagttatattacactttttcccctaagacatctgtcacaggacacggagattaccaggaaggccaatgctagtccatcgactggaagaccttctctgccagcggcgccatcgacttcgccaggccatttatctccgtaggagttctccgagaacgagaaaacccttcgcggaggaactcgaggtgcagctgcggacgatgatctcgtatgcaagccaacacatgcccctcggcatatcggcttgatcgaccacactcctgcttgaaggcctcgtcaatgcgttgaccgatgctgtcgagctgggcgcaggccccattcagccacgagatgtatccggccgccgattcctcgggatccccacggggtactcggagctctctacagactcttgacatggacgtgcagcaactcttcagatacgagttgaaccacacctcacgacccccgagtgtctctacggcctggtccttttttacttccagcataattctctcgagttccgcgacctcaaacttcgtccttcaatactggatgcgacgatcctggtcagcaagcgcactctcgaggtttgctcagcatggaaacgattaagtcaagctgctcttctctcccgagaacacaacaaatcaagtcgatccagacggaagggcaaaggatatgataacaaagacaaccaacctaaaggagtcgtcgccattctcgtttccacaggcaaactttgatctacatcgcacctcggcacatgtggctcggacgcaagtgccggaacgatcactggcaactcaggctgcccgctttgctggacatccttgacatcaacgtctctacaaactacaacaaagtactcaagatcataatgctaaagaaagctaaggtgacgaccgcacacataaaggtagttggaaccaataagagttttacaaagcatgactaaggaatacaagagagctaagatcctactcttcaaaaagcgggaggatggactcccctagatcgccgacctcctccatcacatccatgcgcgcatcgctagccgccccctgatccaatatctttcacagatcgagttcaggttgcgtcaacctcacacacgcaagcacatggcacgcccaggtatatatcccgttggacgtctcttttctgatcctggccgcgtgctgggaggggatcacctccatcgctgttgccagttccgcgagcaaagatgtcagcgagaactcgtcgggattcgccgggatggtggccttgacgccgcactccccggcgagctggtgcagaccggtgtaggtgacccacagtgagccacagatctccgacaagtggttctcaagcttcgacatacggtgctcgagcccttgccgttgtcgctcattgccagccactagctcccgcatcttctggagatcctcgcgaacctccgccaaatcgcgcgctagccggtcggcgcgctcattggccgacaacgtcgccgccgccctcgccccttacccaaatatgcggatacataccaattcacttgttggcgaaggtcgcgtcatttaaagttcgacgtgcaagaccgtacctccttgcgttttagttcatggattttcctcccgtctccggaggtgatggagcgggcgtcttcggcttttccttccacaccttctttgatttcggtgcggaagatggcttcttctaagccggctgctctaacttcttggccggttcaggtgattttactagcgtcctccaataacggttcctgggcattgttgtttccttctccaggaagttttgcatgaatttcacaaggttgtccgtcttgggtggctccacttcgaccacttgaatattctacgggtttggcccgtacttgattctaaccatggagcattgttccgtcctcggttgaaactcaaacttttcctccttcccgttgaactgttgtgccccgatcgaacaggtgatcgtaggacaccccggatctttcttcttctccgggaacttgtggagtatctggttgctgcattgttctgtcagcttgaccacctccgttgttgggagcagtctcttgttgttgagtatgtccttgagataacgggcgtatgttggcacttgcatggcgtccaacaacggcacgttgatgtggatcttctggattacttcaacaaaacgggcgaattgctcgtccactgacggtttcctactccgttgagggaacggcagcaaccgtatgtcgtattactcctgcggcactgtcttttttggctgaacttccttgtcagccgagtcattagatggcgcttcttttgatatccctttagttcctgcagggttaggatatggcggatcacgagtggacttacctcctctccttgtgatcgccttgacattttcaatggaggagtcgggttgccccggaatcctcccagattcatttgcagggactaaagatgccaactgagctaactgggtctctatcattttattgaagctcagctggttttgaaatgtggaagcaaagccatctaatttgacatttatgttatctaggatcttatcattggcagcaagctttttgcttagcgaatcagtggttttagcttgcgcaaaaacaagatccttcaaggagggctggttagagaagttaccgttaatgttacctccttgataatatgggcatggttggttccacccttgacctccttgtggacggtacccgttgttgttgttgcccatgtacatcgcctcctcacgggtttccgggcaatcattcccagaatgacccgtgccaccgcagacttcacacgtaacgtgtgagtccaaggccttgacggtgcctcgtggccttttctcgtggtcgtccaagcgtttcatgaggaggttcagcttggtagcaagtaacttcgtctccttgacggtgtgcatgtctcgctgacgggtctggagtcgttcctcgctccaacccatattgaagaccattttctctattaattcaacggctccttgaaccgtttttgagaagaaatctcctccaggtgatcgcgggacattggggtgagtccattataaaaaaattctgcaggatcagccagccatccatcccatgatgaggacaggcggccatgtactcctgcagtcgttcccatgcttccggaatagactcatcccttgtctgctggaaactggaaattcgtccacgaacggcattggttttgcccatcgggaagaacttcaagaggaatgccgtagagcatttatcccaggtattgatagtagcacggttggcataaaaccactgcttcgctctcccgaggagggagaacggaaacagtcgcagcctgacggcgtcgggactgacgcccttgatggtgtacgtgctacatatctccaggaattgttgcagatgagcattggcatcctcattaggcttgccacagaacgggctagcctacgccatcgtgatgaggctggacttcaagtcgaaatccacgtcccctatgttgacctgcggcccaatggccacattatcagtagagggagcagcgaactcgtgaagagtcttgctggccatcgtcttgaaggtcggtggcgcaggtacggctggtttatctgtcagtagagttttctgcggagcaacgactcgcggcctgacgctccggaagaaagcttctggattttctttgaagttttccggcaggttgaaaccagtcatgcactaccctgttttcacaacaacaagtgaaaacaaccaaggttagtctacaaaggaaatgattatacagaagtaaatataaagtattagttcaagcaatcgctattatgaatcttccccggcaacggtgccagaaatgcttgttggtatttcttaacgacattactagaaatataatccccgtcaacggcgctagaaatgcttgttggtatttcttaatgacattactagaaatataattcccagcaatggcgcagaaatacttctggtatattatggttacagagttcatccgcaagcgcacagatataccattgtagcatttcacccgagagtattccaagggtatcgtatttattttctcccatgggaagatcatgtagagaaagattgactaatagtttatatattacttgtgataatcatattctaagtaggggttaagataatctaagggtagagtgacacacaagcattaacaactcatcctcattataaatgatctaaactaggtgtaaagaaaagagaaagagaatctattcctatacttctaatatacatagtatacatacattctagttaactgatatactagctaataccctctatccgatgccctcctggtacttcgagaagccacccctgactgccgagttccttacgacagcccgtcatgaccatacaaccggggctaaatacggaggaataccctcctcaggaaattaacttaggattatatataggcgcgaaggaatacccgtactgagttgtcaccatcagcggcccacctctcatccgcaatatataaccccaaataatgatatctcgtaatttagacaccacgcctaaattaccagatagtactctaatatcatcgtcatgacatagagtaattgcaaaagcaaacattatacccgcaccaaaacatctcccagataagctagccgtatattcattataacatgaacataatgtaaagtaggtactcatatacttagaaagtattccaataccataaatgtatttagaagagtattctaataaaagtacaaagcttataaaagaggaaaggaaagttactagagccatacccgaactcttccgaaggcttctggagttttgactcctattctatttctattccaccagctaaatactactaaactaaacttgagagaaatgatagagctattgcttgaggtgtgtgtgtgaagtgagaagagtagctctttttataggcaggtaatgacggttgtgacggttggaatgatcagtaataccctccaaccgccattggggatcaatcccagccgtccatccaaaccctgcatccatcggcgccacgggaggttcagccgaaccaccaggttcggccgaacttggggctggcccaatctagcccaatttcggctggtggcctcgtctattgctccactccacagacttgtgaattttggcccaattcatcgtgtcaattctgagttcttggcctattcacacacaagtctggttatcgacatcgtccgattgatttatcatccgagtagatatcgattctccttcactttattatcattctctgcaaaaaggttagtagacctaatactagtggaatattattgttctaacatatttatgcattgcaagcatcactagttctcctttatttttgtagtattgacggttgaaactgatcgataatgaccgtcaacaatagccctagtccagtttatatgagattgatgatgatgagaatagattacaaagagagtaaagaaacaggcgataccgacgagatcgtggtcgaggggttcgacaagatctcccggcgagttggctccgtgtactccggcttcgtaaactttggtgggtgtgtggacaatgagatgcgatgtctttagcgtgtccttaggggtcccttttatatcgtggaataccttaacctccaagtaagacttagagatatgtaaaccgacacgatataccagagattctaccctttccgagtaggacttcggcaattcctttactcatagagatattttccataatctgaggcaagtttccaatggcgtatacgggaaccaaccgtatatatacgtgaaggtataccttatcagtatatttcataagtcgtaggatagaggggtatgccttatccgtaaccctaacaatctgatccgtaatttcttttcttttctctttttttgtggactatgtgaatcttgttcttctctcatttgtatagtgacatttgatacgtgaatcttgttcttctcatttgtggaaatgtgaatattgttcttctcatttgtgtgttgatttgatttgtattgtgattaatacgtgcaaatggtagctggatgggatttttttcaaatacttttttcgcccaatattattttcacaggcggactacttaacggagccacctgcaaaaatcttattttcgcaggcgaacaaggtaaaaaatgattgattttcataggcgtttaggtgcaagcggaagtgatggtcgtctgcaaaaatgtgttttgaacgcctacaaaaacgtttttttctagtagtggggggtggggagatgcatagcctaatagtgaacctagggatgttaatgagtcaagacctagggttctttaactactctcatttatttttaagatcaaaacgaagtttaaacccaaccctcaatttgtttttaagaaaaaaaaaggtaggcacttcaattaccacccctagggggccccgtgagtcgtgagtaccatgtaacaacgggggatttaaggttattagttcataaactggctgaacaaatcatgcgtggggcaatttgattgaagtaatagattaacaaatgtggaaatttttaaaaacaaaaagacagatagaacctccctaactagttagtctcccccaggtatattcttagtcgatgaacctcccctctcccttgtttgctggatcagttttgttcgttaattttttgtatgagttgggttcgttatttttttttatcagaaaagtcagttagaagtcatagttttctatttgtcttcctctcattgtgcggcactccggcagtattcaaacattatcatgtgttgtggtcttcacattacggaccaactggtactagatgaaattatggattattacggagtatgaaattaagcaccttcgtgccaactgccattgaggtactttcacacataatcaaagacaggcagtgtgtagaacctttgtggcaaatcggagaaggtaggatgcatcccgacgtgaatgtggtctaggttcgtgatagcagagtgcacacatatcctgaagcagatagaaatttgactagctcgctcgcactagtctcgactaaagtcgaactaactgaatcacatgaattatattaggtggtgttcttttccgattaggatacagattttatctcgatttttattagcacgtttttaaactgttaaatggtttgtttcgtagcaaaactttctatatagatgtgttggcttgaaatatcaaatttgtaacaattaaaactcaactaatcatgtgataatagttttcttatttaccctaactttatctttatctttatgttctctaaaaaataccaccataatggtacggtgttattgcctgcagctaactacgcgctgtgagtaagcataagctgatcaagtcaaatccgtgtaaatcacaaaggttaattaatcgatctatgtgcatagatcgagctggttttacttctatgagggtatgtccggccggcccgggagagaggagatggggcaaataggccggcggggaaaaggagaaaaaacttgggccgaaagtggcctgaggacacagaagggatttttatttgtttttcaattcaattaattgatggaatggactttgcattattaaaattacttcttaaactgaaaattcacggcaatttctatagagtaatttagggtaaggagaacattaaaaaatatgttcagccatgattttttaagtaaattttattctcatttaattcacttgataaattgctttaacttttaatataaatactataaattatttattaaataatttttaaccccaaaagaaaatcaggacgtaacaactgccaccacggcttcaccgtgctgaagtccaccactgaccactgctacccctctgccccgccccccaacacacacacacaaacacatacccctactggatctaaccacttccaagctcatggcgaacagagctagaaggctatgagatccgagggagggaattaagtaagaacactgcctggagatctgaccgacaccggcacatttgcccacgtcggtatgggcctcattatcacccgctagcctaagagaagaagaggcagtggcggtctagaagggaacacagggatctagtggagaagctcctcggcagcgttggcaggatgcaattgagaggggatagatagtgctgttagacatagaggaacaactctcttcagtctcagatagtagtgaagaggagaggcgaagacggcgagataggtgagcgagaaggagagaggtgagagccagggagggagaatgaggggtggacaaagcctattgaattgaataatagaggttggtagatatttttgtcggtggttcatccataggtacaagtttttgaagaaaaccggtaatgatgactcacctatgcatgccaatttttaaagaattataccaatgactcactcttaggtgccatttttgcttaagaaaatcagaaataatgacccacctataagtgtcattttttttaacaaaccaatactaatattattactgcaggttttattgtataacatactaatgaggtgttatagatgctggttttaaatttgaggggccgctcaggagaaagggagaggacggagaatacctcacaagtatcggttttaagttaaccggcacctacaatacctgtccctgtattaggattacattacattattgccaaaaactcatcacagtatgaaaacaaattgacagaaattgctgagaccacgttacgaaaacacacattaacggaaattgctgagatcatatatagatctgcattattttcttgaccggcttcgatcaagtgcaaaccaacatcgaaatgattcacacatgcacgcggagattcgctgaattcaaacacatacacagtcacacacacagacacacacacgagaaagggaaaattaaattccggaccggccggttcgtggttcgccggtgttgttagagcttaatttattattagggctgtgaaatcgggtggataaaacgctgtagctggtgatgatcactgaaaagaaacacgttgattatcagtggtgctgtggattaggcccacctgggctaagcctcttcgtcccgttgtacgccgcggtgatcgccggcgtcagcctgccgccgctgacaacgacagcggagtcctgtagccagcgccggccgagcgggacgctgccggcgaggcgcggcaggcccggcgtggtaacgactaggaggaagacggcgcagatgaagaagcacattgcaagcttcgccattgctgcctagctagctaatacgttcgtgcgacgctagcttcctggctaataatgctgtcttttggtcgatcgatggcttgctaggtacttagaagctagctagagaggtgcgtcgatttgcagagctccaccgtgtatttataaccccaatgctgaggtgcatgaatttttaagttagacatgttcaagttcatggttttgcttacgctgatgcgtttcagcacaagagctgggtgatgcttgtcagcataagcaattccatcgttttgcttctaaggaataatggccgattagtggatctagggtggcatggtggatcaatgaagggagtaaatttatttgagagattatatatgtattggtgcttccctaaacgggtagttattggaaaatttgtaaattgagaactaaattattgagcatatgataaattagtaactcactagccagtcctagtactgattagtgagggcacacaattaaatccattgatcaacactaaataggtgtaatgtcctgcctatgtggccgtagatgggtgttggcatggctggggcacactaccgatggctgatcagcattcggcctaataagcaagccgataggcatatgctgaaaatcagcagttgcaacagcgaatcgatgaagccgggtgttgtgtgtggcccaacccgtctcaagtaagtacctggtttgataccgtctctaggtactgatttgtaaccgatgggctactatcctactaccacctcgagctccatgaccacaccaataacgacatcaagaacttccagagaacttccagaacacctatctcaagaagaagttccctaccaagaagcagtactcactgtcgtcgagctcttctctttctcctccacatccatgcatgacaatactgttgtctcccacattcgttgcaaaggaccagtggggagtgcaagccgcacactagtactaaaaggcatatacagatcggcactataggtgctagaacagctaaaaccaacacttatagtgtttttcccaccaccgcaagctgaaaatacaaaaaaagacacatttacacgattataagtgtctgttttaaagaaaaaccaacacctatacaatattataggtgtcggttcttacaaaacactgacacaaaaaaccgacctgagatgagcgtgacacctcccccagtcccctgtccttatccagtccccagtacctagtcggcccctccc

SEQ ID NO: 67207 - DNA, 4861 bp, Oryza sativa
ctcggcccttggggccgaggcgggtgcggcccgaccccctcggggggactaagaggagggcgaacacatcaccctcgggcccaacgtccctcgggggtgccaggccacgtgtgcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacggggctccgctctgctcgatggtagcgtgctgccgccttcccgcatcgtgagcgagaggcaggctgggctgccgcgccgcttcatgccggaatctgccaccggccgggagatagtcacgctgggcgagggacgcccggcgccagactacccagggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcgacgcgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgagagggcgtcgtgcttctaggtctcgcgacaggggcccggggagcagccgccctgccgacgcccgggggaagaggaagcagggaggaacacctcccccatctcctccccgagggggcggggcggcgcgtgccagcagcaggcgcccggagggggccgcgcctacatcgcagcccgagggggagcgcaagaagaagcggccccgcaagatgggggagacagaaccatctcggggaaacctcatttcccctccaaagtggttgtttaaccgaccccctcgcaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcggatcgcctacgggaagctgaggaggccgcccaggaggccgcccgggctcgccaggccgaggaaaccgctcgggaggaggccgcccgagcccgccaggccggggaaaccgctcgggaggaggccggatttcgccaggacgaggcgatggcgacttccgaggcagcttgcgacgaggccgcgggcgcgtcgcttgggcccactccctcgggcgacgctcaggcgacaacttccggggtagctggcgacgaggctgcgggcgcgtcgcttgggcccactccctcgggcgacgctcaggaccaaccgggtccgggggacatccccgagtccggcacttccatcggcggcccgagccgcgtggcatcctctccaaggcggcttttccccacgccttctatcgccccactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctagaagagcgcgcctgcgtcgtggagagggatctggcggaccgcgaggccgccgtcaccatccgggaagcaacgctggcggcgcacgaggctgcttgcgccgaagaagagttcacgctccgcctccgcgaggacgcactcaccgagcgggagcgagctctcgagggggccgaggccgcggcgcaacagctggcggatagcctgtccctccgcgaggcagcgcaggaggagcaggcgcgccgtaatctggaaggtgcccgcgccgagagggccgtactgaaccaacgggccgctgagctcgaggcgcgggtgaaggagctggacgcgagggcgcgcagcggcggggcggccacgagcgaaagcgacttagccgcccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggcttcccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagctttgagggctcggcccctcggctcgcgttcgcccccaactccgacgaggagggcaatgccggtggtgcagacgacagtgacgacgaggccggcgatccgggcgcattgaattgagcccccagatcttcttttctttcttctaaggccttcgggcctcttttttgtatagatcaacttaatctgtaatcaaaaaatgaagaaatttttgtgttaatttcatcttgctgtgagtatgagatgaggatgatctgtgccgtggtccttttgtgtcttagcttggataagggcttgtgcccaggttctagtcctcaaaaggcgcgggtcggggctagtgcctggggagatccacatgtcgagactggccaggccgggaacgtggtgaccgagggttatgggtgacctgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttattgaaatattgaaaaaaaagaaataagaatgtgcacgtgtggcagcccccggccaaccctacacgcccgagggggtgcggggttggcccgagcccaaaacatgacactcgacccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgttgacgcagagtgtcgggcccgaacgtgacgctgatggtagcgccgcaggctctgctggtgggc

SEQ ID NO: 67208 - DNA, 6798 bp, Oryza sativa
aggtcatctctgcgaagctgattttgatcagccccgcaatacatggtagcccgaggagacctcagggtgagctcggatgggagaaccgcttccgccccgtagacaaggaagaaaggcgtttccccggttgctcggcttggtgtagttcggtttgcccagagcactgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcaatcgcgacatacagatactcaaacccgcccggggcccgcctaaacggtcccaggatatcgagtccccagacagcaaatggccacgaaagtggtatggtctgtagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacgggcctcgggggccggtcaggtgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccatcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactctgagtctggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtatgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtactctctcgattatgcaagatttgaccgagggggtgagacgtaactacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggggtcggaggataacaggggcggccttcccacagtggcttcggggccgtcctgggggtcgggggctcctggcgtcgtcggacaagcgggcaaagggccaactccggtcgtcaggggccttaggcctccgttcggctcgggggcctcttctccctgctctttcctaggtcgagtcagcacagggttagcctcggggtcaaagggcgataggtgcggccttcccacagtggccttagggccttcctgggggtcgggggctcctagcaccgtctgacaagcaggcagagggccaactccggtcgtcgggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcggggttggcctcaatgcctcgggcagagaccaagaaccctagaagcttgcccgcaggtacaccaaacacacacttatcggggtttagttttatgcgggcggagcggagactctcaaaagtttccgctagatctgagagtaacatttcctggttgcgcatctttacaaccaagtcatcgacataagcctcaacattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccagatggatgacctcacggatgaatccggcctccagaagtcgcgccacctcctcgcggatgaaggcttgacgttccggggcctgccgccgcactttctgccggaccggccttgcacccggccgcacggcgagacggtgctcaatcaaccccctggggaccccgggcatatccgccggtctccatgcgaagacgtcagcgtttgcccgcaggaaggagacgagcgcgtcttcctatttgccgttcagaagaccaccgatccgtgtggtcttggacgggccgtcgcccaaggcaacctccttgaccgggacctcgtcgcctgtgatcatccgctgcctcggggtggcgggggcggaggcgccaagcctctcgtcgccaccctcggtcttggacgcagcggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcaatgtgacctaacggccacgtgtgccccggcgtcacaccgataattggctgggacggccggagcaccatccccggggccttgatggcgtcaaaggccgcaggggaaaggatgttgagggccgctcccccatcaatgaggacacgccccaacttcacgttgcaaacggtgggagaaaccaccatcgcaatctgccctccccgggcaacgcacggtgggtggtcggtctggtcgaaggtgagggcaacctctgaccaccgcgcccgacacgtcgcctcatgagtaggggtcgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgggggccttctgcttggcctcacttcgccgattatcggaaggaaccgccggggatttgccctctcggcgctcctgcctcctctcctcctcccacttcctcgtccgctcagccaaacttttgactgcacggcagtccgcgaggtcgtgaagggaagtgttgtggacagtgcaccacttgccggttgggcgctccctgttgggagcgccggcctcgttctttttatctcccgcaggcctcccctttcgggtggcccgcgaagcgccctcgacggcgaggacatgaccctcgtcgtcggcatgggctgacctcttcttcttcctcctgtcacgccgccctatctgagcggcggatccgggggcggccgaagctaccacaccggaaccggaggggttccaagtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaactccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgggcatccagttccccacgcagatcttcccgggtcggaggcgttgactaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggccacatcgtccagccaacgttgggctagagactccgggtcatgggcgacgggcgggtgacgtaggagcgcgcccgcagcttggagcgcgccctggggcgtgctgccgtcgccgtatacgaggaggcgacgctccccatctcgccgcctttctccacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaagaaaagcttggcgcacacgaaagagtgcgagagctcagaaaatccctcgcagagccccctacctggcgcgccagatgacggagcgtggggctcctcaccgggagaccgcgcaggcccccctttgccggttcggccggggactcagggtgagattctaagctctctgtatgtggaaggttcgcgagacaggaaatacacaagacacgggcgatgtatacaggttcgggccgctgagaagcgtaacaccctactcctgtgttttgggagatctgtgtatgaaggagctacaaagtatgagccagcctctcccttgttctgggttccccctctcccccaaaagtccagtcccagtgggcaaggtcctccttttatatcttaaggggataccacatgcaccatttctctcttttttgtggggacttaccccaccttttcataaatggacggagatttgtatagttgccgtccgagtcaccttctgatgagacggcccacaactacctccactttcgccgggagcagatgcgacgtggaatcatggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctgacatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgttcagccaaaccgcaataaatgtggttaggtga

SEQ ID NO: 67209 - DNA, 13180 bp, Oryza sativa
ttctaagtataatattgtttattaatgttgcataaaaccactaactcaatggcaagaagaagctgaagcggaagaggaggagcagaagaggagatgtgagttccagagcagccacggcggcgtcgagggatgagatcctctccaagattgtcaccgtcgccggtgacgggactgcccttctcccccccgaggcacgcaccgtcacggagtgctctctccatggcctcatcgccttcctcgtatcatacttctgcttcctctctcatcgacgcgtgttcgtccaggcaacccggccgacatcgatgccttcctcaccggctcattcgcgctcgcctctcatcttggcagcatcatctcatccgccacaagaatcattcagtcgcaagcctctctgttcaggatttgtgctgcttgtcaggattgctccagaagcagccactcaagctcaagaaatcggacgactaacccatggattttgttgctcaacggcttcatcgcttggacatggatgctagtactgacagtgtgccagcaaacagcaggttgaatgaatcactgcgaagtgttcttcttgacagaatcctcaatctttatctcaaggcactttctcggctaccaatggaagatttttgggctcctcatcacaggaccctgctcaaggcaggctacttgcttaggtccattgagccctgttagcaatatcatcgacaacaccatctggtatgactctttgttcctctcatcagagaatttcgaggtggatattgttggatagtcatagtataggaaggagagaaatactataaatattgacacgttgtattgaggcttgggggtcggtatatataggaatacatgtattggatcttaagtaaactcagagagatagagatggaaactaatcctatcctaccatagcaaaccttatacaatacgatcttgtctacatactctaacacccccccaccccgcagtacaagcgtgagccgtgcggacacttggattggagaagaaaccagcaaaaatgctcaatacggatgatagccctttgtaccatagtcgacgtagccgaagcgaaaagtgcgatggagccatggtcgatgaagctgtgcgtagagtagccatggtcggtgtagccgaagttgggaagctgatgttgaggtagccgagccatagaggtggtagagcgcgcaaggggcgccaaggagtagtcatggacgcaggggtgggcgtcgtggaccaaggtgcgtgaggacgctctgggagggtgcaagagattttgagaaaattgtttgtggggaatacaaactcacaaatccagctattatcaatagttggaagatgaatgataaccatctaggccttgtcactgatgactttatctatttggatgttgcctgggacgtcaagttgatccaatatatgaatcataccgcaagggtgatgaatcttgatgtgaatgaagaaatgaagcggataaaaccaatgggtattgtagaataaggttgtgttctttccccttctttcccaactcacaaacctcttttttcgtgagcacgttttttaaatttctaaacagtatttttttttcaaaagttttatgtagtaaagttgctgaaaaaattatattaatctattttttaagtttttaagctaatacttaattaatcaccattggcttttatcccgacggcgccctaacgtcgccagttggcgcttcgaaggaagaaaacaatacgagaccaccgatgtcgacgcgctgcaccagccagcgacgacgccgggttcataatcatcaaccctgcgggagctagcgctccatcccggggtcgtcgtctagatcaccttcctggcttcctctgctcattgccgcagctcggcgccggcgatgtccaagccgcgcgccaccggagcggctgcgtgagggtcactgtcctcgtccagcacacggtgaccaacgtgcgcgagcaacaccggagaggttgtgatcgagcttgaggtgacattggtgccaggagaattcagcttcggtcatgctgcctctcgcctgacggcccgtcgaagaaagtgcaatatgaatgagaaaaagaacaagcaattgcattgtgaacagctacaaatacatatgcagaaattgtattacaccaaagttttctagactggacctgccttatttctggtggtggcatgtgtgcatgaaaattatctcatggtatccatgaaaggaattgtttgtatattctaggacttgtgatagtaagacctagttcactcgcatataattgctgttgactggtgcagttcaaatcaactatcttatcggtgcacaaatgatggtaaaaaaaaaatctatcagattaaatgataaacatgcaccatgccaccatcagattaaatcataagaggaacaaatgatatgtcaagaataacggatgcaactcatgcacagcatacaatttcctgacctcacaaagcatgtctacacgatctcatggaggtgtatcctgatgcgacaatacgagttacagggttagtagattactgtgaaaatagatgttctacatgcaatgctacttctaactgaagggttagtacatccgggtcccttcttgatgaaccttctgctatatccaaaggtttccaccatgaagtgcactcaattcaccctacatcccatgacagtcttcataaaaattacctgtgaaaaaaaacaaatataagtaaatcttgtattggttaggaattcggttgtaaaaatattataaaaaaatatcgcagtttaaacttgtcatccctaaaaaaagcacttgtcaaaaatatctcctacaaaatcatgaagttaatttctgcatttttataaacctaatattggttttgtacaaatacagtggcagcaagagaatttctgaaggtcatatctttgcaaataattagaaggcttcaaaagaagccctcaagattggtttggaaattttagtcagtaaaagcaaatctattcaagctcaaaaaagagcaagaggacccatctcaggaggagcaactgcacacagcagtcaggacacaacctagctatttactagtgatctagtcttgtagctatcaataatcaccataatgagatctcatcattgtgttgtctcaactaattacatagttaaacagaaataattcttgaattatatcactgttggcgtaaataattaagaaacatgaacagaaatgaaatgtatacaaatttataatcaacgttgatcggaaaataaatccatgtcataagaaacatctagccaaatttctcgttggttcaatttagctagaattaaattaataagtagtcataaacaattaaaatggtactaatactatttctgaaaataaaaaaaaacttaaaattactgagagagagaacattgattttagcccggcccaaacttgtggcttctgctaggtacgtgcggcccatttggcggcgccctaccccaccgcggacagcaacagcgacgccctcccccaccatgagcaaaggcggtggcggcgccctcccacggcttcccacgggtggatccgatggcgatagcctctttgacgctccagtcgcctcccctatattccgcacccatgtgcgacgacctcctttaccgctacttctacgggtgcttctctctgagtctgagcgagaggcgattaaaatatgtcactacaaatatgtcattttagataaatgtcactactattcatgatatcggctgtatgccactggaatttggggaaattagaattgtgccactccgtcgagttttccgtcagaccccagacgtgggactcacatgtcagttccattttcttctatcctcgctcttctttcttccccatgtgcaattcaagttaacggactgataagagtatgagataaacattgattccggttgtaaaaaataatcggtacagaaaacaagaacaggagccaagcaaaaattatctcaagtctatccaccaacacaactcctgctttattatctcagctcctccctaccacgtgtcaaaaaaaaactcttatctctcttaccccttctctattctctctctaccttatctcctaccatccacactccacagccattctttcttctatcctttctcccttctcacaacacgcaggagcgatggcgtcctcggccttggcgagcagcaagccagcaacagcagcgatggcgttggcgagaaacaggtgcggtgtcctcgtcctccacgagcaacaggcaacaggagcggcggtggcgtcatgtcctttgcgagcagcgaacagtggcgtcggtgagcagtgggagcagctctgagcgggaggtgaagatggagatggtgggacgatcggaggggggaggcgctccggtcggccaccaggtccaccccgtcctcctcgttgtggcggcccccttccctggcgacgagcgtggttgcgggtggcggtgaggagcacgctcctccatccccctccttgtgatttcctttttgtgatgaatgttttaagagatttttttttgcagttttttcctccttttgattttccccttccttgtgattgaatctgtgatgaatcggtgaattttgatgaatcggctgtgaatctgtgagtgcaccctcctcgtggcacacggcagcgcgcagacaagccatgacggcctgagggcagcggcatgcttggcctcggatacgcagtggccccggtgatttaattcttgtgatttaattttttgggatgattttgattcattgttgttggatttgtgattttgtgattcagtttctctcgtttccatgcttcttggctcggatcggatttgatctcctgtatgcgcgtaccggacgggagcgacgcggtctcaatctcacggactgatgaaccaaaattttgggagaggatcgcacacagacgagtgaaaaaaattgcgcatacggacgaaaattaggtgacgaaaggaaaattaagaatattttaattagttaagataaatgatttaaaattggcactgtataccatgtttagaaaatgaattatatagcttagcgtttaagctgtatactagcggactgtcttgccaaacacggactagtgcacctgacaacctgcccactatgtgatcaagaggatgaaaccatcgagcacatccttgtctcatgcgtcttctctcagcaagtttggacctagattttcttgaagctgaccggtgctgcccctcaaccttcagtaactcgttttgctaaacagtcgtggaaagctgtcaaggatgttcctaaggagcaaaataagggggtgacttcattcattaccctagttgcttgcgaaatatggaaacagcgtaatgacttttgttttcaacggatcaattccaaacatcatggaggtgttgcaggcagtgtcaacagaagctaaggctatggtgcctggctggagctcttgcgctccaagttttcctttgtaggtcactaaccaaagggcactatttgcggatgtgttttgggaagggatcacgagcccttggttgtatgggtgatttgtttttccttcttaatgaaatgaagcacagctctcatgcgttttattaaaaaaaaaaaccagcctagcctttaacccgtgcatattttaactaaaatttctttagtgtcctttatatgctacaaaatcgactcaacaacttagtggttccaacaatcaaatctaaccaagataccatgctagagtcgtatatcggttcatgtgttaggaaagactgtatatttgtaatcagtacatttaccatacagttgtagatgtcatagatggatagatttttagttttacagattaatgtggggatatctagttttcggcctcaaaatttgtggtcgcttccaggagagcctccaattgttataaagaaatatatgatgtaactgtgaaacaaaatcatgctatcccttaaaaaggcagactaaaatttccacttaaaatttcctacatgatagctcaaatgtagattataagtttataactacagaattgaccaagaaataacataactgaggctctgagcatggaaatgacgacagggacaagtacatggcgctcaccagggtggagagatacctgttatgaattgtagtaacacattgcctgtgcctgaagaaaataagaatccctatattttctcccactccctatgtggacaccatttttagcccaatcttctctatgtatccaagcatcacgaccaatatcaagtacgcccaaaatctgtacaagttagggcttatgaatttgaaatataagagcgcaaaaagggggaaaataaaaaggagcaaaacaacactgcacacatttgcatgctttttacattaagaacatgtggcataaactggcaaaatataaagcacttaaataatttaaagatggatccacctatttagtgagcctctttaaatctattattctgaagtttccaattagatgacattattttatgttaagtaaattgctttcttgctttggatttcttcaattaccataatctgtcaaacttcaccaatgatttcaccaatatgcttatataagcaagcaaaagtatgttaagatacgtggcacaaaaacaaggggtatgtcaccttaacacctgaaaaacacttgttcaggatttgtaccaggttatcaactgaatattctttcagtggatttattctttggctcatgatgcacacaagtatgtagttaagatttgtctatttcccacctaaggggacattgacactccatttgagtttgccaatgtgtaacatcctttccaattaagtgctagatatatttgtatttctactagattgatactacattaccagttactacttttgtgaataataaataaagcatcatatgactataggaaggggaaatgaagtacataatcaaatagtgagattaacatatgatcatgttcattccaaaagttcccttaaaatgaaatgcatttgaacaataaggaaaatgtactgaaaatataaattatcatgtaatatgtaatgatttcattagtttgtcttacaagaaataggagaacaccagactgaagatagatgtaacttaccacaccacctttccatgggacaaataatggataactcctcgactgtaatacctatcaatattagatgagattaataacaaagaaatgatgggccatggttatcacagcatctttggtgaccatggctctcgagcggcccctcgttggacaccaagatgctgtgacaaccatgtgatggaaatgaacctatcatagaatatattagtcagaaatgaacctatcatagaacttgcaagttattttcaagaattggagtgtgcatttgtacttaaaaacttgttcacattcttagtttgaaagaacatacctctgctttctctatcggttgatttgatggaatagtattgagaaccctgaacaaaacatatgaattgttacacacagcagcacatttatagtcttttgaaaaatgactccagtggcaaacctttgttctagaactggtgcaaggcctgctgttgaagctgtaccaccaacctgaaaagccacataagcactcctctcaacttactttgaattaacagtgttgaagtattgactaaaaagacgcctggtactttaccagctgaatgctgcagaatagcttcctttgaagctcaatacgtcctgtggtcagcaggtgttagaaaagtttcaagataaggggagcaaaataataaggaagagtaaagacactacctgtcgaaaggatactactaacaatggcttctacaagaccgatgttatcaaacttttttaatctggtgggaaacatcggataattgtcccacataccgaacccaccattcccacttgagtaaagactgtcacttgtttgccatgtatcttctaacatgtcatcataatcttggaacctgcaggcagaaaaactactgtaaagtaatcaaatccaaacacacaatacccaaactaccgagatgaatcaaaatattaccaagatcgaggaggtggagggtattcttctgggacaagaacccttggataaagtagccccataggaggtacctatttaatcacaaaaaaggcatacataaatcaactaagacgaaataatgaaatgaagaccagcattgttcttggactgtagctcaactacctgtgctagtttttgatgataaacccaaaaaaggaaaaaataagcacataagagaaagagaggagtaaatagtaatggattacattcagagccgatagctttgttttctgatgaccaactgatttttcatgctcatatgaatgaacaacactgacagcatcaaaacttccactctgtgaaaaagaaaaatgtaggttgagatcatggttcaggtgcgaattgtcctttgaaatatatatgtaatccctcatatacgatctcttttgttttgttgtttaacataatatagctctgtccattttattacactgttttcaaacaagtgagtacaagatatgtaactagaatctaaacaagcaaccagatccatttttatgttgaatttatttttgtgctgttggatgatcaactcatgataaagaaaataagactacagatatgcgtttgtgtttacatattcatgaaagtcacggaaaaagtaaagggatgagccgaaaactgacaggagacaagactaatagtaactcatatgatacaagctacacaaatataccactcgagccaaatcaccgactcattgtcattctagagatttgcacctaaagcataacaggaattctataccgtgacattagaaaccattattcaatgctactggtgttatatttttattgttcttttttggtggttgttctgaagatgttgaatttcaatctgctatacactggagatggaaatgttaactggagcacacactacctctgccatctgttgcccttattagaatgaatgcaaataagtataagccacttactcttatctggctgtatgactcttttagtttgttgagcattagcatatctataggcttgttcactggatcagtttggaagtttggccatgtgcaatgacgacgttgaacccaaagaaggcatctagatatgtcctacaaaagaaaaaggatagcaaagctgatgtgtaatgtattaaaaagaactcagactgccttgccgcaaggaagatgataagtaaatactgattagaccaacaacagtgctatcaaataatcatgtcataaataactaattgaaaagacaatctcaaattagtgctaactacaaaacccctttaaaagcagggacagaaaaacagaggcgatctcaaattgtacaggaatttcctatattacttgactaagaaacaaaattcccagatgcgaaaaattatctagatggtttctggtcatatttcaaataccaactcaatatcctaatccatgtttcagcagatttttcactggttactggcagcagtgaaagaaaaacagaaccagactagactcgctgagaagtttttaatgtctactttcagtttcaaacactgatatcagactaaatcgctacacagaaactgcacaaacgcatattttttgaaataggagcaaataatagctctaaaaaagtaaaaacaaagaataacaagtatagatggcgttgtggctagcagcattggaccagaccatttagcataacaaattggagaaagaaacacacacaaaaaaaaaaggaaaacttgttaaccaacactaaacaaaaacaatataaaccaaaggcagaagcaaacttaatatcgtaacaaacttaatgctaaagcttggtcttcctagtaaattattgatgtctacacagattgcatgaccatagcgatatactctaaacaaatgatataatgtgatacaatacaatgaacacaaacaatgaattttcatagtaatgataaactattaaatagaatgaacataaaaggcggatatccaaagtaactaagattggttgtgtaggtcaaacagtataatttagggcatacatctccaccgtatggaagcgccagggctgtgtggggtaaagcaacaccatcctgcatacatcaaggaggacaatatattggtacgtaagcagtatctagaaagctaaagaaaagctattcatattacgacttaagaatacaaccctcatttctcaatggctagtgaaagaccaaagaaaatgctacggttattacctcaacacaaactacttgtgtaacttgcgcgccaatgttgaccacacaagatgtcgacaacccatttccaaatgctgcagctagagcttcctatcaaagcatatacagaagaaataaggatgttcaatgtctcaacttgtggatcatcaaacacataacttggttgaatggctattcttctacaagccttatacagccgtgcaagtaggaagttccctaacctaaccggtctcaatttgtagttccgcattagaatcattaaacctgttgtcagacaatcagtcaataactactaaaagaacacagaaggtagaatccaccagctggtcccctagctgagccagcgtcaacttaagatttcgagcacaaaaaacaagttaaatcctagcttttagatgtgaaattctgtcgttcatatagcccaagaatatgaaacattcatgggtcccttattttgtgcgctggtgaagtatggactggtttaaaaccagaataattagcatctataatcagtgtcaagctgggctacaagcagtactttttgcagtaggctaagggcttagttccactctgggattggaccaaacattgaaatgttatctaatgaaggtacaagaaaaaactgttcagcaactatatctgctgtgctaagaaaattcctgctctggcacaaatctgaactctgaaaagtatccacattgcaaccgaaatatctcaactgttttaacaagttggccactctctcagcagtatatttagttattaacaaagacaataatgcatcaaagcataaacacaggagcacaatacaatccattcagtgaatacaaccttcattgattaactcaacaataacatcagaatagtggaaaccaccctgtggctattgaagtgtacaattctaaatgatatccctttttggagaatggtttccaagtgtacatccaagtactttcataccaattccaatgttccttaaaaatgatgcaaactttcaaaatgacaaaattctagcatcccatctttacaaatttgtgtcttgtcacacttattggagcacttcagaggaatagatagtactgtagtacatggaaatcaatttatatgtggagtttcgtttgtcccactttacgaatgaacgatccaattaattagattttccatgtaaaacagagtattcttacatccagaatgtgaaaagaaagaaaaatgaaaaatgcccagtgattggatgcaaaagctaacctgatgtatcactgctgtgctaaaacccaaatcgcaaagtacgattgacaacatttccttgatttctgaaatggaataaaataattaacttcctttgaccagataaatcagcaaaaagaaaaatcttgctcaaaagtgttatgcaacacgcattatacaatataatttatagtaaagggtaaaaactaaaaacaaacataagatagggtacatgtcaactttgtggccagtattttcctcatctgtcaattcaagactacttcaatgcagaacagtattatgaaagatcattccagattctcacagccagtgtcaagcagacagggcagagttgtggactaaatcacagatagcacaagatgccatcagaacatgaatatattgtgtgctagtagatgagggcaaaaccaccatccagaactagttcagggtttattcactttgatctggattttgtaagtttaagcatcatggtagtttggggtaaatagaattttccttatcttttaaaactttttgccaacatctaactagagaataaaggaaaagcatgtgagaccaaatagatcctttgcttatagtgagaatgttaagatcaatctaacccgcagtagtgagaccagatagatcctttgcttatagttttaaaatatttctgctaacatttactcattccgccccaaaatataaacctataacttttttacacggtctccaacgaagagctttgacaaataattcccatcgtaatatatgatgtaacaattacaaaataaacatcttatgaaagaactttcaaatacaaatttaataacatcacatgcatagaactaaacatatattacttcaattattattagtcaaatgttgaaattgttgatttttcctaaaattgtgtgcgttatattttgggacagggagtaactagagcattaaggacaaaggtacagtattggggactgcattaatatccaaaatgacaagtcaaaggaaacatatgtacttgaaagaagaaatacctcggttatcaaatgtctctcctagaacaagaattgcagaatacagatgccgatctcttggatttatatgcaatttttctgtcaatatccagttccaaatagtgcgcaaatcttctaaaacctgcactttttttaattaaaaagatggtctagcattgtgatactatgctgttcataagaaaaaagaaggcagcatacacaggtttatgacaaattcaaaataaagagttgtcacttagttttctctttggcatacaaaatatcagccatcaaatccagattttaatatttctaaaaatttgatagccagattttgttttgaacattttatatggtatgtcattcataaacaaatacatcacatcagagataaaaactgaggaagaaataacagataatttggaataaatttttaacttttgaacacaaaatcaacagtgcctaaaattacaatatggcactacaaggctgtacaaatgctgccttacaagcagcataaactgattgattaattgttttattaattatgcagaaaaaagaagaagaagaaccagtaagtaggcatggataccagaaagtgtaaataataattctagtggattcagaacgttagtatctcattctttcatcacaattgtacttca

SEQ ID NO: 67210 - DNA, 1650 bp, Oryza sativa
  unsure (1)..(1650): unsure at all n locations
cgcgggattgaattgactttacttcgtctgcaagtagctcatcatgcatcaaatatttttcatgatcatcactatggatttttgacctgaaaacactatgtgaactttcagattctgctctgcattgatgtagctgcaacttctgctaggtcaggagatatgtgccgatttcttcttgacgaggtaggttttgatggttatgcatttctatgtcttcatattcttattcttatggacgttggttcatgaagatagcataagggcccaaaactccaaatactgggataaggtttgatcgcttttcagagtggggcttatgtaatgaagctaggcttcactttaaaattatgtattagcatattgcttgtcatgatagagttaccttggtaacttctatatggatggttccctgctacagtaccgctgatactaattcacgcaaaccagtaaccttgaatttgcttatcctcaagggtaggatccttgccatcctaacaaacttctaatttcataactaaaccatttccttcctaactaatggtaccaaatgattagcatcttagtaaccaaactagttatttaggcaatagataattagatattattattggggaaggtaaactcttccttagtcatactgctaccgtaggcagcacccttcttgctacagtcccaatgcccataacatgtactccctccggcttttcttcaagcgctgagtccctgaccaccgatggtagtagttgaagcaccagtaccatcgcggacgcgctttcattatttaggactgaaacttggcctagcctaacagggccgccgacgcattccgatattctgttcttttgcttgtgtccagagagggtctctgccactacagctccttgagcaagctaccaccttttgcttaccctcattgccttcatgattttagaaataaatctcacctctctggacacatgcccatttgctttcaccatcaaacatatccaggggcttattggatctggtcgctgctggacatgagccatactcagtgcccttgcagttgttagatctgatcaggtactgccatttcctggtcacaggcaatggccttgaccatacagctgcctgactgcattcatcaccggtcgaggaccttgaccacgccattgctgaccattggcgctcactgtcacctggtcataatttgatgaaagcactgcactactgtcatgttgaccctggcaatggccacatgatgaccaatacttgtcgcacatttgctgtcctagccaggccatgtcacattggcgaagaaggcagcaaatggaaaatatcaggtggtaaatgcaaaaagagtttagctttcagtaacaccattcatacaatttataaacagtacttggcaaacgcttttacggcaataattgagtggtacataaccaaattatccatatttctgtaaaggccagtaaatgatgtttatctatgtaaggcacatttcactgaatgatgcagcttcattaatcctgagaacaaaaaaaaaaggaacaattaaacagcaaatactttgtctctgcatgttttgcactgtttaatttgacatcgcgattccnnnnnnnnnnnnnnnnnnnnnnnggaatctaaatcatcaaannnnnccccatc

SEQ ID NO: 67211 - DNA, 6414 bp, Oryza sativa
  unsure (1)..(6414): unsure at all n locations
agagttattcagattcctgctttatttagttgagtcgttagcggcaacattagcaagtaattagtatttttacttgactagaaaatatgcctgtgcgttgcaagggtaaatgctattttaatcttattattgttatacggtttaattaaggtaagttcactacggaatacgcttgaatatatattcttttagaaaatcaatcatgaactataattaggagtccgatcatctcaagttagcattcgagtttttttaaagagatttcttatacgactctttatgcatttccaaaagtgaacgaacttaaaatctgactcaaatataaatatgtatttaataaaacgagcaaacttaaaaattgacttatacacggatgacgtaccaaagtatcgataaaaacattttcaatttttataatagtagagattagcctgttgtgtattcgtctaagttagtatggcctgtgggcctgcatgttaattagttggcccgtgtgcttgattggagttggcctgtgcgccgtcatatatatgtgtgtctagcaaattagcactactagaaaaatcattttttaggtggccaaaaatcattttttcaagcgggggaatggtccatctgtatacaaacgattttcgatggcggcctagtcacccacctatgaaaatcttctcaacgaacaaaaaaaaatcgccgccacccccacctgtgctcctacccacctccggccgatctagggttaggattttgggagggaaagagagatgaaggataggtgaggggaagcacgaccgctgcaaggccgccaccgacgctagtggtgggggcgctgctgccgccactgccctcccccggcctccctccggccggatctgagagggaggggaaccgccgccaccgccgctgccctcccccggcctccctccggccggatctgagagggaggggaaccgccgccgccgccactgccctcccccggcctccctttgactagatctgggagggaggggaaccaccgncgccctcccccctcccccctccccccttcggccagatctgggagggaagggaggggagccgctctgagtgccgccgcccccacgcatcaccgtcaccgaccctgcgtgtcgccctggccgtccccgccactgagggagagggagaggatagctgagggctgccaagggagaggagaggtgagggagaagaaaggagataggacttaggaaaaaaaattagcgatgtggctcctatttatatgccacgtcaattttcgcagtccgcctacaaaaaataaagggtatttttgcaggcataccgcttaagtggtccgcttgcgaaaatagagttttgcaggcggacaaccatctcatcccacggttgtcattttcgcaagcggtcatttagctccgagaaacctacccgcctggaaaaaaaatgacatcgtcgggaaaaaatggtttttctagtagagtaggtctaggaaaaagattggtttttatgtgagttcgagtcgagcgatggcgatcccatcttttttatatgctattgaagattgctgagaaatgtcacgtgcacttggcatgttatcctggtatgcaagatcaatattaatggaggatctcctggggatgttcttaaatgcaacgtagaagtagaactgttggccatatgcttttaattgtatagacgcaatatcaagtttaaagtatgattttttgtacagcgggaggtgcacctgctagtatttctttttttcttttttgactgaaaagttatagatggcttgagaagtatatgtctgcttgtgtgaactgcactgtacattggaattggtgttcagaagacttcttgttgtgttgataggacgacaagaatgttaaaagaaatgcatgcactgctacttgtttgattgggttcatactgtcaatatcattttgttatatcattttgatctaggttcaacttatttgaactgcggatggttgaataaagttgtatgatattctgggtttttttagttttttaattaatttcttgagtttctatgaattttatggaattttctatgaattttcagaagtttttgtcgttctcataaaattttcttatggtttttaaggtttgtttttgaactatcttatttttcttatactcattatagatttttattatttttaagcacatatgttttctttttcctactatctctttgtccattccaagtcccaaattgtatatgggttttttcctcccgtgggagtaggttcccctaggtgtggggtgtctcacagggaaaatccccttgggggactattttctcgggtttcttctcccgaactttcagactagctggctcaatcccctccaattcctttttcacagagataaatcaaacaagatataagaagagtgggaactaaaaggcgtaggagtgcgagaatgagattgcctgtgcattaaccttttggctaattggcttgcttcgattgttttgacatcctaccccatttttattgactcgtataatgccacgtgttatgctaacaagtattccctccgtcaaaaacaaaccaagcacatatgtgatatatctatccagattcattgtattaggatatgtcacatctatgtcttaggttctttttttatatatacagagggatagggttgaaactggttcggatagtttctgtccgtccggaccatttttcagatttggatagtttcggttggaactatccggaaattctcggattcggaaacgaattcgaattttttttctcggaaacgaaaatgaatacagtaagggtactatctgttagaatcggaaaacggtcggaaactatccggaatttttttcgaatatctgcagacattgagcaaattttagaaaaaaaatacgtatatatacataactttttggcaaattttaatacatgagacccaaaatttgtgtaatttgctgatagacatcgaaaaaacgtgtcatggctgaaagacattctaaaaaactggtaatttgctagatgacacttttggctcaattgaagagatggattccaaaaaagacgagaatgcccctttgaccacatgcttcaaacatggtgttagagtaaaaatttggagattatgcaaccctacatttgccatagcccaaagtacatcactagcatacaccatatttcattttcattctagtctcggctcaaaaagcttttgaccctagggtcattattgtctttttgaaaaatttctctctccgattaagttggaagtgtcctccagcaaatttccatttttagagtgtctttcagccgcaacacgttttcacgatgtctatcaacaaattatacaaattttggctgtcatgtagcaaattttgtctaactttttcatacagaatcaaatgaagacaaactttatatcaacattgtagagcttgatgagatctacaactttcttattgactattttattatttgggttcatttaagggtctaaatattcattataatataccatattattttttacaaaatctcagatctacaattcaaacgacatctgatggagatgtgttccatatcaaagttgtagagctcaacgggatctaccactttgtagtttatagcatttgtatttgaaagcatttaaagtataaaacaaacattacaagtttcgaagatgtgaaataaaataaataacatctccagtttatacaatggtaagtaattaagttatacatctagtaaaaggtattgggaatagaaaatgataattattttttgcatatggatctcttagaggaacaaccatgaaaatcgattttcacatatggttgtgggaccatctacaaaattgacgatataaatgttggagatgttaaactaaaataataagcgatatctcttccttgatcaagaaactcaatttgaggggttttttatataccggcaaatattcactaccgtattcattccatctcgtattcgctccgtatctgtattcgataatattcaattttatttccgtatccgagttttcgattccgattccgattccgaaaaaaaatatgaaaacgaatatgataaagctagtttctgttcgtttccgatcagttttcattccttgggagtgtccattcttcaccgtcgcggagataaaaggaaaaaaaaaagagggaaagtggaaacgccttcggggaatacgcttccctttccattctgcgttctctccaccgaaaacccccatgcaccgcaagctcccgccattacctcccctcacactccgccgctcctcctcctcctcctcctccgccgccgccgcggcctctcctccaccgccgccacctcgccgtctccctcctccggttccgctccgtgacctcctcgcccaccgcctcccgcccacgcccacgccggaccggcctcccctctcgcggccgcatcctcacgccgacgtcctcctccgcggccgacgcccgggctgcgacgcctcgccggagagcctccacctcgaggtcgtcaagaggggcctcacccatgacctcttcctcgccaaccacctcgtcaactcgtacgccaagggcgcgcgcctggacgccgcgcgcagggtgttcgacggaatgccgggccggaacgccgtttcttggacctgcctcatctccgggcacgtgctgtccgggctccccgaggatgccttcccgctgttccgcgccatgctgcgggaggggccggggtgcaggcctacgtcgttcacctttggcagcgtgctccgggcgtgccaggattccgggccggaccggctgggcttcgccgtgcaggtccatgggttggtctctaagacagagttcacttcaaacaccacggtgtgcaatgccctgatctctatgtatggcagttgctccgttggtccgccgatcctggcacagcgtgtgtttgataccactccagtcagggacttgatcacatggaacgccttgatgtctgtgtatgcaaagagaggggatgcaatttgtacgtttactctgttcagggctatgcagtatgatgattcggggatcgagttgaggccgacagagcatacttttgggagcttaatcaccgcgacatatctttcctcatgcagcttgggcctgcttgatcaattgtttgtgagggtgctcaaatctggctgctcaagtgacctgtatgtgggcagtgctttagtaagtgcatttgcgagacatggcatgcttgatgaagcaaaggacatttatctcggtctgaaagagagaaatgcagttactttgaatggtctgatagctggtttggtcaagcagcaacatggtgaagcggcagcagagattttcatgggagcaagggattccgctgctgtcaacgtggatacatatgttgtgttgcttagtgcaatagctgagttttctacagcagaacaagggttgaggaaaggtagggaagtccatgcacatgtgctcagagctggacatatttataggaaaattgcagttagtaatggtctagttaatatgtatgccaagtgtggtgccattgataaagcatgtagagtttttcagctgatggaagcaagggatcggatttcatggaataccattatcactgctcttgatcaaaatggatactgtgaagcagcaatgatgaattactgtttaatgagacaaaatagtataggtccatcaaactttgcagcaattagtggcttaagttcctgtgctggtttgggacttttagctgcaggccaacaattgcactgtgatgctgtaaaatggggactatatttagatacctctgtttcaaatgctcttgttaaaatgtatggagaatgtgggcggatgtcagaatgctgggaaattttcaactctatgtctgcacatgatgtagtttcttggaattctatcatgggtgttatggcgagttcacaagcacctattactgaatctgtacaagttttctccaatatgatgaagagtggtttggtcccaaacaaagtgacgtttgttaactttctagctgctttgactccattatctgttcttgaacttggaaagcagattcattctgtcatgctgaagcatggagttacagaagataatgcagtagataatgcactcatgtcatgctatgcaaagtcaggagatgtggattcctgtgagcggctgttttctagaatgtctggcagacgggatgctatctcatggaattcaatgatttcagggtacatctacaatggacatctgcaggaagctatggactgtgtttgtcttatgatgcatagtgaacaaatgatggatcactgcaccttctccattgtactgaatgcatgtgcttctgtggcagcattggagcgtggaatggagaagacatgcttttggtttaaggtcacacttggaatcag

SEQ ID NO: 67212 - DNA, 2276 bp, Oryza sativa
ggtactttttgctggatcgaagcaaatctcttataaatataactgcaggattccattaccttacctctttgtagcccttgccgaggaatgtatatactaagttttgcattgttcgaagtcgatctttgggtgaaggcagaatcagaaggtggcggatcagatgacaagcaattgctttctgagtatgctgagatcgagaaccgtggcctaaaagatcctatgatatatggacggattccaagtgatcgttgcctgctagacgtagactgcatgttccttctcaacagtgttgaggctgtcatacaagtctttacaaaggatgacagtgataatcctcatcgcgtgagattcaccgccttcagcagcggctttgatcatgagatcgtgttgtacgatgacagattatgtaagaaggggaagttgttccagaatgttgtcgcggtgaagtctaaggaaaaactggttattcgcttagaattcgagggatcgacgtttcggtggacttttcaggatggcgctgttgcagctgttagttctcctgatgattcggtctcgaagctgtttgatgtggtggttcttttttctccaaaatcatagttggtatctgcgccctaagttgtcctctttataggagaaagaacacattgatcaaatgaagaaaaagcatgctgcaacaaagcattcgcattaagattatgaaaatagcaaactagaaatgccattgcattatttgtttttactgatatggtattatcgtctaagtacaaccactttgactgctatattttgacttctttcaattgtggttgagatgtaccccttccccccaaaatacccaaaatataaaggattttggttagatgggagcctgtccagattcgtagtactagaatgtatcacatctgaccaaaatcctttatatttttggacagagggagtattaatcagcgacagacctacaatgttcaacgtatgcttggcaatatattatgggttctcattatttgacctacaaaattttgcaggttcaaataattcaacaggaaacaaaagataaactatgttggaaattcacaaacaatggtatctgcagtacaaagagtgcttacaaggaggtttacaaaagagaaatttcaaatgctcatcaggttcactctcaatccctttctatcttgaaataaatctagaagaacagatacatccctcccaaagttaaaacttttgcctggagactcatcatggaggcccttccttcttcccaaaggctaaatcagaggattcaagacattttagcagcctgctgcagatgtggtcaaatactcaaatagaaacagatttccaccttctcttttcttgtccttttagtaaattaacttggatgatctcagaagcaaaactctactgatatttttcctgctaatgttcctatggctcttattattgcttatatcattaacaatggctcttccaattccaccctaattcgaactctgaatatcatgtggtagctttggaaagctagaaatgatcttaagtttcagggaaaaatcaaggagccaactcaagtttgcatggaagcaaaagcaatgattaaaacttatacaaacttcctttcaaatgatttgatgcaggaggatcttgatgaggaagatacaaacagaagaatggtgaatttgcctaattgaattagatgctactcagatgctgcctggagtgataacgaaacaggaattggcattttctttcacataccttcctctcataatgccatttttattagagccacaaccataatggctcaatcacctttgaaggggggagctgctagcatttcaactggcaatggagattgccagattcttgaagttcactttctcacagatagtgccatcatcgcgcggacacttgcaagagaagaaactttcaagaagaaccagggcattggagcttaaggccaatttggagccaaatttgtatgagaaggttggagaatcttttgcaggttaactggatcccaagggagctgaacaaattagctgataagttagctaaagaagccaaatctcagctatgcctaaatccaacttactcttgtcaaaatatatcccatattgccctatcccaacaggagatgttatgctaatcatattagagacaatttcagtatctcgaattttgctatccaatatgtacaatgctattgagttgaataaagagtttataatttttttaaaaaaataactctacatactccctccgttttttaatagatgacg

SEQ ID NO: 67213 - DNA, 10865 bp, Oryza sativa
ttatgcgggtagcgggactacccacttgcatccctacttgttcccttttacacccgtgaaacacatcttcttcctcggttcctccaccacctacaccttggcatgccttcgccgaggaagacatccctcatcaactatcggagtacaatttgtgcgataaaggaaagtcactcataaccaagaaaaaagggcagattatagtattataagagaagtatattgcattattgcagccctgcttgttacatggaaggcatatgtcaggcctggcaattcagaaaaggagtctaaacaaaccttacctctatgaacacaagaggagaaaaatcatattctacctcatagatctgaacatctgaagttgtatatttgaaagaaagaaacccaaactacaaacttactaggtgcaggacaacttttagaaaagaaatcccaaccttgggcgacccaacggacgtaataaccaaaacaatctacggcacactattcatcattagataaatctgactacagtttagctaagtaatgtatcttgtatggatactgtaccggagatggtcgatccagaggtggtggtattgtatatgggatccgcgctttttcccgagcgacgcggccctcttctactcttccgccgccgccgccgccgctgctgctgctgccgcctacaagcatccccttccctctcccttgctccattactgcttccccttctgtacggatgtacccttcttctagcagcgtactgccggacccgtccccctcttccaccgccgcaagccggcaaccacacctacggctgccgcacccttcccttgatcgtcacctgcatgcgcggctatccccgccgccgcactccaccaccaccaccaccaccaccgccaccgccacccccaaccccaaatccacaacctgctcgctctctctctctctctctctctctctcgcgtaaggtttaagctcagtgactaaagtgaggtggtttttttttttcttacagcggctgcggagctggacttttttttttacattttaacccttcttttataaacttcttttgctgcgagtttttttttattgtctttctggtcattcactcttttcttttttatattttataatccgtgtacaaggcacatatgagtatgactgcgtggcttcgtttgagcctcccgtgcatgcaaatcacactcaaaatctttcatctgctcttacgggtatttatactatagattgaagacataacattatatttcacgaattttaaatagtaccattatcgtttataggtatttgaaatataccattacttatcctttctacgcttaccaaaatatttagatcaaattatctctctactttgtccatccccttcctccttccctcctctagggtggttgcatggtgacgggatagcaagtggccacgtgcggcggtgggtaatcataagactacaaattcagaaatatatttatcaaaaatctataaacttaagccattatatctcataactatagttctagtgtcatcttttttcataaaactatagatggagcatcaattttctcacaaaacaaaaaaaaattaccacgataataggtatagggatagcacatatgggtttgaaaaaaagatgatactagacctatacttaaatatatatagctttgcattaaaatcattcctaaatcaataattttgttataccatggattaaatatacaatttttttgataagtttattgaagtatcaattaattcattgaacctctcatgcatatacataataaaagaaaacattgcatctaggaatggcaaccctgtgccatgtatatgatcttgtttagattgttatattgatatctgaacttgtttgttatattgatatctgaacttgtttagattgttatattgatatctgagagtcatatgagctcggtgccaagagtcttggtgcgaccatcggggtgcaaccgtgcgagctctttatacaaagatattactaagatctattttatgataacttcttttaaagatttatttgtaaaattagtttttgggaggagctaaaatgtaaaaagaaaaaaacaatgagatgcaaagtgtggaagggtatttactgctggccacgtggtttgtagtccaccagaccaccgtagacagacacgtggtgaacccgtggtttgcaatggagcatggactggtgaacccggtgttgcacaaatagcagagctagtggatgccgggaaggcgggaacatcggagactgcgaaatttcccgccaggaattacaagtactgccccttcattctaaattgatctacatatatttcatacatctatttcaaattgatctatatatatttcataggtacaccaagaccaagaaaaactaataactctctcatactatttttactctagcaacaaactcaatgcatgcaccatcgccactactccctccattccataatacaaggcacaaccacttttttttagatgttccataatataagacatacatgcatgtataccattaactatgacaattctccattaaattactacttttctaaatgcttcactctcacattctctaactctattggatgcatgcattacatttattaggatgatccaaactacaaggtgataataactatttcttggtctttgagttaagtgtggttgtgccttatattttggaatagggtggtaataaatacttgtgtgcatggatgcatgcatcaatgtccatttactccaatgcacaaataacaaatagacttaataaatgaacacaaatatgtgatcatttaggaataacctaaaaaaactataagtagatcaatttggaatggatagagtactccgtaaattctatttgaaaaataagaaaactttacttggcctcaaaagtcaaaaccaatattttttatttatactattttacttataatatttgaaaaataaacccctccaaattttctattattacaaaatagatattgcttctagtttttaaaatatttttattacaaaattgcatgcctaatgagcgctttaacttgaccagcactgtgctgtgcgaaaaactgatagttttaacttttaactagtagtcgcataatgcccatgtgaattgggatcacatgcaggactacaagttaagctattgcatataataggagtcatctttttttaatgaacggatcatattattagctacagtgctaatgtaaaagcacttgacaatcttctacattgagctacagtatccataggtattttgaccatgggatccggatctaacagccggaagtggactgcacaagttgcagccacacttgctctcaagtatagttgctatgaacccactcatatcacacttgcttattgatatgggaaaatgggttaacccgacacgtgatgtcggcaagtttacgaaataaaacatgtttacggaaagtaattccttgcggcttccatctaatcattatatggtacgaccacatgggtgatgtgggccctccaatccttaagcttatgtataattgcccggaggtttattttgtcgcatgtcgggggcatttttatccataaacacaacgacaacaacaaaaaagtcatgtagaggcaatttttaaagcgagacattttaaatgttgcataaaacacttttaatctagatatacttttagcataactagttgggtgcccgtgcgttgcaacgggaaaaagaatatgcctcaatttcaaatcacaccaagtgaaataatcactcggtgtaatttgtccccaaagaacatgatataaataatgttctactatataataatactactaagggtacacggcatcaatgttagccaatcaaatgtctgaaaataaaaaggcctaatgcctgtcatttcatcaatgagcaagcataaaagaaaagctgatcaatccctttatgcaagacccatgtagcttcattgagtgacgtcaacattgccccattacgagtcctgttaacagagttctccattatattttgaacaaagttaaggcaaaagcctctgaaaatttagtacctaatgtgtattccctccatactcgcaaaggaagtcgtttaggacagtgacacggtctccaaaacacaactttgacttcttgtttctataaaaatatttattgaaaagtgatatatatatatatatatatacacacacacacacacacacacacttttatgaaagtattttccaagacaaatctattcatataatttttttattttcaaattcaacaacttaagagttattcatgatttatattcctaaagtttgacttaaacattgtcctaaacgacttcctttataagtacggagggagtatcattacagtctatagcggtgggtaccttcatttagcgaggttaacttcgttcgttcaatcatgccaaaatcaatagaagatgaggcttgctgaaagctggagaacgccttctgaatcaagaagaaacaatactgtctattccctgattttcgcatcactatcggtaatatcataagttatgtggtattgtctagttgttgggcacatccattttatcttgtttgttctaacaggatcaatagtatgaccatggcacctgcacaaccgtttattaagctacaaactgcttaaaagacaacctgcagtcaagaacttcatcaatttcagacaactatctttaactgcagaactgacccaatggcatgatgtttgtccttcgaagctcatttgtgttactcacacgggatgactatatctcccatgtatacatctcagccagttgtcaaagttgcgcagaagaaatgatgtctcacccaatttctttattatccactcgtattcttgaaaaagtagcaaagctttacatatacctgcaagaagcactcccccagttaattacagttattatgcacgtgtaaaacaattagcaatccatcataagcatgcacacaagcattatccatagaataatagaaaactattaaaaagtattcagtggctgaaaaaaatgaaaaagatactgatttaatcatttgagctcacagccaaagttcagacaagataaaaaatggagctacctcagaatcattccaaagctcgctatctcctattcagagttgatggttttccatatccaacttgttatgagaaatgtgagaaaataaagctctgttgagctgtattttatagtcaacggtagtgcagaaccaaatgttccaagcaaatgcacagaagatggctagaagggatgacatcgatgcaaacttctgatgagctgaaactatttcctgaatttgttgaacaagaaactaacccatgtagatagtcagaactcttcatcatcaacaatcaaaatcaataattgctagttcccaaaaacctcatgccctgcctgttctaggattggcaatatcgacgcccacgggtgccgtttcctccctggaggtgttgccttgtggactccctcccccctgggtgaaaaccagcccagtttttggacggacgtcgacagcggcttatgtcgttattcacctccttggagatttcatcttacggtcttgctcatccctcggcctccgacagttcgtagttgtcttgtctcaggctttttgtgtcttctgtgtaaggttttcgctggtttcactttagcaaaccgggcagttgtatgttttttgggcccggttttccttataaacagggtgaactctattcgtctaatatattcggcaatgctcttgccacttcaactcaaaaaaaaaactcatggccgttttgaatctatcgagcagtactcatcaaaaatcaaaatatgtgcagtcaaatttagcattacaaggaaacatatgttttcaattttgccttagatgaaaaaaaatgtaagtaataaaattagtggactacttggagatttttgaaattaccattggcgtattcaaaggcaattggagaccgctgaagtgaccagccgctgccaggttgtggcctctgcttctgctaagtaacggagtttcttcagaagtgacggatcaattctgcgctcattccaaaatactggcattggttatattctgcataaaatttcagaacaaactgaaagattgatttcaaatactacagactgaggatggttagtataaaaatttcagaacaaactgaaagattgatttcaaatactacagactgaggatggttagtataaaaatttcagaacatgaaccagttgctaatccacggctgaaagccaaccagcaaagtgagggttcaccctggaggaaagcagctgtgaatcattagttaccgtggtacaccctcaaaactgagtataacatattcccacgctacaaactggtatagttcagatagattattttcctgtgctctttcccatactattttcataagataagatccgtagattattttcaattttcttgagtctgaaatcattcattcagttaattaggccatgacttgactcgggttactaacaggtcaaagccccctgaataaatgaccattctaattctaaataacacaatggatctaaacctagggaactgatcacagatgaacgccaataatcatatatgtatgtactccaataagcaggaatataggatcactgatgcactgcaaactaatttttcttataaaaccaaatacatttatttgttccgaggatgtatattgtacctgcttggaatggactctataaactgaggaatgagacgagggcatggcctgacgaggcttcgcttgatcccgcagcaattccaacctcgacaaatgatctgaaattgagcaatgaaatgaaacctgagtatttgttgtagctggaaacattttaactggtaagaaaaaaagactgcttcatgagaaaattgaccattggttgcttagacaagttccctaccgagttcatggatgaactaaccgacaaccaaagcaagtggcacaaaatatccttatagagaaaaaaaaatctaattcacctatgcatttatttgcttcaatattaatgctaaaaccgatccatccagcgacaatttttgacaaactgatgaactgattttttttttaattgagactgtttgagataaaaattcattttagaaggagtattaattagcatgaccctgacctgttactctgacggtagaaaccattttcttgagggtgcaggtatctatcagttcagaactgctattacacgccatgggatcatattaacaatgcttacttataattgcagcaaaatcaagaaaataaggggaaaaaaattaattctgcatgtctgatgcttcacaagttcgatcatattgtccatatggaatatatgcccaggagtgatatgatatttcttcagatgtaacaatctacttgttctgaagctattatttgtgggggttatgtgggtgatcgcttaccttaatggacacatcatgcccaactaaatccatatttgggttttcaattcttgttgagaacacagtacgtacttgcactgatttaaagataaccctgtctcaagagagaggagatccagcaacagtgttatgcaacagtgtcattcagtctctacacaagcagctgtcctagtgttctcatttgtccatttagcataatttgtacaaacatggcaggcaaagacaaaatccccgatctctaattcccatgtttgaaatttaacacgcctaaaaggacaaaatccccgatctgaaaacatgtagatggatttgtagaaagagatggggaaattttagggtttggggggaagataacatgcagccggttgggttcgtcatgtggcgtcgtcagctgcactcaccctcagtcgccatgcgccaccgtgctcgccctcagccctcttgagttggagggcacctgcaaggcgggagaagaggctgcggagatagggggccggacggaggaggcggactactcacagaatggggtggcgccgaggagattggcttccggcggcgcgcgtgaaggcggtcgaggcgggagaagaggcggcggagatcgggggcggggcgtgcgtggaggcggtcgacgagccggagattgggtcgtagtgtgccttcatcagctgccagcctgccctcaccctcagccgccatgcgccggcgaggcgggagaagaggaggcgaagatttggtgcggggcggaggaggcggacgcgaaggaaacagagatgggagacggcgttgagagggagagaaaatcgggggaaaggggtgtgtgtgcgcgccgcgtgcgatcaacgatgcgtggggcgcgtgcggaagattgaattgtgatctgatctgttggattcaagaccacgaggaggcgacgcagggaggagggcgaaggacgcggcgtggggaaaggagtgggcgtggcgcgtgatgaggagaggagcgatgggaggagatttgacgccattggatatgaaaatcggatggttgagattagacgtgtttgttagatgcgtctgctatgtcaggaatcaagaccaccactacagattttttaagtagtagagatttattaaatttatcttgcagagacactcttttggcactttaaaatttcaatctctatagagacacttatagaaattttaatctaagctgattaactagataaaagtaacattgggctcatatgtaagagtgtaacatgaggttgagatggtaagaccattctagttaaaaatggtatattcaagatgccttgagttcaaagattggcagttgcaaggaaagtgatattgttttttttattatttttttacattggtttgatatggttctggtaggttaatgcctttagaaaatgcctatactcccttatagacataaaaaattcctatatgaatgtgctagaaagcatagagatattttctaaagtatctgtcacgcccagaaatttagcccaaaattttcagactattttgtgtattaaatctctatccgggaatcaagtcagggtacacaaaacgacaaattaatatacatatacaaacgaaaataaagcgtaaattatttacagacaaggcacttagtcctcacaccgaaaagaaagcagcagcaaccgaaaaatacgatcctagcggggcttcagctccaccccacatcaaaaactcaactgaggtataagccttggtcctctaacttcgtcttcagctcagaagcactacacttctgaaaagggagaataatagcaaggttgagtacaaccaccgtactcaacaagtcgcaccaatgatgtagacgtgcaatgggagtcaaggacggttttataaaggcggtttgtaaatattttgtagctggaaacagtaaaacaattggttaattaagacaagattatatatccactgaacaaggctacaccacgttgaacatgccaaccaaaccacctgaaccacatcagttcattatgtcaagttaattaatagagtgggactaatcacggtgaagctagttgattgcccataaccgcggacacggctattcgaataattttactttgatcaaaggtgtacaattgtacctacaagacatagccccacgacatgtttccgtgcgccgacatgtcagcaggatacaccggaaagagactgtgataagacccttcgcataaccccctttaaccaagtgtaccacacctcagatttcgcccccactcctcagcaggcagcgggcaaccctttcttgtgcctaggtgaatccggcagccgtataggccgtcacagggcccatccaaactccatcacgctcgcccttgcctggaaatttacactacaagcctagccgttgcccacgctagcttgtggtaagcacggtagttcttcgagggtttcccgcgaaccgatccttaattgccatgggtgcgactagcaaaaccatgcacccatagcccaccattaagccacattttagttggataattatgacaaaaaaaacatggccagatgtctcgagctcacagctcatcaagatgctaagtgtaaataatgtaattatcccattatgtgagctagtggtaattaagcatgactaagcatacataaatgattcttgcatacataattgaccatatttatcatttaaactacttactgtcgacattaatacgatgaaaaaaaaattagaaaaaacaaaatctaaaaatagccaaaaagggtacggtcagaaacggtaccccttatacggaagcagcgctcggttgattgggaatttccgtgactgttttcacccctacggtcagaccatcgggtcagtcggtctgacaaccgcaacacctgcggtctgaccggcggcacccagtcggtctgaccgctagggtcagccgaaaacaccaaattcacaaaatcaaccgtctattaaactccaaaatatcatcaacaaacaaccaatattttcatcacaaaatctaaattagctccttgattttacattttgcacgagtggatgttggtatttcttaacgacattactaaaaatataattcccagcaatggcgcataaatacttctggtatattatggttacagagttcatctgcaagcgcacggatataccattgtagcatttcacccgagagtattccaagtgtatcgtatttattttatcccctgggaagatcatacagagagaacttgagtaataatttattttacttatgataatcatattctaagcaggggttaaaataatccaagggtagagtgacacacaagcattaactactcattctcataatatatcatctaagctatgtggaaagaaaagataaagaaaatatattcttatacttctaatatacatagtatacat

SEQ ID NO: 67214 - DNA, 4445 bp, Oryza sativa
gagaccgcgcggtcttgcgccgctgccgtacgataccgcctgcgacgtcattcccacgtcactttcgcgtaacagttgtgcgagaccgacggtatatttctgtaaaaaaaatttgcatcctaaatattcgtgaggaaaaatcgaatgaacattatattttcaaatttaattcccgggagtacctatgcgtattttgaaagatttgtatgatcatatcacacatatttttaatatttggattaaaattcaatagacacagtaaaaggcaaaaagcagataagaaacaccataatggacactaaattatcattttaagaaaatgaccaaatccaatataaatttcaaaacttacatacgaagattaaaaaattacactgtaacttacgaaagttacaatgtaagtttcataaattacactgtaacttacaagaaaatacaccgtaaatttgagtgagaagaaaatacaatgttggcttgtttggtaacttgagggaaggggattgagagtttacacgagggaatttataatgagattaagatgggaatttgatttttaatcccaatgtcttgtttggtggatgtgatggaaattgacagggagtttagttggagattagctcattaataaaaacggatggctgagatttgcttagacaaagtaaaggaggaatttcctcccaattacctgcccctacccaggtattgaaaaggagggagtttcttcctcaactccccatcccaatcccaccaaaattcacatgtgtctcaaccaaacaaaacacttaatagcctcatccctctaaactcccaatccatcttaaaaactacctccaaccaaacgggccgtgtaaatttgagtgagaaaatcgagtgggagataaaaaaatatttgaagtgagatatagcaaaatcgttgcctacatgcctactccccattccccagcgttagggttccaggccgcgacttctccgggccagtggaacgaagttgccgcatcaatcgacaaggtaaatccatggatttggatgatggatctgtggtttcgcctcccatttctccttcctctctttcaacatgatttgcgaagctcatcagtcgtcatcgtctccatatatatcgcacaggttgttgagatgagagcagcagcgccaccagcggacccaaccgtggtgatggcttcgtcgtcgccggagaagaagcatccacctggttgtggctctcgggactcccagcccatcgcttgcacggacgatccccccttgtctgaatccccaacgacggacctaggctgccacgatccgcgcgaggaggacgccgaccacccggcaccacccatgggcagaggtgtatcctcaatcctcttgctttcatgtatgctgtgtatgcatttccttatacgatatcgatcatcacccaatgcactaattcagactgcattcagattccgacttttgtcccattgctctttttttaattttcaaaaaacaccacattggctgtgtacctttcggtagaggccggagatataaatcattttaattatctggaaaattcagattcagacgacatctttgcctcaaccaactcagacaatatgaatatgttgatcggtgacatcgacgaggatagtgatgatgatggttacgtagacgaggagacaacttgcccaggtaacattactaataatctcaatagagagcttcgattccagattaaaagatgaacagatactatcgctacattaatttctcagggcagaacttcacgaaggagcaggaaaaggaaataatgcgcaagtggctggaaacatacgacaagaagaatagagaattcatggtggcgtgcgaggagttccaaaagcagggaggagatgagacgagtgcttctcgtccggtatttccttttaaaccgctccccgagacaacagatttttgtatcaccaagagtttatgctatcaccgtgaatacaagaccaatgatacttctgagagtaagtgtgtttgtctaaaggattcattagttattaataatattgtgtgctaccaaagtatcaatatgtatttgtaatgacttatcttttcttttaattgtttgtagctgcatccactattgggtggcgtgaacccaaggagatgctccagatcttctcaaagaagttgtccagctccatgtcctatcctattagtgtttacggaatctttgcagtacgtgattacttggaccctttgcggaattatgtcttcaaccgtaccagagatgatcctgtcatagttgaacaggtaaatacagtctgtttttagaagttaagttatatatcttggctgaaaaagataccctaatatgcctatatatattatatatatgaatgctaataagatttttgtttttcttggataggctgaatgtagtgtgttaccagatacatattttgacaatttgttttattttcttaaagacatcttttgtatggtctatcgttagcattgtttcaaaatatatttttgtttctttcagtgctacattttggtataagtgcatcactgttcgctgcaactgtagtacattctcctgtcatcccttatattttggttacaattgatctattgttaagtcttttggaagtattttgatgtagagattttctagtgtgttaattaagaggtatatataacactatgagatctatatcagtagtgctcattatgtcacagttactatatcagaatttttattatacatgatgcacatttttgtatttctttttgtgattgtactaacatgctgatggtgtccgcaaaaatattaaactttgtatataccatcaagtttgtgcaaaatttcggaaatgttgcgcgccgggcgcccgacggcagaagaaaaaatcgggcgcccgcgcctcccgccgtgcctactagtataatgctaagcattttaaatagctttaaaacgatttttcttctaaactaattatccaatttatgatccgatcatgttgttgtatttattgtaattaaatctttacaaagatcacacatgattatatttcgataaaaaaatattttagcttttttattgatattttttgaatgttgcatataatctcttttgatgcttcaaccagtagttttacgatgtttcagctagtgtgctcgagatgtttcactatatacggatcaaatgttgcagtggattttgatattatggaatacgccgttgcaacaaatcatgcgcatattatggaaaccctctattaagggaatccgtttcattttttgttccacgaaaaatgtttcacctagtgtactcgtgatgtttcactatgtatagattaaatattgcagtaaattgaaacattctttcgttatttgctgaaacattatttttatataaggtgaaacagtacccgatttaaacgattgaaacatttttgatctaactgaaacaattccgatatacttggtggaacaacgtgcaacatataaaaataattcaataataatttaatttttttcatcgaaatatatccatgtgtggtcttgttttaaagatttaattgcaacgaatttaatgatgcaatcggatcatgatttggataaataaattaaaagaaaaaatactttaaaatttgcttacaaaacattaaccacccctaccacacatgcaattctgcatgcatgcatgcaggcatgcatatagctcgggagaagtagcatgcatgcatgtaggagaagttgcatgtagtagtggctgcgcgctatcaatggttaggatttaatcccttgatccgatggctgcggcgggtttcctattttttttgctcctggattggacgcccgatccgtagttctctccgcaaaatttgcataccatcctatttatttattagtatgcatatccagttgagtttattctattagaatacttttaaaatatgtatttatatgttctaattaacacacttaaaattgcttaagctccagctttgggttctaacgagtccttttaaattataggatcccttcacattacctctttgcagcccttgtcgaggaatgtatgtgatagaatatgcattgattgaggttgatctttgggtgaaatggaaggtggagtatctaatgacaagcaattactatccgcgtatgtcgagatttttgcccgtggcgtgtttaataaggagatgagtgggcggatattaagtgaccattgctatctggacacacactacatgtatctttcacggagtattgaagctgtcatacaagtatccacagagattgacagtaacgatcctcgccatgtgaaattcactgctttctgtagtggttttgacaatgagattttgctgttcaatgggaaattctgtaaggacaagtctttcgagcacattgtggcaatgaagtccaagggaaaactggttgttcgcttggagtttgagggatcc

SEQ ID NO: 67215 - DNA, 19801 bp, Oryza sativa
  unsure (1)..(19801): unsure at all n locations
cgcgagagagagagagggaaaaatggggggaaagggagaggggatcacggggagttattccccccactttattgcacgcggggacggcaggaggcggcaggatttgcagcggcggcggcgctagggcgcgggggaggcggcgggagcggcgggaggaaggggatgacgggtgggccccacccgtcagcgagggtggcgggcgggcccgcccgtcagcggcgcgcgcgcggggagaggccgagtgggcagcggggagaggagagagaggaggagggagatgggccgggccggcccaagggagggaagggggacttttagggtttttctttttataaaatcattttaactttgtttatttcttaataattattatttgtgctctgaaaattccactaaaatttatttacgcattttaggcttttaggaaatttacaaaaatcctctaagccttatttgacttttaactttgcacattttaattgttggaggctttcacatggattttaattattctaggcatcatttaagggatatattttagagtcgttttgggacgtgacaggggttttgttggcggttgttaaatgccattctcatacctccaacatctgcataaagtcgagacaataaaacatccaacatagtaataggtgcttaatctcacatattccacaagtgttggtgtatatttgtatgcagatgataaaccttgaagttgggaggaaaatcagactaaagtgaggagaattatgtatccatacaaggaggggttgtgaacttcattgaaacatcagtaaatgaacccaaaactccgagaaatggaaacaggaaggcccaggaagtccaccaaccgaaggccagaccaggagggcccaacccaggttcggccgaaccctagtgatcaggggcggagcccaataagctgagggggattcccaggaacccggcccaaacttggaaatcacttgttacccctatagtttcaccatgtaggaaccccctcagcccaaaccaaggaacccccttcttgtccagcccagaatggaaaaggcccaagtaggcaagcagcagacacaaacacaggcaggcccattcgatggagtcctttgcgctgctcgaggcttgccctggaagcctcacaatcatgggagtcacgacgcggtcaagcgggcattagcacaacacatcgtttcgtcttcaggataatcaagttcgctgtacgcgcctcctcgctctcgcaatctcgccggctgcctccgttccggcggcagcctgattcaaatcgccgacgccaattgacactgtgccccaagccccaaggtcaccgtgctcctgctgctcggcactcctgattttgccgctctgcccgtgatgactggttttagctagggcgagccgagcagcccgagcttctgccctttgaagtttaatcgttgcattgtgtgatcttgtctagttgtctaacagggatgatacattgttgcttgagttggagcctctgagctgttggacggcaacttggtgccgacgtttcatccaagattagctctccttggctctgggcctctggtctctcccaatccaccgacaacctccaattgagagcaagtgagatttcccctcacttctcaaccttatttcttcaatcttgaaaattttcatcttgtcttgaataggttttatacgatctactgatatgttttgtgaatagtgactttgtgtctgtgcttgacactttagtaacttcgtgtatatttattagttggtttctttgttaaggtacacaatttctaaatatttatgtattttcttgttgtatattgctatcaattagataatgatgtttacagttattagacacacgagtatttagtactccataatagtgttccaactagatatgcggctatatacaaaagaaagctgtaggaaccccccttgattttgctctggctccgcccctgctggtgatcgccgttgatcccaggttttggcatggacgtcccagatcacgccctgatggcggttgcggggcacttcggacatttccccttcgccaaccgtcatacctacccctatataaagacatcatctcactcacttcaacacacacttccaagcttgagctaaattataagaggctctattgtactatattgttgttaacgaccaaatttggtaatctaagtattggagatggagttgagaccgaggtggaaattaagatggaatcgctcgaggaatagagcagaatcggctgatgtccgaatcggctgcgactaggatcggcagagttcgagttggacagggttagccgattgagccgaatccgataatatgacacggcatacgttgtcgggttaggttgacgtgcttcatgatgatttccacgcatggatggagtcctgagaaggcaattgtatagtgcttcatgatgattgccacgcatggatggagtcctgagaaggcaattgtatttattaattaggatattttatgtaatttctttagagatatgtttgggcaaatgtctgccgcaaagacttatagtatcttagagtttgttagagataagagtcatgcccgatatggacatattttgtaatctcgggtataaatagaccccgagccccatgtaataaaactaacacacgttcaaatcaatctcggtgcatagccacccttttacttttgttttgtttcgacgagttcttgctttggggttgagctgcatcggtttcaatcttcaacaagaggtaaaacttattgtggcggcttgcattctcgggattagtgcttccatctttatgatactctaatcttgtttatgtgataaattgaattatcatatatcttatataatctccggcaatatcgctatctaacctacaatcggctaacatcaatctgtcagtagaagacagccgattaggttaaataccgatgttgacttagattatataggaaatccaccactctatgacacatccaacggcttgattgtctagatattgtcttttttttcatacttatagatgcatctgttgagtttgatcgtatgagtcgtgattagaatctcaatctctagcctgcctttggttgccaattagggtagcatcggggtttcagccgatcttatctgatttgaatatatttatcttatgtgcttgattgacatgttaaatccgccctttatgttaagatctcgtcgtatttaagtatattaagctttccgtttggtatattgtacttgctttaatatctcaatataaaacggtatcggagtattagccgatacatgctagatctatctgatcggctatgctatgaacatatataatcttgttgttaatatatatttcggtctaagtgatttatactgtctcgacatggcgaccaatctatcccaatcacttgatttaagtatatatcgacataaggattatatattgttaatatcaacagccgatcaagtagatttagttctttcttacttattaatgtctgccgatcgatgcatatatgacatcggctcaaagataaatgatatgtcatcggcatctagccgatcggctatcgtttatagatttaaccgcggtttctttgtctttgtctcttgttgatcgcaggatcaaatcaactggcacgctcacatacccaaaggcaagttttggacctgcactggagttaagcagatctcccagacctcgtgtttttacatcaacacgcttttggcacgcctggtgggaccattagaagtcagaaccgcaacagtattctctcatggctgagaaaccaccagcatcgccgtctttgcgccggcaaagaagtttcttccaaaactaggatcccgaagtttggtgggtctgaagttcatgagagcaacatcatgctcatcattttggacaaattgacacctgaacaaaagaaggatcttgaggcgatgatgtagcaaacacagaaccaattcttgaactcattcatggagactcgccaaggaacaattgttcagaggtacaagatgaaattagatgctgatgttgctgcgacaagttcttccaaggatggggaggtacaacaggtctcagatggtacggctcaatcaggtgataaaagtgctgcagatggctcaggtgataagggtgatggttctcagggagtgcaaggtgaggatcttagcccagatggcaacctggcgcagctacagtttaacaacttccaagatcggattgactatactgtgcgacatgctttgattaatcaatctggagtgttagtcaatactttgtcaaacatcgtgaagtcgatggttgatggctcaatagctgagtatcaggctacaggaccagtttatttaccaggaggtgttttcccaaattatcggcccttgatcacaaataatcagccgactgctcagccaattgctcccaatgcgccatcagttcaaccgacagcaccagtgtcggctcctgcacctgctgcaccatgatcagcaccagggcaattaattaatcctcggttgttggtgagagagcagccacagcatagtggacaaaatgtgaatcggctaactcaagagcaagttgcagctatgttcttaccaactcggcctactgctgacccagttcaacagcagtcgattcagcagacaccaccgaggcagcaagttgctcagccgattcaacagcaaggtttgctaaatgcatcggttgggtttaggacgcccgataatcagccaaggcagcacattgcaaatcaagttgttccagagcatttggttcataatgtgcaaccagatcgatcggtgataccacaagttattcccaaacatttggtgcacaatatacagccaaactttcagaattatcaagggggcaatttgaattatcagtatcagcctccatcgccgcaagttcagtatcagcaaggagggtcggctcagcctcggttcgctcctcagtacaaccagttcgagcctgtgccacagcaagtgcagggggtgcctcaacagagaccgtgggccaatatgattgcagatgtgatgagagagcaatttgggctcaagccaaaggacgctagaaacttgtatcggcatccaaaccctgagtggttcgagagggttccattgcctaaccggttcaaagttccagatttcacaaaattctcagggcaagatagtgtttcgacctatgagcacgttagccgattcttagctcagtgtggtgaagcatcggctgttgaggccttgagggttaggttgtttcctttgtctttgtctggatgtgcttttacttggttttcttctttgccatatggatcaatcaacagctgggccgatttggagaagcaattccatagttacttttatagcggggttcacgagatgaaattgtctgatttaacaacgattaggcagaggcatgatgagcctgtgcaggactacattcagaggagatgaggaataagtgttacagcttgagcttgactgatgcccagttaaccgatttggctttttagggtatgatagctccgatcagggagaaattctcatcccaggactttgatattttgtcacgtcttgcacagaaggtaaccttgcatgaacaaaggtttgcagaagcccggaagaactttaaaaaggttaatcatgtctgtccctacatggatccgatgatgatgatgatgatgattctgaggtagcagcagccgagtgggttaggagtaagaaggttataccatgccaatgggtgaagagttctagaaaagaagagaggtatgacttcgacatcaccaaggctgataagatctttgatttgttactttgggaaaaacagattcaacttcctgctggtcatacaattccatcggctgaggagctaggcaagaggaggtattgcaagtggcataattctgggtctcattctaccaatgatggcaaagtcttcagacagcagatccaggcggctattgaaggaggcaaaatcaagtttgatgattccaagaagccgatgaaggttgatggccatccttttcctgtcaatacggtacatacagctggtcgaacagccgatggggggaaaactcggggttttcaagtgaacttggctaagattatcaacaagtatcagagaaaatatgataagcagcaggaaaggtgttatgacgaagatgacggcggttttgacgaaggtatgaggctgtcgtctattgaagactgtcctaggtgcagcaatgttacagaaatttcaaaccgatcgcataatagaggcaatccgctaaggcaagcaagggttcctgttcatcaaagattgggcccaatgaaccaagattgtgaccaagaggacaatgaaggcagaaagactcaatggtgtccttctggtatttttacaaagaatcagaagagaagggttcagaggttgaggaacagggagcgctttcaggaggttgagcaagaaatcaaccatcggctgaagaaaacgaagccgaagcaggagtggcgcgttaagaatcaagttcctacagctgatgaagccatggccgatgaggcaaaaatattggctaaagggaaaactgttgtgattgcatcggttaacatggttttcacactacctgcagaatttggggccaagcaagccgatgttgatgaagttgaggaagcatcagctaggttggttttatcaccagaacaagcagtctttgagaagccagaagggacagagaatcggcatcttaagccattgtatgtaaacggttaaatcaatgggaagccgatgtctaagatgatggtcgatggtggggccgcagtgaatttgatgccttatgccacatttaggaagctaggcaggaatgctgagaacctcatcaagacaaacatggttctcaaagatttcggtggcaattcgtcacaaactaaaggggttttaaatgtggagctgacagtcggcagtaaaaccatccctacaatatttttttgtcatcgatggaaagggttcctacagcttgttgcttggaagggattggattcatgctaattgttgtattccttcaaccatgcatcaatgcttgattcaatggcaaggcaacaagattgaaattgtaccagccgacaggtcagttaacgttgccagtgttgattttgctctttgggagatggatggccttgattgctagtctggaaaggtttgggaaggagattttctaaaggtgttcgattatgatatacagccgattgaatacggagagcccaagttattatattgagggcatcgtggagggttcaaacgtctacaccaaggacacagtagatgatctcgatgacaagcaaggaccgggtttcatgtcggccgatgatttggaggaaattgatataggtccaggtgatcgaccaaggccgacatttatcagtaagaacttatctccagaatttagaaccaagttgatagagcttttaaaggaatacagagattgctttgcttgggagtattatgggatgctaggactcagccgatcgattgtcgaacatcggttacctatcaaaccaagggttagaccgcaccagcagcctccgagaagatgcaaagccgatatgctcgaacctgttaaggctgagattaaacgtttatatgatgctggttttattcgtccttgccgatatgctgagtgggtttctagcatagttcctgttatcaagataaacggcaaagtaagggtgtgcattgatttcaatgatttaaacaaggctaccccaaaagatgagtatctgttgatggtcgttattgaccaatttcaaccgtcaatattatccaatatatgaagactagctatgcttgcaatgcataattctcaaataaaatagttacttccactatatgctttgctactaacatgtatgcaggagaagcactcgtaaatgaagagaacgaggtggaaatatatcgatcaatcagtcaaaagtctgccaacgatctacaattacatgagaaggcccaaaagtccaatttaataatcacaaatgggcctagaatgtatgtcactgatttaggggcccacatggaagtctccttgaggaagctaagggccagaagagcccatagggggttggccgaccccttgttgagcccaatccagtcacattttggcctggagataagggaggccaaggaggaagcagcaggccaaaaactaggcctgttgggccactctagggttcggctgaacctagtaccttgatctcagccgttggctctcccctttggcatggacgctccggatgaactcctgatggcggttgcggagcatttccgacaattcccatgctctacaaccgtcattgggtgctataaaaggacctcacctccttcactttcaatacacactcaagcaaggatcaaagctctctacaaagttagtagtagtgttagtggagtagagttagaatagttccaagtccgcggaggcttcggggagttcggtaaaggttctatagcttttcctttcttctttgtaagacttccatttatcaatataatattcttatttatacaagttcggtactttattccaatcatagactatgagtaccagtcttagtttattcataagtagtataatctgtgtagttaaaccttctgggatttgcattgatgctggtataatgtctgattacctggtcataagtctgctctggctaggctgagagctatggcccggggactcagctgctctgcaccgattgaatggttgtagagtaataagtagtaatttaagcatggagcttaggttacctcttatcattatttgggggtatattctctgggtgatttgcaggccgctgatggtgacagctcagtacgggtgtctcccctgcagtttatattcctacatacaatttcctagggttggatacacctccgaatcctacatcggttggagggttatgacaggttgtcgtaagaaactcggcaacccggggtaactttgcttttcatcgggagggcatagctatgctgcattgttaaaggggttatattacatagtgtacaggaatagaacatatctaacctactgccacttagctataattaggagatgtaggagttagctaaatccttagctgtgtgtcattctacccttaagctaaacatacccctgcatagacccttgatgtatacaagtaatatataaactattagcatagtactctcttaccatatcttcccttgggattaaacaaatacgatacctaggaatactcccgggtgaaatggtacaatggtatatctgtgcgattccggatcacatctgtaaccataatataccatgagtatttctagtgctattgctgggaattatatttccagtagtgtcgctaagaaataccaacaagcatttctggcgccgttgccggggaagataaatgattaagagtttactacttgctaatagttttatatttacctctgtataagtcattgtccttcgtaggcaaaccttgtttgttttctcttttatgtgaaaacaaggtagtacaggactagttctgatctgccgaccaatttcaaatctggagtcactagtgaagtgaagccgaccccgtgtcgtttatccttaaggttactctatcggcaaccagaccagccaattccgcgccaccagaattacacgatacggctgagaagtccctttgcaagttcgctgctcgctctgctggtaacatactagttggaacccaagtcagcaggggagatggtgactttgatttaaagaccagctaaattaacgatggcgcaggcttgcccgttctgtggcaagcctaaggaggatgcaagtgctcatttgcagcaatttgtggaaagccatagcacgtataccgtcagaagaatcagactccaactgttgccgttctccctcctcgagagagcagaacagtggttctacatcaaccgtgcaacggtgaataccgaaacaattgctcaacagcattcctctcaagattcttcctgatgggcaagaccaacgctcttcgcggaagaatatctagctttcagcagacgagggatgaaaccattcttgaagattgggaaaggctgcaggaatacgtcaccacccgtcctcatcatgggatggccgagtggctcatcctgcagaatttcttcaaatgattaaccccctcgtcctaggatcacctggatgctgctgctggagggacattcttctcaagaatagtcagatgccaaccaattgagaagatggtctcaaatatgggttggagcgaggaacgactccaaacccgtcaatgcggcatgtacaccgtcaagaggacggagatgctcgccgcccagttggatctccttatgaagagactagacaacaatgagaaggataacaagcagggtaccgttaaagccctggacttccacacgacatgtgaggtctatggcaacaccggtcactctgggatggattgcccgaaaacccatgagaacgttatgctcatgaacaataacaatgggtatcgtccacgaggagaccaaggatggagcatttctccatggggtagatcaagaatggaccaaacacaaggaggtcaaagtaaaaccccgaaggacggatagcctcaatactttcatgatgaacttcctggagcaggaagaaacgagtaaccgtcaataccttaagccggcatccaagaagccgggaatacaggccggtcaacctgtgttcccagttacgaagaggccgctgcccgcacctaaggcaaagaaggtgtggcgggttaaggagaagacactcgttcctgtacctccggaactgggtgcctcattgagctaaatacgtcggaggtatggtcgtgctcgtcggacctaaaacgacatcccccttgccaacaggtaaattggtagttatctcatatttattttccattgcatcaaagcatgtttggattttcaaacacacattgagatctgaatttgaggcaaattcttcaaataaatttttgtgagcaaaataaaataaagtttttagaaaacttttgcacagccaccaccacattggtcgttggaatccaatagctaaaggtggggctggttgggtccaccaagggttcggccgaatccctggttcggccgaaccggcctggcaccggctggctggaaatttttgcagggtagcggctagtggggcccacatgccattcctagccgttatccatgcactatatatgtagctcggctgggagaaggaagtcacaccaccttaactcattttcactccctctcaaaaccttgctctaaaaatttattcaaagttttgcaagctcgcctcaaattcacacaatttgctgcatttagtttagacacttgcatatacaagtttgctttagtttggtgcaaggttatcggcgggtatttgcttaacccccgtccgagtagtcttgtattcttgctctttgctgtagccataaagaaacgacttttgggcatattcaagagacgatcaagctcacggacaagccgacacgataagccgagtacaccttcttccgcggatgcatccatgaaggaggcgtacattccaccgaggctgtacaacaactcctttcacgacctcgtgggcgaccgggaaatgcaagcctatcatatgctgaaagaccgaacctgtgctcggacctgagcatacgactcgaccttctgaaaaggataggtatagatgctgagcttcattactttttggcgtgctataggttgggataaatttcatgtgtagacgagccgggttcctggcgggcgccgaaaaggaagcagtgacgccttttcgacgaaagcttagcttggtaggcgctgcttactcaccctattcccttagacaatgcaatgctgtgaacacgaaagtttgcagttcagccctcttctcccatgcagagtcgcaggcagcgcctcggataaaagcatggacgagccacatgcagggaaacttgcacgtgtggttctggccggggaccccggtatactgtactaatatgtgtaggtccctgtaattcgagtgagattgtcatggcgcaaaagcagatatggtccggtattcccttgttccccgtattggttatgttctttattccttgtctagcagaaactaatcgagctccgtctgatctcccagaagcggaagctgaatcagttgctggctataatgtggaatatgcacgggatgcgatccttaatagttcaagtcccatagagttattttttatctttgattcccaaacgctgcgtgcaagtcaagcttacagaattcctgccggggcgccttctttcttatgccagccaagtagtaatcagaaaaccaatcaatcttccttacactacgacaattcacttgaactaccaacatcatgagtgacccaggccggccgtatatgcgtcatttctcttcatcattgtctctatttgttaattgctcgctacccgtagtgggccttgagtaggatttaagcacgggtttcgaaccgtgcagtttttatgtgccatgctagaggtaggcgatggtgttactttccggttattccgcaaggaatatcaccttttttggaaggaccttagcttgcatctaggctttgacaaaacatgcaaaattaatttcaggaacgcatttcctgattttaacaagcgtatgttttggcaaagtatttcgggtctctcatcctatagaaagcctagaactaatgacatccataatcctaccttgaggctgttgcataagttgcttggtttcacatcgtttcttagagctgatatccagatagcgcgaactagtcctcttgtatgccatggttagaaaaaaaatcaacgtttcacccattcaacccatgatcaagcaatggttagaaaatgtgaagttgtctggtcctgttgagtgtatttctttggtgactcgtttagcatgaagagttgggactatgcttaatatgcaagtatctagtattcttgttaccggctcttatgttgatgaggcctatctggttcaaggccacgcactcaaacatggtccaaatgattttgtttcccggctatacaaatgaaattccgttacctaacccggagtttcatttgtataactgccgagaactaaccatttctctccaagcggagttgcctcgtgatgtcccacgcaggataacacggcgtatggggagaaaagcaccccaagaggcgtcttcctcttcaccaccagtgcagatgtatggagacagttgggacccgaccgcgcatgcccttggttggacccaattccggcaacatgacggcggaggttcgtcctggcagagtgccagcgacagccggtggcatgagccgtaggagctgcactggggatactcgcgctccttcagttcaagtggtctacctccatcctcttggatgcattgctcagtctcctctcgaagggatttgggagaactcatccgggggacggatacacttgaactgcaggcaaggaacatgcaacataccttggaggatgatgtggtacagtcatgggaatggcagcagtctgttggtgcacagctcgcaaatttcaacactatgatgcaacaatagcaagctgactggcaagcgtttcaccgctaccagggatttgatccccgccatgagccatagcaagaagcaagcttgggggggatgnntntccnggccgccgagtaacggcagtcctatcacattgcatatttccttttcaacttgcatgtttaaattgttttattgcatttataaatctgaaaacaacataaaaattgcaaaactaaaaataccaaaaagataggttagatttcatatgctaggtaagacatgcttagttcttcatgtcgaaatgatgaatagttactctgttttatatctctcatatatgggttcatggttaagtactctctcaagaattgaataagagtagccaacaattatccgggaacctgaggtaagtgagttgcactttgctgatctgagtctaggttgttgtgagatatgagatagtaaataagagttgctatgaacctattctaagtttgacttgaattccggatgttttattttccaaaatgataaatttgaaagttcctcatttgatataaattcctaccagagccaaaaatatccatattgattaagccatatacattttggttacttgtaattctattgaactttgtcaaatctttgtgacttgtgtagatactattcatgctctatgaacgagatcatacacccacatatgcacacatatgctaagcttctacactagaagatagcatccatatcatccaccatatccatgttatcattatccacaaataagctctccatccatgcttcctttccaaagaaaaatcctttgcaaaaaaaataaaatttaaaaaaaaagagggaaaggtatggctatgagaaaaataataaattcttgctctcccaaaattggagcatgaaagaaaaaaaaagagagaaaaaaaaagagaaaaagtagccataccctctctatgaaaattaaaggatattttggaggaaaagcataagcacaaagaagaagcattttctgtatccacattttattttctatcatgttttccaccatattattcgcacacactttgcacgatcttgatcttgagtatgattagtcatctattttagtccaagtttttgatttagtaataaatgtgaatacaagtgtgccatgttttatccctaccaagctccacatatcaaaccttagagtaggaatcaaaaggcaaatctggtgaggaatccatattcatacactttgagtgatctagagaattatttgaggaacttggctttcttttgcaaaaatcattttaaaacttccggaatgaaagttaaataaagattgggtaactagcgctctaattactgttctgtctctcaaccgctcaagacaaggagatgcagtgtttcgtgggaatcaggggtaagggtaagccaccatgccaaacatatttaatttgagatagagtacccataccttgcatctatatctttgagatatacaacattgcagcaactcctgatcaacaaccaagtctttgttcctttcgtcctttactcgggacgagcaaaggttcaagcttggggggttttgttgacggctgttatcgaccaatttcaaccgtcaatattatccaatatatgaagactagctatgcttgaaatgcataattctcaaataaaatagttacttcaactatatgctttgctactaacatgtatgcaggagaagcactcttaaatgaagagaaggaggtggaaatatatcgatcaatcaatcgaaagtctgccagcgatctacaattacatgagaaggcccaaaagtccaatttaataatcacaaatgggcctagaatgtatgtcactgatttaggggcccacatggaagtctccaggaggaagctgagggccagaagagcccatagggggtccgccgaccctttgttgagcccaatccagtcacattttggccaagagataagggagaccgaggaggtagcagcaggccaaaaaccaggcctattgggccactctagggttcggccgaaccactaggttcgcccgaaccttgatctcagccgttggctctcccctttggtgtagacgctccggatgaactccggatggcggttgcagggcatttccgacaattcccatgctctacaaccgtcattgggtgctataaaaggacctcacctccttcactttcaatacacactcaagcaaggatcaaagctctctacaaagttagtagtagtgttagtggagtagagttagaatagttccaagtccgcggaggcttcggggagttcggtaaaggttctataccttttcctttcttctttgtaagacttccatttatcaatataatattcttctttatacaagttcggtactttattccaatcatagagtatgagtaccagtcttagtttattcataagtagtataatctgtgtagttaaaccttctgggatttgcattgatgttggtataatgtctgattacctggtcataagtctactctggctaggccgagagctatggcccgaggactatggtgctctgcaccgattgcaaggttgtagagtaataagtagtaatttaagcatggagcttaggttaccgcttatcattatttgggggtatattctctgggtgatttgcaggccgctgatggtgacagctcagtacgggtgtctcccctgcagtttatattcctacataaaatttcctagggttggatacacctccgtatcctacatcggttggagggttatgacaggttgtcgtaagaaactcggcaacccggggtaactttgctatgcatcgggagggcatagctatgcctaagcatagctatgctgcattgttaaaggggttatattacatagtgtatactagttagaatatactaagatgttgtatacttgaagtacaggaatagaacatatctaacctactgccacttagctataattaggagatgtaggagttagctaaatccttagctgtgtgtcattctacccttaagctaaacttacccctgcatagaccttgatgtatacaagtaatatataaactattagcgtagtactctcttaccatatcttcccttgggattaaacaaatacgataccttggaatactcccgggtgaaatactacaatggtatatccatgcgcttgcggatcacatctgtaaccataatataccatgagtatttctagtgctattgctaggaattatatttccagtagtgtcgttaagaaataccaacaatatccaatgctagtagcctatcagctgattgatgctgcttcggggcagaagatattgagttttatggatggaaatgcaggatacaatcaaatctctatggccgaagaagatatccataagaccgcttttaggtgtcctggtgcaatcggcttatttgagtgggttgtaatgacttttggcttaaagagtgctggagctacatatcaaagagccatgaattatatataccatgatcttatcggctggttggttgaggtctatattgatgatgtggttgttaagtctaaggaaatagaggaccacatagctgatttaaggaaggtttttgagagaactaggaagtatggtttgaagatgaatccgacaaaatgtgctttcggtgtatcagctggccagtttttgggatttcttgttcatgagagggggattgagataactcagaggagtgttaatgcgatcaagaagattcaacctccagagaataagacggaattgcaggagatgatcggcaagataaattttgttagaagatttatctctaatttgtctgggagattagagccttttacgccattattgagattgaaagccgatcaaatgtttacttggggggcagagcagtagaaggctttagatagtattaaggaatatcttagctcttctccaattttgattcctccacagaaggggataccttttaggttatatctatcagccggtgagaagtcaatcggctcggttttgattcaggagcttgaaggaaaagaaagggttgtgttctatttaagtcgtcggctcttggatgcagaaacaagatattctcctgtggagaagttgtgcttgtgcttgtatttttcctgtacaaggttaaggcattatctactgtccaatgaatgtactgtaatatgcaaagccgatgtggttaagtacatgttatcggctccgattttaaaagggagggttggaaagtggatattttccttaacggaatttgatcttcggtacgagtcgccgaaggcgattaaggggcaggctatagccgattttattgttgatcatcgtgataattcaatcggctcggttgagattatgccctggactttgtttttcgatggatcggtgtgcactcatggttgtggtatcggcttggttataatttcccctcggggggcaagttttgagtttgcttatactattaaactatgcaactaacaatcaggctgagtatgaagcggttctcaaagggttgcaattactcaaggaagttgaagccgatgctgtggagattatgggtgattctttgctggtgatcagtcaattggcaggagagtatgagtgcaaaaatgatacattgattgtttataatgaaaaatgtcgagaattgatgaaagaattttggctggtgactttgaagcatgtatctcgaaaacagaatgttgaagctatgatttggcccaaggggcatcgggttacaagccgatgatgaaggatgtcaaaatagaaattgccactataacaaccgatgattggaggtatgatgtgcatcattatctgcaagatccatcccaatcggcttctcagaaattgcgatataaggctttgaagtataccttgttggatgatgagctatattatcagacgattgatggggtgttgctctgaagtttgagtgccgatcaagctaaggtcgcaattggtgaggtacatgaaggaatttgtggcactcatcaatcggctcataagatgaagtggttgcttcggcgagcgggatatttttggccgacaatgctagaggattgtttcaagtattacaaaggatgtcaggattgtcaaaaatttggagcaattcaaagagcgccagcatcggctatgaatcctatcatcaaaccatggccatttagaggttggggaattgatatgatccgtatgattaatcctccatcgagcaagggacacaagtttatattggtggcaaccgattattttaccaagtgggtagatgcgattcctttgaagaaagttgattttggagatgctgtacaatttgttcaagagcgtataatctatcgatttggtattcctcaaaccattacaaccgatcaaggatcaatcttcgtgtccaatgagtttgttcagtttgccgataacatgggtatcaaattgttgaattcttcaccatattatgcacaagctaatgggcaagccgaggcatctaacaagagtttgatcaaattgattaagagaatgatgatctcacatgtgccttgtgcaacacacatcaaagagagactaggcttcatctcttttttacatgtcccttcagtgtggcttgttggcagcagatgggcatttcctggaattgtaatctggagtttttccaaatgcttgtcttggcgagaattagatttgctcgaaagggtttccttgaagtttttttcatggcagcatggcatatttggaagcaaaggaatggattaatctttcaatctgtccagccatcaattcagtcatggaaagctatgtttgttaaagaagttcatctgcatatgtgtagaatgaaagatcctctcaagcaatccatttctgattggatacaaactttgtagcatttttgttttgcttttccctctgtaactttgtacatatctttattttataatatttaaactgctgggcaaagccctggcatactcgattaagagaaagatgattaagagaaagatttctgattatcctcggcagtggcatactcgattggccgaagcattgtggtcctatcggatggcttgtcatggttcgatccaagtctctccttataagtttgttcatggacatgaggctgttttaccatgggaagttagaatcggcataagaagaacggagttgcaaaatgatttgacagccaatgagtattataatctcatggctgatgaaagggaagacttggttcaatcaagattgag

SEQ ID NO: 67216 - DNA, 5643 bp, Oryza sativa
tagggactcaagataacaaattcggcaagtggtcgctgaattgggaaggaccgtttcaaatctataaagttgtgtctaagggagcttacatgttgcaaagacttgatggagaagtttatggaggagcactcaatggaaaatattttaagaaatattaccccaagtgtttgggttaatgcatgatcggctggtgttgccgatacatgatagctgatgtatttacatcgccttgagatggccgatattgttgtatcgcgcttagttattttttctattgtaatcggttgtgttttgccgatgtacaatggccaatattgttatatcgcccttagttcaatttataattttatcaatgcctttgacattgtaaaattatggggggcacatatatgcaaagttgaaaaatttttgagcaaaaacgaggagttatattaatcggcacaaaggattattaagacaagttaaataatgtaccagaatgtcttagccgattacaaaatctactatatcctattacagaatgtcactgagacaagtggcgctggatagccgatatagctctctgcctaatttgttctacttcttcaatggcctgggcgtcttgagcatcggttccagagatgacttttaaggacttggtcatgtcagcgacatttttgatggccgatttcaaccttgccttctgttcttcgacagcttgcgggagatcgggtagcttattgtgttccaaatccagttcggcgttgcactcttgaagttgtgccaagagctcaatcttacgagcttcaagccgatcaatattggatttgatcaggccctcggatagttgatcaagcttagccttttcttcatgaacaagctgccgattggcctggattgtagcttcaatatccctacgctcccagcgttcggttaatctcagtttggatttctccagtttgaattgatgttgttcaagataagcagctggagtgaggatgtcggctagttcttccgggatcagagcctgaacttcgtgtagccgagtcctaattgatccacaatctaccaccaagctgtctagagatgatgcctctaacgaatgagagatatcttcaagagtcttcctcacatcattggataagggagctaaagctttgcttgtggtgtcatcttctgtctcatcaaagtaatccttgatatcaaaagagaacagatcggctaagacctgcaaaaataattcaaagagacttagatgccaaatagacatggccgatctaagtccttgtgtcaaagggaaacttactgggatggcagaagcggctggttgtacttcttccttgacatggtgactccctgcagccgatggaatttggtcacttgatgattgctgtacaggggaagaaggaggaggaggaggctgcaaaaagagataagtgctagataagatcggctatgattgactagtgaaagaattgagaatatcttactggtggagccaatttgagagttgttgctgctgatttcttcttcacagcagttttcttcttctgcaattataaaatctataagcaatcggctataaatgaaatggttgcaaaaagaaatcaaggagagttgtttaccctggaaaaatgagctggagcggaaggagccggagtagtttgtttaggtgaagccaatggttttctttcagtatcgcttactctagctgcagcttgatcaacatcttctccaatctcttcttcatccagagcttgttcaatggatggatctagggcaggcaagtcatcggttggcttggtcttcttcgacttagctttcttctttggggctggagccgatgggtctatagtcgatgctctggtttttctctttttgccggcatcggttggttctctaatgagcccttggagaagacttgaagtcttgggggcatgatagccgatgacagggggagatggtccaccttcattgggaatgagacttggagcatattcgatgtatttgccactattgctcttgtgagggggagaggattctgttgtctgcaaaatagaagagaagattagtcaagttatgaatcggctgacaattgttcaaatagaattaatgaagtcaaggtgtacctaggggataacattggaaaagagatctgtcatgtacatagaagccgattgatggaacagatgcatcttccattcaccccaccatctgtcaaatgccccgctcctgaaggttgccagctctatattttcaatgctgcccaaaggaggtccttgaagattgagcaaccgatccatcattagggttgatgaaatttctcctcggcattggattttatcggcaaagaacaggccgattggtaattgacccatatcaaactgtctggcagaactcatcggatgataaaattcataacaaacttggatatttcttccttgatgaatgccgataggaaggatgcatgggctgattgcagccgagaagacttctctggacttttggtatctctcgtggttgatgtcttcaaatctaaagtctgatgggagctctagaagtggtgagtcctcataggggagggggggggggagggtgtttttgaaagccctcataaaagctgcagaaccaatctttgagcagctcagccgataactttgctccaacatcggctggtgtggatgcatattccccataagacatacatctgcgatgggtgcgttcttctccatcgtcttctataattggctctagtcttgggaattcggcttctgtcacagatggccgattgacaaatttcataaccatcagatttagccaagtctgcaatagccaccatggtccacctgttccaactactaagccgacagctattttggccgatgctttatttaacacttggtataggtagccgagaagaattttgcctaagggaaattgtttctttgattctagggcttcggctacaaattgccagttggttgtaggaccacaactggatccacagaaaaggaacttttctagccacatcagcaagaaagccacatgttcccgaggagtgacaggccctttgcccatgtatgccgctacatagccctacatagccagaccaaccacctatgcttttggtcctgaaatcaaattggttcttggtgttcatactcatagggttagctgatgaagttacgtctaatccggtaatcatggtgatgtcaatcaaagttggagtcatcggcccttggttgaacaggaaagcgttgatggtattggactagaaataggtggcggcggccattaaaggttcatctttagctgaattggctatggtaagggcaagcacttggccgattccgatttcgtcccagtgaactttcttgctagccgacatgcgcttgtaccatatagtccagctcttctcgggtgaagttttctcgagagatggccaagatttgaaggtattcttccagtgtcctagatctgggttggctaatctgaaaggaatcgtattggtttcaccgatgatgaacttagtaggatcaaggttgccgactgggccgagaaagtaatggttcttgtgagataggctcggaactgcgatcagattggaaagatgctacgaatccaaaagaacagggaagaagaaaacaaaagataaggaaagggaaaactaatctgatgcgaaaaaagaggatctagccgatgagaacttacctccacgtattcggctgatgatgtggcagacgggctagtggaggtcgacatcgctacaggcgaaaagttggccggacaagaaatcgcctgggaatcgccttgcgcaccgaggggatcgctggagaaagagaggacgaagtttggcttaagcggtgaaaacagaagtcacggtgtgaagattctcggggatgacggttagtatttaaagcactgtgtagatttctctcggaaaacggcaagtgcggatttctctcagagtcgacatgtagcaaatccgaaacattttccaatattccggacttggggggcatgtgttaacgaccaaatttggtaatctaagtattggagttggagttgagaccgaggtggaatttaagatggaatcgctcggggaacagagtagaatcggctgaagtccgaaacggcagcgactaggatcggcagagttcgagtcggacagggttagccgattgagccgaatccaacaatatgacacggcatacgttgtcgggttaggttgacgtgcttcatgatgattgccacgcgtggatggagtcctgagaaggcaattgtatctattaattaggatattttatgtaatttccttagagatatgtttaggcaaatgtctgccgcaaagacttatagtatcttagagtttgttagagataagagtcatgcccgatatggacatattttgtaatctcgggtataaatagaccccgagccccatgtaataaaactaacacacgttcaaatcaatctcggtgcatagccacccttttacttttgttttgtttcgacgagttcttgctttcgggttgagctgcatcggtttcgatcttcaacaagaggtaaaacttgttatggcggcttgcattctcgggattagtgcttccatctttatgatactctaatcttgtttatgtgataaatcgaattatcatatatcttatataatctccggcaatatcgctatctaacctacaatcggctaacatcgatctgtcagtagaagacagccgactaggttaaataccgatgttgacttagattatataggatatccaccactctatgacacatccaacggcttaattgtctagatattgtcttttttttcatacttatagctgcatcagttggatttgatcttatgagtcgtgattagaatctcaatctctagcctgcctttggttgccaattagggtagcatcggggtttcagccgatcttacctgatttgaatatatttatcttatgtgcttgattgacatgttaaatccgccctttatgttaagatctcgtcgtatttaagtatattaagctttctgtttggtatattctacttgctttaatatctcaatataaaacggtatcggagtattagccgatacatgctagatctatctgatcggctatgctatgaacatatataatcttgttgttaatatatatttcggtctaagtgatttatactgtctcggcatggcgaccaatttatcccaatcacttgatttaagtatatatcgacataaggattatatattgttaatatcaacagctgatcaagtagatttagttctttcttacttattaatgtctgccgatcgatgcatatatgacatcggctcaaagatcaatgatatgtcatcggcatctagccgatcggctatcgtttatagatttaaccgcggtttctttgtctttgtctcttgttgattgcaggatcaaatcaactggcatgctcacacacccaaaggcaagttttggacctgcactggagttaagcagatctcccaggcctcatgtttttacatcaacaattctatactagaataggaagagagtagagtagaagaagttggaagaattccggagttgtcggtaatcttctcctatttcttttattctgtttattactctgaattcaatataatattcttcttgagta

SEQ ID NO: 67217 - DNA, 1666 bp, Oryza sativa
tactggagtaaccaaatttggtcggtcgcccaaaaaccacaatagtcccggttcaaatagcaaccgggactaaagataattggagcctgcactcgacctgacaacttgttgaaccgagactaaaaataatctttagtcccggttcctatttgaaccgggactattgtggtttttgggcgaccgaccaaatatggtttctccagtagtggatctatttatttatttaccattcaacaaacatatttatggggtaaatttatcattcttgtcttgataaggtacatgaaggttttatatatttttaagtgtaaaatttggtacgtatgtatctctagttatatgattattttcgcggtatggaaaatttagttgtcttttgagatacattttaaaggatagtaaaatttctctccttttcttattatatgctaaaactctactcgtttattgacttattgtccatcatagattctaaactactcaaatcgcaaaagctggagaagaaggaggaaggctcggaaaaaaaaaatatatatggtcaaaacctcgtggtgcaatcgtaccaaacgtttcctcacatgcatactgaactttgaaaagtatgaaggaatcctctctcacaagtcaattaaacaactgcgaacaaattaattataaatgagctcgaattgtgttgtctctataaatactgaacgatgatggcaagcagcaggagctcatcattcatcccaatatctattgcatctgcaagagcgatcgagagagaaaaacaagatctatctatagcagctagctagctagcacaagaacgatatgccggtcttcactgcatcattccagtgtgtcaccttgtttgggcagccagcatcggcggccgacgcccagccattgctgcaagggcaacggccgttcctacaccttcacgctcgccgccgtcgaccatgcggtaatccatctcgatagcactatatatatcgcgctatacatatatacgtatcattaattgctgggttctacaattaatgttccggtgaactaaacttttctatggacggagggagtaattaagacgataacggaatgtctaataattaaatgacagtgcatgctgtctgtttctttatgtaggattttcatgtagtcctttcgtttaaaaatgcatggtgccgttgacttttcacacaacgtttgactatttgtcttattaaatttttttatataaatatcatttatttctttatgacttgttttattatcaaataaaatataatcttaacttatacatttacatatttatactaaatttttgaataagataaatagttaaacgttatgtgaaaagttaacggcgtcgtacatttttaaatggagggagtacttgataaacattctcacctcacctcacctcccatatatgcctgattttcagggcccatgctaataagcaaatcaccgccgtacccggcctcggaagaaacacgcgaatgggaagcagatggacaacatgaacacacggtactgtatacacgtataagcttcacactaccacatgtttcaaaatatagtaacctaagacggaggatgtattaagcggatattgatcattaattgtgcatatgcaaatttatgaacgaattaattgacactgataaacccctatctcaaa

SEQ ID NO: 67218 - DNA, 8333 bp, Oryza sativa
agtaaaattttgggtattcaactaattttattagatatatgtgtttttcttttattactaaaagctctttattttggccaaaatccattgctatttgggctgttaaaatctgaaccgttctaatacatttttacagttttggtatttgttatttgtcatacgtctctgaggtaataatgtcagtaaggacaaaggaagcaatatgcatagacaatatcgttaatttactccatcgatttgagtgaattttactttaagccaccttttgtcgtataagtttcacttttgaacacccttaatccaagctttttattttggactagctaacttcacgtttgttgcattttaaatcacgtcaattctcttatatggacatgtttattctctactatgacaaatgtatggcacgcttgtaggcacataattttgcaagcgtaacagagccaaacatgcttgaggttgttgatgtgctaaagaagcggtcagaggtacttgtaggggttaatatgtgtttgtgcgtgtgtttatagtggtgagtgtacagtttatatgagtgcttgcctctatattgtgcttcgcaagcttgagctcgttgacgaccgtactcctagaaaggagcttgtgctcgttgcatccacgagggtggcggcgtttggatgaggcttcgcccgtctctcttcgccaaatctggaagtgttgacaaagatgagaaggtctacactgtggtgatgtagtcgaggtaggtttgtcactgtcagactcgggtgctgaggcgatagacacgttgctaaagctccgatgccaactcacacgcactagctgtctgactcagcgagaaactcgcagcgacccaaactatggggcttgtagcatgggaggaatcacaacgataagacatgactctagatgaaactaggtgatatgtctcttgctgtgaaatttacggatgaataagtgctagtaaaacattatagaaatgatgatttaaaatgttgtgaaaattatggaggaagatgattcgacgtaattgtatgttgaactttacaatattatattttagatgacgtgttatgtttgtatgatatttaaaatgctctagaatagtaattgttaggtggagctccgacgaacgtcgatggagaaaatgcacctatgaaaaaaaaaacctcgtccacacgcaaagagacacacaataaaactgcttttgataactgagggaactgtgtataactggttccggggttgagtgatggtaattaaaccgagggagaccaaaataaacttttcacctttattttatggactttttttttatgctacaccgcctgaaggcctcacagactcacagttttaccgggccgtatccgagcccatcgtttagcttcgattcgaccattccccaaatcccaattaactgaaaaaaaaaaaagaaaaagaaaaaagtctcctcccagtagtgagtccaaggagagggtattcgaggggttcagtcgaccggcggcgagcatggcggcggcggcggcggcggcgggtctggaggaggccctcaggcccttccacgatagggcctccgatgccgaggttcgcgctctcgtatccttgagttcctgaccgtcgtctatccgcgcttcgtttcgctgtggtcagagttgttattaggttattaagttgttaaattcgttcgttgttgctaagagcggaagtaaatggaactagtaagaatttttacttttccagaaactagaacatagatggtcagttcgtatggtgggcttgatttggagcaaagtcaaatcggttgagcgatgaactagtagctagtgctagcatattttagattccctttgctcttatattatccttttatgacttggtggtgttacctgatttcagtggataatccatatgatcaccaattgaaagttttggcatgaaagaacctgaggaaacttcgaaaaaacgtacaatttttgcgttatctagagtatggtggtaatgatgttttagggcgaggtctgcgtgatatgtactacataaagacaagttctcacctccggtctgctttaatagagacaacctaattccatatgttaataaattctaatgtatgcctcagacttacaaatcgcgatccttttcagtataggactagctttcccccatgccacggcaagtgcctaaattagattgagaatttggcttgttgctgtattacctaatacctaccaacgtctactggataactcagtggttttagactgatagttgtcctgggaggtatgccgcatggctatgtttctttattgtcagtcagcatgaattgatgtgtttgaccagccacgcatcgaaagcaatggcattctcatctggcttggttgctgtggttacacgaatgcgaaataggtacaggtggtcttctcaatgttttgttcccatatcttacgctgtttctttcatcttgtagacacgtttagcaaagctggaagccttgctgctgaacaaaggtaagttaaatatgggtgtagcatttcacaggtgcttgttggtaagagaaatgcctcattgttcgtttacatggttgatttatcagatggcctgacgagtggttcagagacaaattcatcagccgtgaaagatcttcagtcaaagcttgatgcagttaacacagaatgtcttgctgaaaaggaaaaggtattcatctagcttgaaaatgtcaccaattgtcaccatcatacagctgtttgatatataaccatatctatgaacgatctctgtagaacaagaagctaatcatagagaacgagaagctccagtaccgtatcacccatctcatccgcgcattgaaagaggcagattcaagatagagagccctaccaagctggacctaaagctaaatttgtttaaattgaagcactgtgtatgatcttgtggttttgtggactgcgtgttcttagcaccatccatgaatttagccaaaactattctagcgatcttgatgggtatggttaaagcaaggtattgatttcgaatttttgaaacataattaaactgcttgtatttgactattacacaaaattgggtgcgactccctgtcatctcccatttcgcaagatgatttcagtgctgaaaagtgaaaaaaaattgctgcaattcaactcaatgtacagttgatatgacatgaaatcttttggagaactcaagagtaatgtgattaagcaaagatattttgatcttttttgatgaaggtgggtgtgtgattgctccgacaactttcatgccagaagacaaaaaaggtcatcactttacttgtaactcacattgcctctcacattcatgcaccattgcatcctttttttcaccaaggaaaaatatcctcctaccacttgttcagactaaaagcatcctccaatcatgccatccatttgcattagtggttgatactgctaattttactgttctcaatgctcctcaatttcccaaactactcatgtaaccataaccatccactcgatccctgggaaaccagcattagcctcgtgacaagggaaacatagaactaatgaacacaatcccatccgcgtgcaagcaggttaatcacacaaaatggcaccaaattcgacagcgaaaggagctgggtaaggggagcctcactcgtttccttgttagtttatcatccacggtttaaaaacctttttttttaagaaacactgcaaacacagacactcaaaaatgctcacacattcacctttatgaacacatatatacatcctaaacctgtaaaactgtgaacaccttcaaaaaaaaaattggaccaacgtatcttgagattgactaaatcatcacggacgtctcgctattgacgggtaacgcctaccactgaagggataattaggtttaaatgcaagcatccatgtcaaatttaaaacttaaacccgggttaaaagttttttctcacatagtctatttatcagcatcggcttgaaaattgttaataagtcagttttgaaagtttgcaccacaatcatcttagcttgtcatccaaagtcaaattttaaaatgtgaaactcaattttagagtttaatttgtatttttttccatggcagtcactttcccagttccggtttttgaattgctgctattaacgcagttatgaaagtttgcaccataatcatcttggattttagaacttgcagcctcgtatttttatttatgcttatgcttatcaactaaaatttaaatttttcaaccttaaatttagagttgattttgagggttttttcatcgtagcttattttttagctttgcttctaaaccgttaagaacacacatataaaagttttatttataaattattttttatttataaatatactgtttcgattttttttcttcaatatgacaaacgtttttttttgagaggacaatatgacaaacattgaggctgttggtaaacactggaatttcccctgtgattacatacgtgtgctcgtaatgtttcttatcacggactgttgaatcggatggggagagaaaagtttagaagaaaaacaaaaaaaacggacatggggttagctagcgagctcatcgcaccttccagaagcgaacgtggcaaccttccctgggccccacccctcccctcccaccgggccatgtctcatcgccaccctacccacactcactgacgtccggccccacgcggctgtccccaccgcccccgccgtcaccgacgcgtgggcccggggtggctgtccccacatgtcatcgactccgtagtacggcctccctcccgtgcacgcaaggcacccatcccccgctttaaattgcctcgccccactgaccgccgccgcttgagctgacctgaccccgagccgagccgtacaccaccggaggaggaggaggaagccggcgaggtgacgctgcgagatcgggaggtagggttcggggggaggttttgggtttggtggatggtcacggcggcggcggagttcgtcgatgggcaggtcgttcagggactcgctgaaggtgctcgaggccgacatccagcacgccaactcgctgtgagttcagctcgcccgtttcatcttcctcttcctcctcctgcttgtgttcttcctgtgtccagtgctgagggtagaggctgctgctcctgctgtgagatagtattgatgtgtgctttctgaaattcgttgagcttgttgtgtgttgatttgggggctggcttggatgggggtacattaggattactctatggggacgttgctggcggcgcaaatgtgatctcactggtggtgatgtttgatgttcactgctcagtatggtcagtctagttggagactgtttagaaggtatcaagctgacattttcttagtcacctcgatttgtggttagacattttaataggcatatatgttaggacttgcgataccttggatgtgttccctgtttatattgcttcagtagtactgaaagtttctgctggtaatggcctttcatggctgcagtgacacctgtcaccagatatactgcttaagtggccaaagctatctcctttggccttgcaggtctgtttgtactactttggttttgtcatcatgaggttttcttttttgttgttgtcggtgtgctatgcagttgtgctgctggttcatcacaattcgctatcatcgtgtgttctgaaagccgtatttggaaattgttgtccacaacatgcgctacacactaagagctaatatcatttggcccaactaactactgatcatgaattttattatgttgctgttacatcttttggttggagctgtgtaaaaaaaatatggctctcatgttactatgttggccatggtaatttagtatttcacttgacccctatagagttgttgcttactgtcctatgtggagataaagaagcaatatattaatgtatttttttatgaaataactaagtgacaggcagagagcatattttacattcctgacaactactatgtttggtatgatagacctgttttgatgtttttacaatgtgtcaagagacttgttgaaacttgagacattcatcagtctatgaaccagggtccatgttggttaatgattgagatgtccagttagtaaatggtgatttctatgatccatgttgctgttacatcttttggttggagctgcatatacaaaatatgactctatggagttgttttctattcattgtggagataatgtgcatgtttaatttgttttttttttcagaaataaccaagtgacaggttgaaaacaagtgttttacattcctgacaactaatttatttgctttaatagatctattccaaggtttttacaatgtatcacagatgagttgaaatattgagtctatgtaccaggtgccttaattgtttctgaaatttcaactttcaataaacatgtgcacggagtagccatgagagtacatttatttatttagttttcaaattttatatgtagagaatgatgacaaatggtttgttgatttgagtacacctattgcaaactgttagcataggtctgcaaccatatttttagccattcacgtataacatcgaccatattgttaatacccccatactgtgatacaagtccttttattgaagattcagaagtcctaccgtaccatgtatatcaaacttgcagaaagtcacctgagtctcatgagacattcagctctactccaaacatcaaactttgaatagttatttttggataaagctctacagccgtctagctactgagctgcctaagatcattgttttacaatagttagactaaattattttgtttgtaaaaatgcagtgctgctgaatttagaagggaatatgatggcgcctgtcttcagatgagaatgtcatactgtccagctgcacacttcttcctttttcttgtgcagtggacagattgcaaccttgctggtgcacttgggctgttgaggattctcatttataaggttgagaacagtcctgtttagccaagttcctttctaatgctctttctgctttattaggagccatggttaatcttaactatacaggtttatgctgatgggactaccaccatgtctgctcatgaaaggaaagcaagcattagggaattctatggtatagtgcgtactttggatatcctattgttttacacatatttcttgaactgttctttttttcattagtgttggggttttttctgcagctgtcatatttccttctttgatgcaactacatgaagggatcaatgaagtggaagacaagaaacaaaaggcaatctgtatagaaagatatagaagacgagatgaagatcagaaaatggtgatttcagagattgatgataacatcgaggaggaatgtggcatatgtatggagataaatggcaaagtagttcttccaacttgtagccatgctatgtgcattaaatgctaccgtgactggtacacatcttcactcttctctctgtggcgtttatattgtataagggggttcagttcagaaaatatcttttatgtttctctagctgtatagcaatagcacttctgcatgatgaaaattacatgttggatcttcagtttaattaattaaaacaatgagactgttgctaaccatcatggtgtgccagtaatatttcgattccttcaatttattagaatcaaatgaaagaattaccctgttcctatgtgcttactaataaaaaattggacccttttgtgcttccttgaactctctgcggcttgcgatttaaatcattaattctgttgagcctggacaagtgaaagacttattcaaagaaagctcaagagtttgatgtcccatgcctttctgatggagaacctaccactgcttcttctaatcctgaaacagggcttggcctgttgacttagtcattgaaggtcctccaaccttaccccacccacggatgatattctaaaagatagagggtcacagatgattaaaaaatagatacaaagacatttaaagtaaaggggtgtatatattattcatatcctctatctacggaaaaaataaacagagttcgtttttgggttccctgaaggctgaaggtcccagtggattggtcttagcttgctagctactgtactactagttcatgttctggaaacttgctggtggtagttgttaattggagcctttgaggctatgtggttaacaatctctaatggaatggagcaacctcatttcagttcttattaaatggctggttgctttcagtgacatatttatctttcaggtttattaatttctggttcaaatgttcaaaattttggatctttgatacaggaagtaaagaatagtgattgaaa

SEQ ID NO: 67219 - DNA, 3016 bp, Oryza sativa
ccccccccccactgaggtaacttgtatcacattgcatatttccctttccaattgcatatttgctttccaattgcatcttataaaacttgaaaacaacataaaaatttgcaaaatagaaaatatcaaaaaaaaaggataggtttgagtcatgctaggtaagacaagctagttctctttgttgaaatgatgaatagttgctctgttttatatctcttatatatgggttcataggtaagtattctatcaaaggttaaatatgagtagccaacaattatccgggaacctaaggtaaatgggctgcacttgctgatctaagtctaagttattgcgagatatgagatagtaaataagaattgctatgatcctgatactagtttgacttgaattccggatgtttgtttttcaaaatgataaattgagagttcctcatttgatataaattcctaccaaagccaaaaatgtgctatcatgattaaaccatataaattttggttgcttgtcattccattgaactttgtcaaactcttgtaacttgtgtagatacttctcatgctctatgatcaagatcatacacccacatatatgcacatgctaaactcctacactgggagctaagcaatattccatattaccaccaaaaataaattctccatactttcatgtgctttcttctcctaaaaatgaaaatccttttgaaaaaaaaagagaaggagggaaaggcatggttgtgaaaaaataataataataaagttatgctccatcaagcatgagcatgatgttgaaaaaaaactgtagccatgccctctcctaatcaataaaagaaggatttttgggagaagaaagtaagcacaaaggagaagcatttttctttatttttcctcatgtaccactttcatcatacaccacacacacattttgcacgatcttgatcttgagtatgtttagttatctgctttagtctaagtttttgctttagtaataaatgtgaatgcaagtatgccatgtttgatccctaccaagctccacatatcaaaccttagagtaggaataaaaaaggaaaaactggtgaggaattcaaattgatacacttggagagaccgagtgaatcatttgaggaacttggttttctttttcaaaatcatttgaaaacttctggaataagagttgaatgaagattggatgattggtgctctaattgttgttctgtctttcaactgcccaaggcaaggagaagcagtgtctcgtggtaatcaggagtaagggtaagtcaccgtgtcaaagattatttaatctgagagagattacatataccctgcacctgtatctttgagatatgcagcatagtagcaactcctgatcaacaaccaagtctttgtttccttctgtccttcacttggaacgagcaaaggttcaagctttgggggttttgttgacggtcgttatcgatcagtttcgaccgtcaatattactaaaatagagaagaactagtgatacttgcaatgcatatatctgttagaataataatattccactagtattaggtatactaaccttttgcagagaatgacaataaagtggaggagaattgtcacgtcctgataaattcatcccgaaataaaaatcattccctaaaaggaataatagaattaattaaaattcaaaaagaaattggcaaacactaaaatacgtacaagaaaaattcgaatatggcccggagaatttttgttaaattctccttggtctaaaaggagccctcaaattttacttgaattttcagagcaccggaaataattattaagcaacaacaacatttatcaaagtttactaaaaagaaaaagctaaaaataaaccctccttcctcctttgggctgagcccagcccaaagtccttccctcctccctctctttttccatccctctctctctcttgggcctccccttccccttccggcccactccatactctcctcctccttctgggccgaccctcccctccctccttcccctcagcccagctccctcctcctccctctccctcccgggctgcctctccctcctctcctcctgggccgcctccgggcccaagccaagcggcgccctcctgcccgtgccacgcacgtgcgtgcgctgacggcgcgcccgcatgggtcccacgcgccgggtcgttgtcctcctcccgcccgacctcctctttctctcccggaaacctagcgccattcctccccaaaatccacgcgattcaaaccgggaattccaaaattgattagggggaattaatcccctttccttcctattcaattccccccaatttcccccttgattcgtgccctctaacgcccggaacagccgcgccattcccggccgccttccatggccaccggccacgaattccgccgccgttccccgcctctcccgtggccggctccctcccctcacctataaactggaaccccctcgctccgttctctcgttttagccttctcccgcacctccccgtgtgatatgaccatggctactacggatacatccgttgctcacatcatggatgaacaacaagatatcaagttcgagtcctccaagtgccggaatccgattcggccacctgctacactgctgacttcaaacggccgccgaatctgcatacgacctccgtttttggcccgtgaatacttgatggaaagctctcggagcgctctttccaacggatccagcctcatctccgaattccatctcgtgtggccggaatcacacacacaagttgctgcatcacctataatgggcctatgggcttgtaacttcatttgggatcccggcccaagtggggcccatgtggggtgcgccccagctaggtggagcacgaccttaggcacccctaggtcatcctcccacccctatttatatagctaggtacccattcagggtttcttgggttttgatagattgaagtttagccattgctacttgcttgcagcgcgcgtgaatgctagaccgcccgttgtcacgaccggaaataaccc

SEQ ID NO: 67220 - DNA, 16627 bp, Oryza sativa
gaccgtccgttgtcacgaccggaaataacccaacgggcgttccttacgtgcatgtattattccttgtcccaggaggcaaggtacaccaaaagttgatacatttcagagtttatcaagcggaagcgtaaataattaatttattacatgggcggcgaaggcccagcacacacaaagacaaacgggaaacagcggaagactagggcgacgaccacaggcgcttgacggcaggcacgagctagacaccaaagccttcatcttccaggaactcctcttctgggtttgggaaaaattgagcaagactgagtacaaccaccgcactcaacaagacacacccacaagtgcagaataaatgcaagggagtacaagggagccataatatagggggttagggtttgcagtaaacagcattaaaagtcacttagttgctcaaagctactttgtaaacacggtcctagagatatacaatattattaattaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccatcctagccatagacaagagtaccgacccaaccccaactacggccggaacctccgggataggtaggcaggactgagcccctagcagtaggacaccggccctgtgccatgacatctcgactaccgggccgtagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattccatagtgtccaggtgatgagaatattcccaaagtctagagttgtaaaaccacctaattttgcctaattaaccagcgaagcttctacctaaattcatactagtggttccatgagtagagtgtccactagttggggttttgtttaatctagggtgaacaaggtaataatatcaataacaataataataaggtcataacaaaggtaaataggcatggctaaataaaacagtgataacgcgggaatttaaataaagcgataatgcaataatttaaatcaaaataatgttataaaatgggaaccaatatgttcaaggatgatgtgacttgccttgctcgctttcccaaacgtcggcttcaacctccacgaagagcagatcttctgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccacgcggcagcctcacagtccacggtggaccaggtgcacccgggctcacaccggccggcgccgtgggccccacacgtcagccgcacccgagggcggccacgccggcgcggtcggcgggagacggcgcgcctgtgccccgatgatcgccgccggcgaccaccggcgcggcggagcggcggccgagagaggggagggaagggggaaaggaggcgacggtccacggctcaccccggggcgacggcggcgacggaggaggcggccggagcggagggaggcggtggcgcggctcaggtcgacggggacagcggcgctccggcggtcggcaaccgaaacagagaggtggacgaggtcggcgaggatgcggtgaagccgaaggaggcggcgccgaggtgggaggcggtccggggcgacgacggcggtgaaccggagctcggcggcgacggcggagagagaggcgatggcgcgagctcgattccggcgaggagaaggcacggcaaagggtggaaacgggcgaaggaagtgcggggagggtttaaatagggttggaagggggagagagcggccggaggggaaggaaaccggcgcgggaggtccggccgccatcaatggcgccggcgagatttgcgggggcaaatccgcccgtttgaacgcgagagagagagggaaaaatggggggaaagggagaggggatcacggggagttattccccccactttattgcacgcggggacggctggaggcggcaggatttgcagcggcggcggcgctagggcgcgggggaggcggcgggagcggcgggaggaaggggatgacgggtgggccccacccgtcagcgagggtggcgggcgggcccgcccgtcagcggcgcgcgcgcggggagaggccgagtgggcagcggggagaggagagagagagtggggggaggagagatgcgccgggccggcccaagggaaggaagggggacttttagggtttttctttttataaaactttttcaactttgtttatttcttaataattattatttgtgctctgaaaattccactaaaatttatttacacattttaggcttttaggaaatatacaaaaatcctctaagccttatttgacttttaactttgcacattttaattgttggaggctttcacatggattttaattattataggcataatttaaaggatatattttagagtcgttttggcacgtgacatctgtctgcttgttcttcggaaccccaacttatcattcgtatttaactcctatttgcaattcagattgcttttatcttgttcttgcttgtatcttcgatttgcttgtaggaataaggttgatctgcaccggcaagatcaacaacccatggagaggtgtatcgatcgctaaggcgcaacacaacgtcttgtacggttgtagtcggatcgtcaacgtcttttccacaaatcgtagttatctcagctcaccgaaagatcgggccaacaatagccttgagtgtctcgagtggaactcagggttcatcaggtgatatcagagctttcgttgctcggtgagtttttttttatctacctataaccagaaaatagccaaccaaaaaaaaaattgtatcttttacctagccatattgtgccattgcattgttcttttcagtttttgctttgttgaattttgtgttgcatcgtcatgtcgtgttgctggtcttagcgtctagttcgtttagagtttcgagttctggtcacattttgtaccacagtcgtcaccgcccccgtgtctctgttgtcgtcgggacctacgaaaacggaattggctcgctgccacggttctattttcgtagttttcagaagtttatgtcggttagtttttgagttcttgagttgcatagcttctgtttggtggctgtgccgtgatggtgcatgccgtgatggtgcacctgtgcatgcgcgtgtgagaaagatggaaggagaagattagattagattgactggtttggtttctatttagtgccgagtctgtttctatttatcacctggtacctttccaaaccgaagccgagtaggattccttcccttgcgtcatcttgtggccgagacttgtgagtcgactcacactccctcacgtttgtttctgtccggattggttaaacacttcggtgaaattttatttttggtgtcggattcaagatccgtttgcaaaaacggaaccgacataactttagcattccattgttgtataatttttaattttggtttggacttttacagttgagtccctgtaatttttatatttacgtttgagtccctgtaaccttacattgaggtccttgaatctgtttttgtaaaataaaatcaaaaaaaaagaaagaaaaaaaaaggcagaaaggtgcataaaaaaaagaaaagaaaagccgcacccaaaaaaaaagaaaagaaaaggaaaggaaagaaaagaagaaagaagaaagaaagaaaagagaaaatactgttatgtttgagctgaacttcatatatcagagttgtgcatgagttattcctagtgctatcttgtggcatcgtttgtgtctaggctcgcgtctctagtacgttctagcctaggaccagcacggtgcttgactttgaacaattattcaactttgcattctctgatttgagcatttgctattcctttgctacatatttaagcctacccagagctccacagatttgattgcagccgtacagcaagtattcaccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcattgccttatttcgagggaaactatgatcctcgtgcttacattaattgggagctagcggttgatagtgaatttcaaaagcatgtcttgtctgagaaacaaaaggttatgtgtgcctctagtgttttaattaaacatgcttctaatgattggaaacatctttgtaggcataacaaaataccacaatcttggaaatacctgaaacgatatttcagagatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggctaaacaaagaaattcaggacatgcttgattgtcaaagatatacatctctttctcatttgttacaacttgcttgcaatgctgaaagtaaaatagaggagagagacatgaaagagccgccaatcccattgttcacactcaaagtcaaggcacctccatcatctgaagaggacatcaaaggtaaagtaaatggtattgaaattaatcatggtgagtgcattgttaacgaagtaaatttgtccacctttcatactaaagtagagcaaccgttagtggaatcaaatgctggaattcctttgtcacaagttgatttactcgctgttccttgtgataaagaagagttgtgtgataatgcttcacttatatccatgccacaactagtgaatgaacatgatatttctagagtttctttgtgtgctgattttaagcatgctgttcacattgctaatgaagttgaggaacgtaaattgctatcttctttaaatactttgggctatgttcagtttgatgatttttgtgagctcgataatttgaaggagaaattatttgctaagtctgatttgccatgtccaactaatgctatttttcatatcattggcaaatataatgatagaggaatatatttggtgcatagagttttcatttgttcggatgtagagaaacatgttattgctaatcacactacttcgagtttctcttgttttgattgaatgaaacaggttattttgaatggactatgtgaagaacaccatatggaaaaaccgaggacggttttccgtgaagaaggggaggatgatgtgaccatggctactacggatacatccgttgctcacatcatggatgaacaacaagatatcaagttcaagtcctccaagtgccggaatccgattcggccacctgctacactgctgacttcaaatggccgccgaatctgcatacgacctccgtttttggcccgtgaatacttgatggacagctctcggagcgctctttccaacggatccagcctcatctccgaattccatctcgtgtggccggaatcacacgcacaagttgctgcatcacctataatgggcctatgggcttgtaacttcatttgggatcccggcccaggtggggcccatgtggggtgcaccccagccaggtggagcacgaccctaggcacccctaggtcgtcctcccacccctatttatatagctaggtaccccttcaaggtttcttgggttttgatagattgaagtttagccattgctacttgcttgcagcgcgcgtgtcggctagaccgtccgtctgcttgttcttcggaaccacaacttatcattcgtatttaactcctatttgcaattcagattgcttttatcttgttcttgcttgtttcttcgatttgcttgcaggaataaggttgatctgcaccggcaagatcaacaacccatggagaggtgtatcgatcgctaaggcgcaacacaacgtcttgtacggttgtagtcggatcgtcaacgtcttttccacaaatcgtagttatctcaactcaccgaaagatcgggccaacaatagcctttagtgtctcgagtggaactcagggttcatcaccgtggccgcaccacctctccccgccttctccttctctctctccggcgccggccggcctccagccgcctctccctcctcgcccgagcgccgtccggtcgcgccgtcgccaccagcggcctcgcagccaccttctctcccccggtcagccctccgtttcgcggggaaaccaccggaggcgcatccccgccggcaaccggtggcattgccgctacccaccctccagccgcccctgccgcgccgctcaggtgcgggccggccgcgccgtctcctccctcggcgtcgccgcgtcgacctccaccccggcctgccctcggtttcgccggaacgccgtcgcccacgccggtctcgccctccacctcgccggagttccttcggcaaccccttccgccgtgcccgtgcatcggccgacgtcgccatctcctcctccggcatcgcagcggcaaggtcgccctcggcctcgcctcccctgcatccgaaccccgccggtgttcgttatcatcgtctccgttcatcctcatcgacgactcctccggtcggtcgttcgtcctcgccggctcgtcgtctcgcggcgccgcctccgtcgtcggattcgcagcggctgttccacgccgtcctcatctctgtgcagctactgctggctgccctcgtcgcctcctcgccggccccggtcgtcgtcatcgtcgtcctctcgtcgttcccggtcgtcgtggcgttcgtccctccgtcaagccattcgcgttcgtcgtccgcgttccgtcaagtgagccgctacagccccgtcatcgtctttgtcctcgtctccgcatcatcaagcctcgcgccggccgcgtctcaccttcgtccaaggatcgccgccaaagtcgttccctcaccgtccgtctccgccgcgcccgttcgtcgttgtcgttcccacgcctcgtcgcgtggtggtaagtatccctctccctcgctgctccgtcctcgtcctttcggtgtcgcctgtgcctgttgtgcggttgtcgaccccggtacccatgtaccggtgtcggtagtcgtttgtgtgtgcgtgtggtggccgtgtttgtgtgcgcgctcggtagccgcgtggtttccaagtgtgcagccctcgtggtgtctagtggagtccgtttgtcggccacttgcctcggttgacacacggggtccgcttccgtcgacccgtggactgtctctgtgtactcggtctaccatggtcccttaggttgacatgtggggtccgcatgtcaacagcgcagtcttcctgtcttttccaggctagcgcttacacatgttttatagttgtaaaacctaattacaataatccgcaaatctccatataacagcattaaacttcggatgaccatgtcttggtcatacgagctccgaatcgaaccgttcaagtctcctaatgtttgttataacctaaagaaccatgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttgagcatattgaatcccagtttataaaattattttgatttaaattaatgcattatcgctttatttaaaattcccgcgttatcactgttttatttagccatgcctatttatctttgttatgaccttatcattgttgttattgttattattaccttgttcaccctaggataaacaaaaccccaactagtgggtactctattcatggttccactagtatgaatttaggtagatgcttcgctgattaattaggcaacattagatggttttataactttagactttgggaattctcatatcatttggacactatggaatggttggcttatgttggaattggacacacacctccccctctattcaaaacccccaaaatagttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctacctgcctgtcccggaggttccggccataggtggggttgggtcggtactcttgtttatggctaggatgggttgagaactatgtcacgtcttttggccgtatgccgtggtggtatgtggcacgtggttacacgtgaggaagatgtgtcttgtgggtaaagatgtacacctctgatcagagtataatctattcaaatagccgcgccctcggttatgggcaagcctagcaatgtacccaagttagtgttttaattcttaaaacctgcttaacaactaaaatgtgaaatggttggcctgggttggcttgggacgagctgggactcagggtcgggttgccagttcggtctgaatcatcgtaggccttgggttaaggcaggttcgtgtgggtctacggccttgattaataatattgtatagctctaggatcgtgtttacaaaatagctttgggcaactaagtgacttttaaatgctgtttactgcaaaacttaacccctatattattaccccttgtaccccttgcattaatcatgcatctgccggtgtggcttgctgagtactgtggttgtactcattcttgctcaatctttccccccttcagtaagagaagctttggagaagaagtcttaggtggagtcctggcttataccccagttgagcgcctgtgaagatggagccgtaggcccgctagtccgctgctgtttaattttgattgtcaggccttaagtgcctttgtaataatgtaaatattatcgatataataaagatgtgccttttgtatcatgtttgtgtggtgtaccccggcttttcctgggacggggattaatacactagcgttcgggaaatgcaaaatttctcagtcgcgacaagctggtatcagagccatctcaactgtaggataagccaagtggataaaacctaaggacatattttataaatgaaactatttgtgaaagttcctttttcctcctttccgtaatgctatttgcaaaatgtttattctcttcttcctccttcggatttttgactagtactagatggtcagctttgcgaagaagaagatgtcgccaattgtttgccgaagctccggaagaccacagggtccgctagcgaagcgaaggaagcagtgaagccagctgtgaagaagcagtgaagatcttggagaacccgtcgcagaacctaagccaccctctattgtttcgtttgtcgtgtgtttcctttgcttgtgtgtgtagcgcgtggtttgcatcggtgggttgtgatgtaaccatgctaggttgtttgcttaatctacttgcagaataagtaaaacaaacaacacatcaacaagaagagttagttcctttaaggtcctgtctctagttctggtctattctttcctggcttgtttcctctctcacctcaatccctgtcacagatgtttaacagagaaaaaggaaagaatgtcagcgggtatgcctccagtaactcaagttttcaactcaatccaccactagcaccactagcctcaagagagttaaaaagggcacacccttggtccattccaagcatgctgcttagttcacagctaccattggttggaagtcaagaccaaaatcagtatgtgtttgatcgagcatttgccacccaggtcaatgagcttccaatgccagaagagcatgtccccttttctcatgattgtagagaacaaggacactatgccctgaattgtccatgggtatatgccaaagaagccccttcctttggtttagcagggcagacatcgctaaatgtcacgaccggaaataaccaggaattgcaaaacacaggaaaaacacaagaatggtcgtttaattggagcgcagaaaaaacacaagaatcggatgagagagatagactcaaaggaaattttccaagaggttgaagctcttgctaaaaatttcctccaaaatccacatgcaatgtgccattctataggaattttataggatttggaaagcttcaatcatttgaatcaaagggccaaataggaaaattttctataggatttgaatcctatgaaattcctacataaatcctttgattcaaaggggcccttagtttagtaatatctagatggtggaataggaatagagtagaaatcaggagtccagaagccttcggaagagttcgggtatggctctagtagcttttctcttctcttttgtaagctttgtacctttattagaatactcttctacatacatttatggtattgaaatactttccgagtatatgaatgcctactttacattatgttcatgttatactgaatatacggctagcttatctgggagatgctttggtgtgggtataatgtttgcatatgcaattactttatgtcatgacgatgatattagagtagtatctggtagtttagatgtggtgtctagattacgggatatcattatttggggttatatattgcggatgagaggtgggccgctgatggtgacagctcagtacgggtattcctccgcgccggtatataatcctaagttaattccctggggagggtatttctccgtatttagccccggttgtatggtcatgacaggctgttgtaaggaactcggtagtcaggggtggcttctcgaagtatcagtagggcatcggatagagggtattagctagtatatcagttaactagaatgtatggatactatgtatgttagaagtataggaatagattatctttctcttttcttcccacttagcttagataatatattacgagaatgagtagttaatgcttgtgtatcactctacccttggattatttttgacccctgcttagaatatgattatcacaagtaatatataaattattagtcaagttctctctacatgatcttcttacggaataaaataaatacgatacacttggaatactctcgggtgaaatgctacaatggtatatccgtgcgcttgcggatgaactctgtaaccataatatactagaagtatttctgcgtcattgctgggacatatatttcttttaatgtcgttaagaaataccaacaatcatcccctctcatctcatccgtccatccaccatctcatctgatcttatccatccattcatcagtgatgagcgattctaccaattccgctcccacgcgatgactcagccgcagtgccacacaaatccccgctgcaatgactcctccccacgaatcccgctgcctcctcgcctgccatgatgacttctgcccacgaatcccagccgcttcctcgctcctcctcaatccgtgtgcatcctccgtcctcctcgcgacaggccagcgacgccgcactatcggagttgacgtcgtccccatctgccgccgccgtcgcagcatccccgaggtcgtccccttccgccaccgccgccgatttctccacccattccttgctccatcgcgatttctccgtcgtcgcgacctcgccccgccgatcgcgccctcatcactgtttcgcctgccatccactgctcctatagccacctccatcgcgtcgccggttcctcacgcatgttgctaagtccgacccgatccggttggttccgtcatcgaggttgccgcctccagggaggccaagctgatccggcatctgctccacctgctgccccctccccgtactctgctcctgttccccctaaaccctaaggtaataccaatttatcctattttacatttttttgtgttgtgtcaatttgtggatcaccatttgttttattgatcattcactatttgccaatcagaaattggccatggagtttgaagatcttaacgttttgtttcctccttgcctgatcatatatgtcttggatcaggagaagctcttccatgaattaggtaaccaaagtcgatgaataggctagccttaaggatggcggcttcggaaggcgtctgtccctattctccgttgatcctgcacagcccctatcaatggatttgcatcaattctttcttctgaactttacgaaggaaaattttgtctggttctatatttttttatttgtttggaggtaatgtgatgttttgagataggctctaaatttgcttgtaatacggatgattatcactaatcactgtgaagccatcctactgttctggttagtagttattgagaaatatataacatttgtcttgatcctcgagaatacccaacttcttaaagagaaatatatctatatatatatctatactaatataaaaagaggagttgccccctccaatgctacatgccaagtcatccggactaaacgcgtccatccgcgcgcttctcttcctccaccgcactatttcacagccgaggattccacgcgcgaagacatcgctcctccacccgcagccgcggagaccgcgcgcttctcttcctcgctcactcctcccagcgtcctcgcaggagcgactccccactgccgccgcagccatcctcctcgctcgctcctccttctccccgctgctgccgctacgccgcgccctagccggagccgccgcggccgtcctccttcttccccaccgccgcgccccgctcttccccacctccttcttcccagatcgtgcttctcccactcggatcagccgccgccggagccgactttggccccttctccgccgccggaaccaacatcgacctcagcccgcggccgtccttcttcttccccaccgccgcggctgtcctcctcacgggcttctcctctgccccgctgccggcgctacgccgcgtcctcgccggagccgccgccgtatcgttcttctcccactcggacccgtacgaatctccgtcctccaccttcgccgctcgcccctctctctctctcttcgcccgcgactccatcccctccctagccgctgccctcacggcctcgccatcgccaatccctccatgccttctcgggctcatggtggaggggcaggggctgccttcggtggagagttacagccgatcccccatcaacagcgcccgcgagtgaggatcaagccgccgttatcgagccaaatcaggcggacaagctgagctgacggtgtatacgggaggtagagatggacaccagcgacggcggtgcgttcgataagtgaccttgatagcatgtggcgggagaggatcggcggtggcgcctgagatgtcgacagggaacatgcttgcagatctcttttccatcaatggctaccacgagggtcttcccatggtgcttgcccacattgccacctacgccgcgcttgctcttcccccaactgtcgacgcccggcaccatagccgccgaggccaagaagatctggaccatctggtcatctttggcgccatgaatccggccacttccgccaacggggctgctgccatcatcgacccgccgtctagcacggttcaatgggcatcatcacacgcctatgcttcatgtccttctttactagcaggttaaaaaatccttaaggatttatttgctaatcatctttacctaatacatatctggtataattcttcgttgccttggttttattactgtatttttaggtcatcaggtggagaagccatccatatgctaaataggtctcaagataggagtgagcagcaagttcggttttcattgggccatactcctcatctgaacaaacaggtttacatagtttacatagttgttttacagcctataatatgaaaaaaattattggatagcttgttattgtgaggtgatcttgtttgttgttgaatgatattaattgattggttgttttattaggaattctcagcaggtgtgttgatttctattttgcttaattttgtttaattctgcagccatcatggcccagggagtataaagttgaatagagccaatggatgctgtggcggttgcgatgacggtagctcaacaatggcactgggcgtgcactgggaggtatgcttaaaggagagtgttgtagcatttgcatttttggcagttaagtttgagcactggatacaaatcattgatcttctagaagtaacattttgattcctgcaaactaatgcggcacctctgtctcaacactgtcatcaggtctgctccccagtttggcactccttgtggtaagggaaacgaggagaaagaaatgacgaccaacaggttgtgaaagacaccaacgacctgcatcacgcaaataaacaggtatttattattttggttagtttagtttgttgtgcagacattaattaaggctaggggtaggggttgaagacttatggatgaatccggtaccgtaaccttcacatttgaccgttcattagtagctaaatggacggctaccatgcatctgatacatcaatctgtaggctaatgacatatcttgagttatagcgatactttctttaaacaattgctatctttttatgtactgaaatttgcataatccttatgatgtgtttttctttaatcatctttatgtaattaatacatgtagaggataagaagagagatgattagcttctgcatttctgagatgtgaatatctaattaggtatccagatcctaagaaaaaatatcttcagagaatagtatcaagcaaatattaagagaaagcagtgagcccatttttttttgggtatttcataccattaatcgtagcattcggcagttctgcagttatgtatactttgcacttctattgtgcaaatgttatgttacaatatatatgctgttctgaaggtccatgacgaaattcttgctgcaatcagggaaaaagaggagggacctctccatttgaaatgctctaggctacataaaaaactgacctattcatatgaaaccttaagatagtacatattattattagacaatatgttggtcttttcttgctaaacctgaattgttctattggtgcatagtggaattagtaagattggtgtgactaagtagatatatttgaagtgtatacatttttattaagtcaatagacaatgtttcagcctgcagtgatcgacatattcaggtgtcagtaaagaggcacaacatttatttgcttactggattacttctagacaaggtttgcttcttgcttttctatgactgacatgttgtagctccgctaaatgaagtattattacaattttaatggagcattatgatattagttatgctgatttaaaatgcggtaatctattgctttagacatggtaacatacatgatgaattgacctcttgttatagttttagtttcatcatgattttttagaaatatatataatatatgaatattcacaatgcaacatcctctgccttttcttctttggatatatcacacggagataaaagggaattattaatatgttagattgtgctatcagtgttgatgtgaaacaaagttatcactggtattttttatcatggatttctattttctaatatccgtttcctatctaaccaaaggagggaacaacaatcggtgcatgatctctctacctgatttagacagataacactatcaaac

SEQ ID NO: 67221 - DNA, 26341 bp, Oryza sativa
atagccgtgcccgtggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatcccttttgcacgtctgcatcattggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcatctgtaagtattttacgctttagtcacgtttggaactgtttattacttgtcgttttgtgtaccctggctggtcctggacagggatttaatacacaaaatagtctggaaatttgggctaaatttctgggcgtgacagtatatatgatagcatctgataaaacctatgtgatcaagacatgataatcataggacttcatgccaatcagcttcagatcgtcatcaaaacaaacttactaatccttgatgagtagcccgaaggaactttaatgcccttcaagcatgctatcatatcattcttctcttcctccaataaagtgtggtaagctagagaaaggtatactctgccagttcgaacttattggtgctagtttactctgatttatcatatcttgtaaatctcggtgtgaatttagtccgttcttcgccattcgaaggatatttagtagtaacctagtcacactatcacaagcgttattctgtacatgcattaaatcaatacaatgacggtcctcgagatactttcagtatggcagccattagaatatagactttatcttccacatactcttctcatttgtctctccaagatctatgaatgatggctacagaagaaagggaaagtttcagtggaagctaaggattttgagtgtctgaaggatggagatgaagaggccaatgaacaattgaagtgaacttgaaatgaatgtcactactgaaatataaaggctggagtgacggttcacgttttgaggaatgtggtgcgatattcccggtgaaacagtagtgtggtattatgaaatttgatctatccaaatttgaaatccgactacgttctagtatttggctcggattaaagaaccaagtagtttaccttaacctaagcgcatgttttccgattacgatttatttgatgaaatggcttcttgggtaaggacagcaacaataatattggatatatatttacattgaggtcatcgctattgtcaatgttataaataagggataccccatatacctacactaatcatcatcgccaagaataccacacacttatatacggaaatatatccctaaatctctactattataaaaattaaagatgtttttctggtactttggtacatcatccgtgtataagtcggtttttaagttcgttgctttgggaaatacaaaaggagtcatataaaaaatctctttaaaaaatctcgcatgctaacttcagacgatcggactcctgactgcaactcatgattttctaaacaaatatatatccacgcgaattctcacaatgaatttcaccttaactaaaccgtataacaataataagattaaaataaccttcacccgttacaacatacgggtatttttctagtatatataaaaagtaaaaataatagagagtcatgtttggctaggaaagacggtatagtctgatttagggacgatagggtcttgtgtacatgtattctaattgaaaaacatgcgaggaggttaaggtaaactacttaaaacaaattcacagtgagtttacgccaggaggaagcccttcaggttgccgccaaatacaaccagccaacacgtcaagagtagttccgtaggctagattagcaagcttgtttcccgctttgtagttggtgtaacaaaccccaaatcaatacacataaactggagttgggctgctacccacctctgggacctggaccagtagaaacatccttatcctttgcttgcgtatactttggtaccagctttatcttacgtccctcaaataccatagtcggatatgacccgtctactaatggttttaccaataaatattctatcaggatctattttttttacataaaattgaatttattagatttatgttcaaaaatatttacttatgattgtgcttttctatcatataaatgatgtactaatagagcaactgttggttaaaaccagatcctaacggatgaaatacttcttatattttgaatttgagggagaactgagaagtacatgctattgttcctaaatcctatcatacaataaagttgatgcacactaacttctaaatattaacatgcaagtgtgccacatcattacccagtagcaattattatctagagtattttaaaacacatgcatgtgtaccacatcatcactcactaacaattattatctagagtattttaaatatcatgcaaatatgacatatcatttacagttttgttgtatttttagaactcaatgtgcaatcagagtaaaatcattatctccatatcattttcacattatttaaacttgtacatctatcatttatatcatatataaaatgcattcatccacacatcccacggcaaagcacggggtatcaactagtattattaatttgtttgtccatttccccaggacaaacaaaacttattaagaggtatgcaagcacgtaagcgaaccgcaagtacaccgacacacagtcacacacatccatcaactttgcatggaaatcggcttatatggtgatgccactagctggagatgattctttctcctcgccgttgcaccaacgacgagctccatgtcgatatcacctggctgcatcccatccgggaggctccagtcgaagtagtatagaaggcgcgccacgatgagttccagcgtggccattgcaaatatatcaccagggcacctccttctcccggtcccaaatggcaagtactcaaaacgggagcctttgaagtccgctgtgccatcctcaaacctctctggtatgaacttctccgcatcgtcccaatactcggggctcctcgccatcgcccacgaattgatcaacactctggtgccctccacaatctcataccctccgatttcgcaggtctcccgacataaatgggggagtagcagcggcaacaccggattcagcctcagggtctccttgatcaccaacttcatgtatgataggttttcaagcaggccctcgtggtcttgtgggctcttgttgtcgaatactcctcgcacctcagcctgcaccttggccatcacctctgggttcctcatcaactccgacatgagccactcggtggtagatgatgtcgtctctgtccctcccgtgaacatatcctgaatgaaaccaactacatgagcaagaatgaagattgaagaaacatatactccctccgtcccaaaatataagcatttttagacgctgacacggtctttgagatactactttgaccaataatttttataaaagtaagatgttttaaataaaaagagttgcatgttataatattttgtttagtgataaatctagtaacacgattggtcttttttatttttttgctattaatagtcaaagttataaatgcttgacttgtcactattctaaaaatgcttatattttatgatggagggagtatatatttttcagcagtaaataaatgaaattattaccagtataattgccttgacgtgtgttgagctaaaggggaagtcaagctcgccctggtccttgatcctgagcaggacgttgacaagggaatcacccggattcgactcgcactgagcgacgatcttgtcgaagacggtgtccagctgcaagcgcagtcgctccaggcggctcctcagcccggtcatggcgtcgatgaaccgcagcgacgggaagaggtcgccgaagcagaacccattgctgaacttgagcgcttcgtccagagccgtcaagaactgctcctggagctcgccgccgcacgcctgcccgaacgccgccttcgcggtgaacgtgttcgtgcacgagatgagcagcgtggcgagggtgaacggcttcttgccgccggcggcggcctcgatgttcctgacaagggccagcgtctcgccgtccctgatcggcgcgagctgccgcaccatcttggtgctgaggagctccaccgtgcagagcttgcgcagcatccgccagtaggcgccgtagggcgcgaagccgatgtcgaggttgccgtagcagaagatctccgagacgaggaggctcggccgcgacgcgaaggtgacgtccttgtcgcggagcacctcctgcgccgccgccggcgaggagatcacgacggtgtccacctgccccgtccgcaggaacatcaccgggccgtacttgccggcgaggtcgcggagtgcgacctgcggttgcgaccggaggaggtggaggaggccgccgaccaaggggaggttccatggccccggaggccgtctcttctttgacgacgacttgcgggtcagcaacgcgagaagaatgggcagggtgacgacggagacgagggtgacggtggcttctgagtttatctccatcatcgatcgatagatagaggatgtatatatggcttgatgattgattaggtttaattacttggcagtttagcttgacgaagaacagcaagaactgaagggccttttataagcttttgcccaatgccatgattaattaaattcgaagttcatatacggtcgttagcgcaaatttccaggcatgtgatttgacctggacgtagaacgtgatatatggtcagaggaactgctagtgatcacgactactggggatggtcgatgctcagttgcagcgactcatcgatctaagattaagataaaactagagctcagctaaacagttttaacttcatctaaattaagagcgaagttaggtgtaacactctcacaaaataagctagagaggttgaactagaactagtagacggcttcacagcttcactttaaacccaacttttgaaactacattgagttgaagctctactgaagattcccttaaccaaggggggaatgaggaatgagggggtcgatttagtgccaaactgccaacgacgcataggatcgttggatctaccggtgcacctcgtcgccacaggtgaattaattgcactaactgaactaaaaaaagtcagatcctagcactattgtcagttgttttggctactagcttttcagactgcttgaccatacgtttctttcacaaattttatgtatagaagttttttctttagaaaatcaaataaaaccattttgcagactgtcccatgcaagtatatctccaagagaataacagggttgggcagtacagctacaagagaagaacatggctgggcagagctatatattaggaatgaccaagccaatattgaaacacatgaatagataaatcacaatattgaaatctcgtggcatgttgaatcctatagaaaatagatgagtaaatttcacaaagctacaaatactataacaaaactacatatttaactcggtgtatcacaaaactacagatttaacgttgagtttatcacaaaactcaacatttaaaatggggtatcacaaaagtacacattcagtaacaaaattatcatataactactggtttataaacaatttagttacaaaactataatcttaatagttacaaaactacagtgttaatagctccaacataataattgtgctagaatttcaaactctaaaatctataattttgtgataacttcaatatcaaatatatggtttattatacttggctttaaatatgttaatgttttgtgataaatttagtgctaaatctatagttttgtgatatacattttaaatatgtagttttgtgattttttgattaaaatacctgtagtttgtgcaattttctcaaaacagaattgcatgtataattgctccatacatatcattgtgagctttatgaaatttactcaaaatagaattgcttgtataattgctccaatcgtgtctttggatatttcacaggaaatgtataggaattttgagattatgaactcagatggagtatggctgtgttattcccccttctttcccaactcacctatgtttttttttccatgcacacgtttttcaaatttctaaacggtgtgtcttttgcaaaagtttttttagaggaaagttactttaaaaatcatataagaattcatttttaagttttttttactaatactccatccgtttcataatgtaaaactttctagcattgctcatattcatataaatgttaacgaatctagacatatgtgtgtctagattcactaacatctatatgaatgtgggcaatgctagaaagacttacattgtgaaacggagaaagtacttaattaatcacgcgttaatggacaacactgttttccgtacacctcccgatcgcagcttaagagaagagagagaaagggaggtgttgctttgtaattctcattaaaaaataacatgacgttggagggtatatgtttaagattctttggaattaggccacacgaatgaatttcaaacgaattttgtaagcccaaatataatcctacaaaccaaacaacctccataggaaaaagtcccaaggatccaaattcgtcatttttcatttgaaaatcctcccatccagaggggcaattcccagatgccactagcactgtccagtatatatatatgttgttcatcgtcccgggcgtgacagcgtgagatccgcttgtgtacccaacactcctatactttgatggtcagtctcctcgcccttggcttgtgcaagagaatcacaaattcacaaaggcgagcgtgcgtgcgggggagaagagagggagagaaaaggataagtttactgtgcacatatatctcaaagcagattcgacggtcgaattcaaatgatgtggggtatttattgtgtaacacaagttgtgtagtaggactgtaggaagtggcttgtaaaaatgctaccgacttggccaccatctcctcgcctacatcatctgtcttagatatatattatctattaaaaattagagaaaatcctataaatagtaagaaaatattcgctaagctgccatatggtgttctaaaaaaaaattagagaaaatcctataaattctaacaaaaaaataaaacatctgtctcttgattgctgcgtaaagtgatgggtccagaactataaaccgttagaatctgttgatcttaaaccaatctaaatactagtcccacatctcctcctgtggcagcataggtagtcacgctttcatccccttccttttttcccatatatacaactatcatcggtgatatataaaagttttaaattatgatgatatataaaagttttaaataatcataattttacaaacaaagattataacatcgtataactctttgtaaatagaggtaactaaattagctctataatgtttggaaataaaattacaccactatatttttacccattaaactaataatataagatgattttcagttttcctgttaaaccggtggactcattactttgaattattattttaaataatgcaccattttaaagtaaagtttgcactattatatcattatattatttaaccattaaattaacaatttaagatctacataactaatttacatttacacttaaactaatggacccattatttaaactatcatatctatgttttcattaataaacaaagccttcgaagttccttctctagcctgctacacaacacatgtctacaactctaccttccacacgagcgacgaagtgtcgtatctaaggcagttaaggtgatcacgatagctgcaacactaccactttgccacataccaaataaaatatggataacgattagttttgttagtaacttggaaccaaattaaaggtgtgatgcagaaagagaagaagtaaccatcgtgggttatgtttttctaacacttggctccgtttaagctgaaacaaagagcatacgggttataatgtattgtatgaggtcgtatttagatttcatccatacagcccaaagaaattactatttctccatgcaggcgaaagaaattattatattataaatgtgagcataatattaaccaatatcaatacacttcttcctaagacaagagtgttataagcgaatttaaggctctttttttccctgattccgtattttggattttcatttgcatggttcccaagttcctaaatggtggcatgatgtggctcttgtgcaaagagtttttctttgagtatgaatagtgacaaagatagaagtaagaatgagaatatgaatatgtagcaaaaaacaaattaggtgaaccaatgttttttaagtagtcatggtttgttttgcgaagtttgattaactctgaagatgtaaatcatattgaacttattgatcataatttacaacaaaatggtattcttggtgtcggtgatatgggaccgggagtatcgtgaccagaggcttgaggcagacacaatcgcccacgtggcctggcaccttcggggacgacgggcccgagggtgaggtgtccgccctcctcctgatttccccgagggggggggggtcgggtgactcctgccccggccccgagggccgaggcgccccgaccccttgtggagttagcgccacatgaatgggttgggtgaacatggtaagcctcacttaactacatttattgcggtctggtcgaacgtgtcacgctgcatgcagcgtagtgcagtgcgttcctttatccggtccgtgaccagtcacagaccggtcagatcacgggttaggtggcgactggcggtctgacgcacgccttgccccttctggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggctatccactacgcctacctccagatgaagatgtcgggccccggtggccccatctctgtccatggcgacctgaaagtcgcgctcgcttgcatggagcagcgcgcggaccacctcgctgctgcgtccaagcccgagggtggtgacgagaggcttggcacctccgcccccaccgccccggggcagcggattgtcacatgcgccgaggtcccggtcaaggaggttgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaagacgcgcaaccaagagactttactcttagatctagcggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacaagctatagagcggatgcgcccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaagacatatctcagctctcccccagttctagtcgccccggggccaaatgagcccctactactctacttagcggcgaccccccaagtagttagtgcagcgttggttgtggagcgcgatgaagacaatcctcatttcgcgcacccccgccctgtgctgacttgacccgggagcgagcagggaggagaagcccccgagtcgaacggtggcctaaggcccctgacgaccggagtcggccctctgcccgcttgtcagacggtgctgggtgcccccgaccctcaggaaggccccgaggccactgcgggaaggccgcacctatcgccctttggccccgaggctaaccctgtgctgactcgacccgggagaaagcagggagaagaggcccccgagccgaacggaggcctgaggcccctgacgaccggagtaggccctttgcccgcttgtctgacgacgccaggagcccccgacccccaggacggccccgaggccactgtgggaaggccgctcttgtcatcctccgaccccgaggtcatcggcacagaagacgagtgcgccccgagaggccacttggacgaagaacgccccggggatgcggcccctagcgaagaggatcggccccgccgaaaggtgcagcggcttgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagaaggtacaggacgagtggtaaaatgggcaatcgagctttctgagttcgatctgcactttgaaccacgccacgctatcaagagccaggccctcgccgattttgtggcagagtggaccccggctccagagaccgtctcaatccctgaggccagcacggacccctctcagctgcctcacaccgcccactgggtgatgcagttcgacggttctctgtctctccagggcgccggtgcaggggtcatgttgacctctccgaacggagacgtcctcagatacttggtccgtctcgactttcgagcgactaataatatagcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatatacccagacgggataacatggttgccgatgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaagcatacctcacagataagactctacctgaggaccgtgaagggagtgaacgcgtccaacgcatttccaaacgctacgtgctggtagaagggaccctctatcggcgcgcggctaatggaatcctcctgaaatgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaaattcactaagtggcccgaggcttatccggtcgtcaagatcgataagcactctgcacttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgtgccaatgcagaaatcctcaaaggccttaaaaccaagaccttcaatattctcaagaagcatggcgattcatggatcgaggagttgccagcagtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcaacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgagtgtcatgttttgggctcgggccaaccccgcaccccctcgggcgtgtagggttggccgggggctgccacacgtgcacattcttatttcttttttttcaatatttcaataaaagcagtttcaatttcctaagggctgtatctgtgccgttttttcctttttgaagaattttgatttgaaatgaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctccccaggcactagccccgacccgcgcttttcgaggactgggacttgggcacgggcccttaaatcaagctaagacacaaaaagaggatcacggcacagatcatcctcatctcattcgcatagcaaaataaaattaacacaaagaattttttcatcatttttgattgcagattgtaagttgatttatacaaaaaacaggcccgagggccttagaagaaaggaaaagaaaaaactggagtctggagggggcctgggggctcagtccgatgcgcccgggtcgccggcctcgtcgtcacgatcgtcagcaccgctggcatcgccctcctcgtcggaattgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttggagagcccaggccatcttcgtgaggtgcggagcgaggccttccaggttggtggggcgtgtcattgactggcctttccagaggcccgcttgccgaccggcgcgatccaggcgggagactgcatcccagagcatgccgggccctatctcgcccgccaagcggagggcctcggcttccccggcggatgagtttagcgcgcgctgcatgtccgcgacggtgtgttcggcatctgcgaggcgggcggctaagtcgctttcgcccgcagccgccccgccgatgcacgccctcgcgtccagctctttttcccgcgcctcgagatcggcagcccgctgctccagtgcggctctctcggcgcggacggattccaaattgcggcgggcctgctccgtcaacgctgcctcacggagggacagggagtccgccaaccgttgcgcttcggcctcggcctcttcgagagctcactcccgctcggcaagcgcgtcttcgcggaggcggagtgcggactcctcttcggcgcaggcagactcgtgcgccgccagcgttgcctcccgggaggtgacggcggcctcgcggtccgccaggactttctccgcgacgcaggcgcgctcctccagcgccatggcgcgcgcctcgagggcctcttcacgccgccggagcgccgcttcagtctccgtcgctcgctgctctcgggcagcggcggcatcaagaaccccctgggcggcgtcgagctttttcttcagctccgcctcccagttcccgtgctgaaggcggagggagtcctgcgcctcgatcatcatagtggtggcgatgagggcagccccccgctcctcctccacctctcgggcgatctctgccagcgccgctttgcgggcttcaagctccgagacgtgacggcggtgagccttacggcccacctccaccatgacatccactgagcgccgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcggggcgacagaagacgaggagaagagccgccttggagagaatgcgacgcggctcggcccgccggaggacgcactgggctcggggatgtcccccggacccgtttggtcctgggcgtcgcctggggaagtgggcccaggcgatccgcccgcggcctcgtcgcgagccgccccggaggctgtcgcctgagcgtcgcccgagggagtaggcccaagcgacgtgccagcagctttgtcgtgagctgcctcggaagacgccatcgcctcagcctggcgaacccgggcggcctcctcccgagcggcttcctcggcttggcgggcccgggcggcctcctcccgagcggcttcttcggcctggcgaacccgggcggcctcctcccgagcggcttcctcggcttggcgggcccgggcggcctcctcccgagcggtatcctcagcctggcgagcccgggcggcttcccgggcggcctcttcagcttcccgtaggcggtctgcggcctctcgccggtcagattcccgcctccgtgcctctgcggccgccgggtcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggtgcctgctgctggcacgcactgccccgccccctcgggaaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgtcatggcccttaggagcctgctcctctgaggccccgaccgccgtcataatggtcaagatggaggcacgatctgggtcgctgcagagggggaggataccgtgggggatgagggacgcctccacggagttgagatttagcacccgttggaccagtatcttgaagtcctcgggggcccaatcccatctgactccctggtgggtccgcatgaggtcttcggacccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctgacttggaagtcggaggcgcgcttcgtcggcgaggggggtgtagaaccagtcgctcttccagtcatcccactttttacggaggacgcaggggatgtagcggttcagcaccggcccccgcggcaggaaatagcagccgccgaccaccgacggtggcgataccgactgcacggtgaagaaccaccggaacagccggagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcgaaggggagaaagaagacggaccgccccgggtagtctggcgccgggcgtccctcacccagcattactatctcacggccggtggcagattccggcatgaagcggcgcggcaacccagcctgcttctcgctcacaatgcgagaaggcggtagcacgctaccatcaagcagtgcggagccccgtgccatggcgccggacgaagagaagatgaagaacgagcgcgtgtggcgaaagaagggcgcagggaagaaggagttaggacgcaagcggcgaaggcaagggaaatgatggcgaaaggaaggagacaaatcccctcctcagtgcctttatacccttgccaacgctgtgcccggctcctcgtttctcgcgcccattatttcgccccctcgtttctcgcgcccacgcttccactaatcccattcgcccgcttgcggcgcgtgagatggatatgcggttgcggcggtcgagatagatcgtatcgtgcgcgcgttaattacgctcgccgaccgaagcgacattaccgtatctccaggcgaggcaaatcggctcgcccagattcgtgcgccgctcaggtgatgtggcagtcttgaagagaccgcccattattgacagccaaattaccattaccggtgtgcatggtttgagaccgttgggtttttgcccaaccatggagaccggtcccacctgtcaccaagttttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgacgggcccgagggtgaggtgtccgccctcctcctgatttccccgagggggggggtcgggtgactcctgccccggccccgagggccgaggcgccccgaccccttgtggagttaacgccacatgaatgggttgggtgaacatggtaagcctcacttaaccacatttattgcggtctggtcgaatgtgtcacgctgcatgcagcgtagtgcagtgcgttcctttatccggtccgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccagacttcatcccaaccattacaggcaagatgctacatgaagaagggcaaacatgcacgttgctgagccgacgtgtggtggacaagaatgaccgatttgtgaccggtctgacactgctcatgtcgtcagcacacagccaccttcccacgacgtgcccgcctcaggcagaagtggaggtaggtatgtgccgtcccatcaggaggatgttcggaggacgaccgtgcaaatctccgtccatttatgaaaagaaaaaaagtccagtttggaaagggaggggtgcatgtggtatccccttgaagtataaaaggaggaccttgcccatagaaaaagaggttggttgattctttccagattcagggcctagaacaagggatagatcggctcacactttgtagctccttcatacacagatccaccaaaacacaggagtagggtattacgcttctcagcggcccgaacctgtatacatcgcccgtgtctcgcgtttcttccgagctgatgatctttccacataccgagagagcttgagatctcaccctgagcccccggccgaaccggcaaaggggggcctgcgcggtctcccggtgaggagccacgagctccgtcacttggtataaccggattacatgacagaaatactccttactataagacacttcattataggtactgcatactaattaaatttatataattatggtcttattccaaacaaatattgttcatagaaagtaataaaaatctataaataaatctaattaaaaatattgttgatattctgcactaccaaggcaagctaagatccttcaaactatggagaaaataagaaattgttgaacttctacaaagaaaaaaatatccaacatttaatttggttgtcactgcattatacgccttcatgagaccatttaatcacaagaaattcgagttgctctttccatttgcttgtagctatactgcacggtatgtatatagatgatatgtaggataattagcttgtggtagtttattatttactcaatgcaaaagatgattcaaaactcgcatgaacttaatccatcttctattcaaaagttggtgaatgattttttagatatttaatcaaaatagatcccttaagttatattatgataaaagtatattatccgatctatagtttcctctcaatgtacaaaacaaaatttttaaacaaataatgatcataccttttaacaatataagtgcccacacatgcacgcgggccaccttcctagttatatacgaaaagtctattaaatttcttacaaatactcttaagttaccatatgacatcctacaaacgttactaagccgccacgtagcactgtaataaattagaaaaaaaacctaaatactatgagaagaaaggcaaaacatcttgtcattgattttcattaaatttagttggcacattatttaccaccattatatttatattaaaaaattcacctcccaaaccagggcccacctaggcctgtaggtacatgtgtacatacggttactgatgtacatccgcacccgtcttcccttaattccttcttcctctttgtcaccaattccttctcctatttccatgctttattagttagagaagcaatttttttgttaaacaattaagaaactataacatctaaattgtacaattatttttttatccattaatatgtttatttttttatgactaaactgatattgtatgccatttaaacaattaaaaatattaaattataataatattacatattttatcatcgcacataacttcataataattaaattatatataaaatcataaaagtaaaatgtacattactatgaataatgttcccggaatatattacttagaaagcaaaagttatacttaaaaaaaatcaactatgacatctaaatcatacgactaatatttgatttgtttgtgtatttagattattttgcagttaaagattcattttcactagaattcaattttgaaagaaaagtatgtcactttgggcttatattctatgactttttcatgtcattcaaatcattacaaaattattaaaaatataatgatatagaatttattatcatatatgtaacttcataattaaatagatctataataataaaattaaaatgaacctaactctctatgtattgtttgaaagaatcactcccccattacgacattataataagtcaaaacaacaatactccctccgtccaaaaaaaaacccatcctaatatggaatagggcataatctattacaacaaatccggacaggagtatgaccaaatttgttgtactatattatgtcgcatcccacactagggctgtattcgcaattcctggatgggaactcattccctccgcaaggaaaacggagcggtccattagcgcatgattaattaagtattagctaatttttttttcaaaaatagattaatttgatttttttccagcaactttcacatagaaactttttacaaaaaacacacctttagcagtttgaaaaacgtgcgcgtggaaaacgagtgataggtgttgggaagaagggggtgccgaacacagcctaggttggggtttttttaggatgagggagtagatttgtagtgttcatattttcaatactactatgaatatactacaggaaaaagacgaatcttaatccatcaatactgattttataatattttaagttaataaagtaattgtaaatattataatatatgcacgcgtactctctcccctttgactatttcttccaatagtctcttatttatgttcttcatcttctaatttttaactaattaataacttaatataaaaacgataaacaattataaaactaaatgactataattcttaagttatatctgatttttagtttatttgaaggttgttttatttataattaaataaataattcaagatccatattaccatatttcattttataaatataaaaatacgtcatttgaatatagacacctattgtttgcatggtaatcaaataaaaaaagggaacattataaaaaaatgacaataactattgtatcaccttaaatcattatacatcctctctatcgcacttaagtcgttacatattacatcttaactaaaaatagaaccttagaaattgtaagaaaaataatatcaaatcatcggtttccacttaaaaaggtggatccattatttttaactagtagatatagttttgggaaaatcttaagccaccatgtcttatgacttaaaaattagaaaaaaaataggatattggatattctgaaaaaaattggccgatcggttcacttaaatcacatagaaaaaatagacaaaaaaaatgcgcctccacttcaacctcctgtcactgcacacaacacagaacccgtcatgccctctcttggctcaagctctccaccctccatctatcctcactattttgtatagtgagaaatattcaataatattaaaatattcatattttttaagctacacatctgattcctaatctaactattgatgtattcataatcaaaccaacaatctaaatatccagaacgcttatattttaaactggtataaaagaaaacaagaaatataaaatatcaatagggaagaaaatctgacaagttcgtaaaaaaactggttcttacttttcactaaaattacaacagccatggcatgttccattttcataacaatttttaaatgcttggatgttaatagtcttacatctatcatataccatagcattatgagtttctcctcgtatgattgcatatataagccacactatgctagcggtttatagtttattgaaaaggtatatttgttactactagtttaaatttttggactcagtattttctttttaaaaagatattataggtcacgcatatcacaagaaagcaaggtctattatatatctttattaatttgcatataagtatgtaacaacttgcgtcaatctgaaccaactataaggatgactaacttgatggtatgaataaaatatatttattaacaatgatagttaggtaggatttgttagaaaagaacccactaaactttcaattaaactagacaaaacaccttattttcaatttagacttaatttgttagacacgtttttcaaacaaactaaatctaatataagtacgagatcatagataattatttataggatctataaaatattgtatatttaaaaaactagcaaatagttatttcgaaaagattatctaagcaataccgatgaaaaaaattatggagaaatagcacttttaaatcatggcaggtgtcatccgtaatatttcgccccgcagctgggcgagataggaggatgcagttggatattttttcgacaatatgagtttttcaaatgcaatttacaatacatgcatgcatgcatgcgtgtatgtcaggctaccttcctagtttacttaaaaagctgaagaatatgtgtcctagtttgaactgaaaccgaatttatttagcagcataataagcgactatgaccagaaaaatcaaacaaaaaacaaaatgttacaagttctttttttttaaaaaaactaaaagttactacattgttactaaattattatgtaactataatataataactatactacaacttctaaattacttatgaatgtaaagttatatatgtattttctaatacttatatgcaaattacataagagtagttattataatgtagttgtagcatatatagttagtgtaattatattgcaattatactatagttaaaattgaatgctttcaacttaaaaagtttttacagtaacttttttataataaaaaaaatgactcaagaacgcacaaacgtgagtcgaagaattgtgcacatataattagggatgaaaacggagcagatacggacggataatgctcataccatattcgttttcatatttttggccggatacggaaacgaatacggatagctcgaatacggaaacaaatacggactatctcgaatacaaataagaatcgaatatgatcggacacgaatacggaaacaaatttttctcggaacacgaaaaccaattcaacttctaatagaaacaaatatcaacatatataattagctcattttatataaaatgtagtataatttataaatatttttaaaattttaaataatattaataatctggactagtgttaagagatgaactactattaaaatataaaaaggtatactgaaggtcatagagttataaagaaatggggtatgtcttatggcttctgcggatatccgaataacactgtttaccggatatcgttattattatccgtatccaacggaaaccctgataccatattcatattcgtattcgagagaaaatatccgtatccgaactatccgatccgaaaggtatccgcattcgtttttattcggagcggacggaaactatccgctccgttttcatccctacatataatacgagctagttgtacacgtgttctctacgcattaaattaagacagaatctttatgaacggtctactattcaacgtactattcaacgctacaaaccggacgtcaaaaaacatgccaggaaaaaaattgcaccattcaaacggaaccttgaagtcgtgtcaacttgttggagatgagaaaatccaaccgatgtgtattcttgttttttgttttttattggtgtgtgtatatatatatatatatatatatatggccgggatcagtaacaactgaacttattttaagaaagacagatgtaagcagctgcataaatccggtcatgtcagaaagacagcttggaagagtgcggaaaattaaggctgtgtttagttggatccaaagtttggattttggttggaattgaaaataatgtgactgaaaaattgcgtgtatatgacaggttgatgtgatggaaaaaactgaagttttgatataaactttggatctaaacacagcctaagtgagtcgaagtattgtactgtacatgctactcagtcgaagaattaagtgagcttggactagttgtgcgaccgtgtgttctctacgcatgcgcaccacaacaaattcaaattaaacgtcaaaacacatggttgcacaaaaactgcaacctgtagtttgttcaacggaaaccagtaagtcaatgtcaatgaactgatcattctatcgcgcataagttcaattcagtcagtttatcaacgacagcaaaagaaaagggggaagataaatacttcatttttgaagaccgaatatgcgacgaaacactgatagaaaacaccacaaacataacggttttataggtgttgctatgcataaaaccggcatttacaaggcgttttcgtctaccggacgatttcggtggattaataacaaaacggttaaggattaatgagtttatctaaaatgtgtgcagataattagttttaaaaataaggtatttaggtgttcttggagacccctataaacataatgcaatgcgcgctatagattgcaagcgggccgtaactagtcgcttattttcacatggagctcattaaggcctagtttagttcccaaattttcttccaaaaacgtcacatcgaatctttctacatatagatgtagcattaaatataaataaacacaaaaactaattgcacagtttacatggacatcgtaagaaaaatcttttaagcctaattagtccataattagccataagtgctacagtgacccatatgtgctaatgacagcttaattaggctcaaaagagattcatctcgcagtttctaggcgagtcatgaaattagttttttcattcgtgtccgaaaataccttccgacatccggtcaaacatccgatgtgacacccaaaattttcttttcgcgaactaaacacactctaagatacttgcatgcaaaaatataatttcgtaaacacaccacttaagagcctgcatgcaaaaatgaccatattttcccgtgcggtcctattaagtggccacatgccaaaatagattttcgcatatggacctcttaagtggtccgcatgcaaaaatgcccctcatcttctacatagatattttctctcctcctctttcttttccctctcaacactttaaattttttccacttgacctctcccctcactctcattttctccactccctctgtttctattcctctcctctcctctctctctctctcatcgagcaggagcgggcagcacggccaatgagaaggcgccaggagcgggcggtgccaccgcgcatagctcagtgggcacggactccggcggcagccgcaggcgagggccacagcgagggcaggcgtgggcgacgacggtggcccttcctcgcccagatccagcagcggcggccttccccagctacgatctgtcggcggcggcaattcccatcccaatctgctagcgactgccctcccccgcccgaacccaccagccaccgccctcccccgcccctatgtgctggtgacagccctcccccaccccgatctatcggccaccaccctcccccacccggatccgccggcaagaagagaggaggattacaacgagggtggcgacgatgagaggaggacgacatcgacggcggcagcgataggaggatgaggacaatggcggtggcagctggaggacgatgacaactggaggatgaggacaacgacggcggtgactggaggacgagtacggcggcgggccgatagcggggtattttccgatttttggaatttttatttttcttgcgatttttccttttcgcgtgcggtcgggttaagcgccttgcgctggccttttcttccaagcggcccgcccatccgcat

SEQ ID NO: 67222 - DNA, 6616 bp, Oryza sativa
ttcttgcggaggacgcagggaatgtatcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcgaaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatatcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggagggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaacctttataagcaagacgttgtatgaagaagggcgaacatgcagattgctaaactgacatgtggtggacaaaggtgaccggtctgtgactggtctgacactggttatgtcgccggaagacaaccgtgttcccacgttgcacctgcttccggcggagtggaggtaggtatgggccgtcccatcagaagggtcactcgggcagcagccgttacaaatctccgcccatttatgaagagatgacagggtgatccccgaggtcagacgaacgaggacgcgtggccacactcaaaaacaggcagtgtttcagcttccaaaagaaggcaagccaagttttactatagataggatgggcccccacccaaaaaaggagagagggagaagtggtgcatgtggtatccccttgagatataaaaggaggaccttgcccacttaagaggggaggctggaaggggggaggatctggagaggagatcccaggagagaaaaaaaaaggagaagagggtttttagaataagagctctctggctctccagctctttgtagcttcttcatacacagatccactagaacacaggagtagggtattacgcttctcagcggcccgaacctgtatacatcgcccgtgtcttgtgctttttccattctcgcaaactttccacagactagaagcttagaatctcaaccagggcccccggccgaaccggcaaaggggggcttgcgcggtctcccggtgaggagccccacgctccgtcacatatatacattctagttaactgatatactagctaataccctctatccgatgccctcctggtacttcgagaagccacccttaactgttgagttccttatgatagcccgtcatgaccatacaaccggggctaaatacggaggaataccctccccagggaattaacttaggactatataccggcgcagaggaatacccgtactgagctgtcaccatcagcggcccacctttcatctgcaatatataactccaaataatgatatcccgtaatctagacatcacgtctaaactaccagtgtagacccctgattttggaaatcggaaatcttctgtgtttatccgtaccaatccctggatcagtagttggtacacacatacatagttggatcacaacatatcacgaatgaattcaggctaaaagagttaaatacttacattagggccaggtaggccaacaactatcagagaacaacagcggaagacaaaatattataagggcccggttaacatgccacaggcagtcgactggggaacgagacctagaacaagaccgcactccgatcatcttgttggatacgcaagcgtaccgacaagggcttctcttcaacactctcctaaaagatatataaatagcaagggtgagtaccaaccgtactcagcaagccaccacaacaacaatgcgtatgatagaaggtatttcaaggaatggcttcaggttcttttgcataaagctagttttgcaattcttttcacaagcctaagacctagcatagactgatcaagttttaataccagtgttcacattaaacaacgacggttttgtccaccatccattgtgatctccaggacagcttcccgtcattaagtcgtcatggttttctgaggacgtccaccttccctcctctcaggaagtggctccatcagcataaaattcatcatgcaatatcccatcccacacaagttaagaattttgagtctagccaagtgtaatacacgtcccggtgctcaataaccgcgagcacggctattcgaatagatttggtttactcacactgtagtggatgtacactttacccgcactccgcgactgctcaacgcatgagcctcgtcccaacacatgagacgcgtcacggcaaagcttttcgataacctcgcattggcagtacctgctccatgaactttacatcctcatgcactctaggcgtacacggtttctagcagtgagaggagttctggcgcacccgggaagggaaaaacacacacattcctacgttgcttcttgtcgttgaacccagtccatcatgattgttctcttatgggtatcctcatgtagtattgccaagccagcctctgaccatccagaacgggcatccgccatctacctggccacctgaaccgggcatccgccagcagactgcttgccgcatcacacacctagagaaaaccactatgcatggatactgcctccgcgcagctatctactccgctaggtctatacccatacgagaagtgcggttgtacgggggtcgtttcatgcttaacttcatggctctgtccttaactgaccacggacggcactagccttttccggacaccacccaaatcctccagccgccctagtcgaaaatagttgtttcactttattttcctttcacaaatcatgtcatcaatatcatggcaatgtggcgctcatgtctccacatgcagcatctcaattaccttcccaaggtaattgcccaagcataaagcattttgatatatatgagtatgcatgattctagagtagcatttctaagcatttgtcatagttgactagggactcatacgtaatcatggttacaagggaataagggtaaacaataatcaaggcatggcatattcacaattaggatgttcatcattgcatgcaattttatttgtaaacaaaaataatttcgcaattgggatcaacatgttcaagaaatagtgatgacttgcctgctcagaatagtccttattcttgatacaatcttgatcaaccttcacctcctgtaagttgcagacgttgcctcacgactaaccgatacacaaggtctataatacgcgagaaaaaccaatattcaaacaacaatcaaatatgcacaacaaaatgtactattcgtgtttgctaatggattccaatcatgctaagggctaaagtttcttaatctttctattgtcatcgtggtctatttaggagttaaccaacttagcgtttatgatatacatatatatttggctaatcggtggtttagtctatcaaatggctatggaaggattatggctatatatgtatctatctaaatagcacgatttcataccagaggttctgttgttagatggatttaggatcaatcaaataatgaatcatttgtattattattttattgatggaggcgttactttgattatgaacatattttacttgtcacaataaattacaaaaggttaataattatccatgctttgtatgttagagttgtttaggttaatcatattatggttacagattatcccatcacataattttacaatgaataatcctaattttcagttgaactataattataattatatgaggtcaagatttataactagtatttatctaatatacatgtttgtcatatactccccctaatttaatatatgcaacacgcaaattaatactataccgtacaactataatgggatgtatagtatatgtgtaagcaacaatatcttattattggatcatatatttgagtagttgctttttactataagctatacaatacatgttgattttaagatggctcggtttggttaactaatggatgtcaaccgaatatatatatatatatatattctacttcacatgacattgtatcgactaacttttaagtggtccagctctgtgattattctcctaaacaagttaaagattcatctatgtgtttttatattttagttacaaaatatgaggctaaattttatgtaaataatttataagtcatggatttagttatatttggacatagaccagtagatggcactaatattttcctatacacccattaatttgaaggattgattataactaatttatgtggttgctacagtggcaaagcatattaaagataattatgctattgtacaatatccatttttatttattggcacactatttaggctaactatcatctaatcatttgatattaattaatttataattataaatatattttagtaaatagtgaattatataccattggaaagcttatgattttagatgaatttaggttcaagtttcacttaaatcggagctaagatgaataagttatgctagtgtaaagttcaaatttgaattaattctaataattgcgaaacagtactgttcctaattcatttatttttattccataatttacattgactgacctgtgggaccggcctgccatggacacaacatatataagtgaatttttatagattttaatcatagggaccccacatgtaagggacttaactaataaagatcaatgggaggattattatttactaatcacgtggggccactctaacctcccttctctattctcttttctctctctcttctctgttttctcctctctctctcggctctctgcctactcggggtggcaacggcgaccgaacgagggggagggcggcggcttaccggcggcggcggcggcgacggcggcgtaaggcggagcgtcgcacggcgcggcgcggcggcaccgagggcggcggcgcgacggcgcgaaggcggctgcgcggcgacacgaaggcggcggcgcggtggaggagaaggggaaaatggggaaagaggaggtggggtagtgtggggtggaatggcgaccggggggatttatagggcgcggggaggggtggccggccctaaaacgtcgacgggatggcgcggcggcgcgaggctcggggcgacggcgacgtgcggcggtgggacggcgcggcgcaacggcgacagtgcgcggcgcgggcggggcttgaggcgctgatggcgacggcgtggtagcggcacggggctcggggcgcggcagtggctgttttttttcggcgacgggactgccgcgcggcggggcgcaggcgcgaggcggcgagaggactggcgcgcggcgacgcggcgagggtgacgccgacgggtgacagcgacgcgcgcggcgcggcacggggcgcgacgcgatgcgacgcgcgcagggctaggcacggcgcggcagcacggggctcgggtttttttgaaggcgcggtagcgcgacggcgacggctcgcggtgcgtggcgatggcgcgcggcgcggcagcggggactggacgcgacggcgacggcgcgtggcgcggcagggcaggggcgcggggccgacggggcatgtgcgcggcgacgggacgtcgcacggtgatggacag

SEQ ID NO: 67223 - DNA, 5867 bp, Oryza sativa
aggagggggaagggctaggggaccacatcaaacacctaggccataatgaacagtgactttttcctatttattcaattttggggcctatttcctattaaaacttgtcccataaattctagattccacacaaatggagtttacccaatatatgttttaatttagatgaaagttgaccaaattttaatattacccatattttatttatatatcacacaaatgatttctttttatattcttggccctaaagtgaacttatatatttttgaagactttgggggtaatattctgtttaatataatgatgtgtccttaattatacaatggtagattggtcgagtctatttgtatagcaatacattttacacagataggtttaatccatttattctataaatagtaatttgagactcggtacaatattaatctaattgtttaattaaaactctcataattttatttatttataaagcttattttatttatataaccattattttatatgagtgattttcatgttatgaggagcttgataaggtgtttcaaatattaattatatattctagtgagatactctattatagatggggccattgatgtgatcatcatttcatgtgtacttatatttcatgtgagattggattcaagtgaattatattcaaccatgttgtttccttttgttaaatatgaaatcaggctatcaacatggtttgattatttaatatttgatttgtgatttatactacagggtttaataattaacttgtactttatttggcttggctttcatgtgcataaatatttatgggattgataataaataccgtatcgttgtaaatcgtaattattgctcgggtgtaaatctttagattgatttttccattgtgtcgatttatggtttggcaagcaataacaaccataacatccaacatgatgcaaaaagttttaaaaagttcaaaattttagtgatttttaatgttgggaattttcaggatgttacaacttgatactactctaatattatcgtcatgacatagagtaattgcataagcaaacactatacccgcaccaaagcatctcccagataagctagccgtatattcagtataacatgaacataatgtaaagtaggtactcatttactcagaaagtatttcaataccataaatgtatttagaagagtatctatctatctatctattatattattaaaacagctttgaaaggaggcaccacgttcgtcgtgggggctagaaattcccacattaatcagagaaaaagaaaaaaaaggaaaaggagagtccaagtagaaataaaatttaaaaatagcttaaattcggaattaaaattttacccgttagattatagtgggtccgaattataatggtatagattaattgatatagttgtatacaagatacaattatatctacataaatagaacttaagagttgtttgtctattaaagctaaaagttgtataaaatccaaatacacttctacgtataaggttcctataaaaataaaatttttcagaggcatgcagccttgcggaattgaaatcaaacatgatataggatctatacgtatgtaacggactcaatatgaattattgtctaatttctgttagccaaaagaagttccgtatgaattagattatacatatttacttttataagtcaagcacgtatcacaacaatattcaggctttgatatggacggaaacagatcaacaaatattagggggacgaaagctgcagcagcaggttaagcaacattaaaaaaagatttccgtaaaaaaaggaaaaaaagatttctgtaccaaaaaaacaagcgctaaaaattttaggaattactaactagcagcctccgataaaaaaaagtgcgaaaaaagggtttccgccttccgtaaaaaagaaaaaaaatagtgtgaacaaaatgtccaattctaaacaaaaaaatcccgtcctccgtgcccaaaaaaaaaacaagcgcgaatttttttttctatccgattaaaaaaagtgcgttcccgttttccttaaaaaggaaaaaagtagtgagaaaaaaagatttctgtccgattcttaaaaaaaaaatagtacgtataaaccggtcctcccgaaaaacctccgtgcccgaaaaaaaaacaagcgcgaacaaaggttcccgttttccttaaaaaaagaaaaaaaaatagtgagaaaaaaggttaatggaagaaaaagttttcgtgaaacgttccaaaaagaaaaatctgattccataaaaaccgatgcttttccaaaaattccttcaaaaaaagaggctgatgggaaaaaaacgaagagtccataaaaaaaatccaatacgagattagtaaaagttaggaataaaaaaaatcaaaattagaaaaaaagaaaagaaaagaatagttaagtagaatacaatttaaaattaaatataatcagtattgaaataagagtacatatcagaacccaatagtagatgaattaaattcggaatagaaaataataaaatctaaaattaggcaaatgaaaaagagagttaaagtaggaatacaattttgaaacagctgatgaaaataaaaaaataaaaataacaaaagaatacaataagaaaaataaaataaattctgaaattggtgataaaaaagtaaagactattgaaagaaaagaccatctaaaacatatgatgagattaattaagtaacaggcctatagaggaggagagtggtggcggttgatgggacatctaaaaactattaataaatcaccaaataaaatcctaatgactattaaaaggaaggacgacgggcatgtcgtgaagtaatcggtcaaggcggttggcgggacttctagaaagtaaaaaaataaaccccaatgaaaatcatatttgatttttaaaatctcaattacaaaaaaaatgagaggcagcgggcgggtcgtataggagtacaatggcagagccgctgatggttggtgggtcttgtagaaagtaaaaaaatgaattccaacgatagttatgttcgattttacaatcccaatgagaataaaaagtatgcggcggacgggtcgtagaggactacagtggcaccgtttgacgggatttctataaattgattttaaaatctcaatgacagtaaagaagggcggcagcgggcgagccgcagaagagtatagtgacaaagttgctgacgttttggcggaattctagaatgtaaaaaaataaacctaaacgataattatgttcgatttttaaaataatactccccccatcccattttaaatgcagacatagttttccgcacctaattttaaccgtctatcttatttgacaatttttttaaaaaaaattaaaaacattagtcacgagtaaagtactattcatgttttatcatctcataataacaaaaatactaattataaaaaaatcaaataagacggacgatcaaagttgggcgcgaaaacttatggttgcaattaaaatgggacggagggagtaatgacaataaagagaagatgcagtggacggtcataaaggagtataattgaagcgtttgacgggacttctaaaaattacaaaaaagaagcccaactggacaataaactctaaaagctataatttttaattcaatttttaaaggtttcaagaagaatgaatagaaacaatggtgaatcgagcaagctaataaagaataatatgacagaagtaaacggtagcaactagtgtgacttttaaaagctataaaattataaacacgaggatgataaggtttggtcttccaaaatcttaagacaacgagataactatttatgaatttttaagtaaaatcatgttaaaaaatataattttatatgggtgctagccgcgcaattacgcgggccacccagctagttctagtaaaagtacaaagcttacaaaagagaagagaaaagctactagagccatacccgaactcttccgaagactttcgaagtcctgatttctactctattcctattccaccagctagatagtactaaactaaacttgagagaaatgagagagctattgcttgaggtgtgtgagtgaagtgagaaggtgaagtccttatatagaggtagttatgacggttgtggaaggggaattgtccaaagtgccctccaaccatcattgggatgcaatcctggacgtccacgccgaaccctgcatccaacggtgccaggatgggtttggccgaaccatgggctgggccttcccggcccatcttcggctggtggcctcctctattgcttcactttgtaaacttgtgaattttggcccaattcatcgtgtcaattctgagttcttggcccatttatacataagtctggttctcgacatcatacaattgatttatcatctgagttaatgtcgattctcctccattctctgcaaaaggttagtatacctaatactagtggaatattattattctaacagatatatgcattgcaagcatcactagttctcctctattttagtaatattgacggtcgaaactgatcgataacgaccgtcaataaaaccccccaagcttgaacctttgctcttcccgagtgaaggacgaaaggaaacaaagacttggttgttgatcatgagttgctactatgctgcatatctcaaagatacaggtgcaaggtatatgtactctctctcatattaaataatctttggcacggtggcttacccttacccctgattcccacgagacactgctttttcttgccttgagcggttgaaagacagaacagtaattagagcaccaatcacccaatctttatttatctcttattccggaagttttcaaatgattttgcaaaagaaagccgagttcctcaaatgattcactcagtctctccaagtgtatcaaaatgaattcctcaccaattgtagcctttttgattcctactctgatgtaataccccgagattcaaattagtgtattttgggaaatattaaaataaatgtgcaaaagtttaacttttaaaccgttgctcgaataggcgatccgaaaccgtggatgcgtagagctcgctgagtagtgcaaaatatactgtaagtttatagtaatcggagtccgaacgaagtcccggggatcgatttaatgtgggccgttcgatctttattagcatctctatttaatcaacagaaaaaaaagagaaaaaaaaagtaacgctagcccaagccgcctccgtccctgcgcttgtgtcgccgctgctgctccttgtcaacggcgccgcttctacgccgccgccgctacagccgtggcggccaccacaaccatcatcttccgtcgccaccggtgaatcctttccatttctcttcttcccggtgaggtcttgctgctaccgatctgaactaggctgctgctctgtttgcttctgcttgttgctgcaccagggaagaagagaagaacaggaaggagagaaggacaaatttggggaatttggtggatatttctaaattctttgttttgcctacaaattagtactgctagataatccgttttaatccctagttttgtttctaatttatttataagacgatccgtttccggtagctcgaatttattttaccggccgctaggcagaaaacttatttttaaatctggtaattattcgtagagattcaagtttggtgacctaaataagatttgtggtattcactgttatctttccaacgccgctggtttcgttcgattccgataaacggttcaggagaaacagtagaaacagtgctgctgaccgggtccgaacgggtacagtttaacgttttgcttgatctgggatttataaatgcaaaatcagttattccgctcaacatgaaagttgtagattattttctgtag

SEQ ID NO: 67224 - DNA, 15098 bp, Oryza sativa
atgtgtgtggtatatggtggaaatgatatatgaagaataacaaaaatgcttctgcctttgtgcttactttcttctcccaaaaatcctttttttattgattaggagagggcatggctacatctttttttttcaacatcatgctcatgcttgatggagcataacttttttttttcataaccatgcctttccctccccctttttttcaaaaggatttttctttttaggagaagaaagcacatgaaagcatggagaatttattttggtggtaaaatggaaatggaatggaatattgcttagctcccagtgtaggagtttggcatgtgcatatatgtggatgtatgatcttgatcatagagcatgagaagtatctacacaagtcacaagagtttgacagagttcaatggaatgacaggtaaccaaaatgtatatggtttaatcatgatagcacatttttggctctagtaggaatttatatcaaatgaggaactttcaattttatcattttgaaaaacaaaacatccggaattcaagtcaaactagtatcaggatcatagcaactcatatttattatctcatatctcgcaacaacctagacttagatcagcaagtgcagctaatttacctcagattcccggataattgttggctacttttatttgacctttgagagagcacttaccaagaacccacatataagagatataaaacagagcaactattcatcatttcaacaaagagagctagcttgtcttacctagcatgactcaaatctatcatatcattttttggtattatgtattttacaaatttgtagcgtgttttcattttaataagatgcaattggtaagcaaatatgcaatttggtaagggatatatgcaatgtgatattagttacctcagtggggcgaagaaatgtcttccccccaagcttggctttcgcatcaaacaccttgataaggattgcacccctgaaagcggaagtacgcttgaaggtcatcgtgctgttgctgcatcatgttgttgaagttggcgaactgcgcatcagcagattgttgtcattcttgcgtttgagctatgtgttccgtgaggttgaactggatctctcccgtctgcatatcaagggtgtccattctcttagtgatttcacctaagtcccaatgagaggaacttgagtgccgttcacttggagatggaggcacaccacttgatctgaagggttggttgtccccccattggatgtcatgaggcgcacgccaccagtcctcactggcgcttgcccaggttgagactccgatactatgacgtggagcttgggtccatccgggtgcgtcctcagttggctcccaacctgcctcatacatctggacgggtgttgaggatgataaactttctcgttcatttcttgtcatgtcgtgcgtctccctgtatgctccacctgcacgagattcttctatggtttgtaggggaatggttagttcacggcaattgtacaaatgataccctgcatttggcaacgggatttcatttgtacaactggagaaaaaataatcaaagatccatctactccatgtttcagaatatgcccttgcactagatatgtctcatcaatacacggacgagcggctgagataaaagcaatttggtcgctatcgacccctagcccttttgctatccgagtaatcagagaagtgcactcaacaggagtagagaactttatactttctaaccattgtcttatcatacatttcacaggagtaattttgatctttctaaccatggcaaacatgataatcaattcatctcccataatgggcctcagatcacgtctaagcaattcatttgtgcatgagcctaagtgtaggattatggatatcattcgttctaggtttcttgcaaattggagcaccagaaatatcttcccaaaacctatttttcttgaacccagaaattcctttctggagattgattttacaggaatcttgaaaaccaagaagtgtacttaagcctttccatgtaagtgtaaactcttcacggaaaaaatgaaaggaaattccatcttctatttctttcaaagtgcacagaaaatgcaaagtaagcaggagagaaccaggctcatctaccacagcaaatctctgccaaccaacagctttacaaaatagtacgtaattcagcatccatacctatcttttttagcagcttcggtgagtattctcgcgtgtgagcatactcccggtcgctcagcatgtagtaggcttgtctctcccgatcactgacaaggtcaaggtcggtgtcgttcaggagtcgtcgcggagcttcggcgtcttccatcaagacatctgctgatgaacgagtactagactcgtcatgacaacttgatgaagagccggacctcttgaacagacgagacagtcgcctcctcattttgcacaatggagcaagaacggactaactcgacggaggttaggaatgacaagaatttcacccgccggttagtttcaccaaagcaacttgtatatatgcaactaattgtttgaatttgagggaaactatcaaagcttgaatgaacttgagagcaaactttggagagggaatgaaaatgtgttgaaatggggtggaattccctctctcggccggttggcttaagtagtgcacccacaacggtcaaaaccgacctatggggcccactagccgttgcctcaaagaaggaggcagccgaccgttggcctggccagttcaaccgaaccagtgggttcggccgaacccacggtgggcccaaccggccccactttcggccgttgggttccaacggtcagtgtggtcatggcacatcggattttcactgaaaattttattttggtttgctctaaaaattttatttaaagaatttcctcagaattaaaaaaaaacctaaatgcaattttgaaattcaaacatgtgatgatgcaaaaattcaaattgttgaaagcaaatatacggatacataccaatttacctattggcgaaggtcgcgtcatttaaaatccgacgtgcaagactgtacctccatctagttcagtttgcggattttctacccgtctccggagatgatggagcgggcgtctttggcttctccctccacaccttctttggttttggtgcggacagcggcttcttctgagctggctgctctagcttcttggctggtatgggttgttttaccaatgtcttctaataacagttcctgggcatcattgtttccttctccaggaaattctgcatgaatttcaccaggctgtccattttgggtggctccacttcgacctcttgaatattctgtgggtttggcccgtactttattttgaccatggagcattgttccgtcctcggttgaaactcaaacttctcttccttgtcgttgatgtggaaacggatactccccgttcccacatcaatgttggctcccatggtgctaaggaacgggcgccccaggatgagcggcgtctcttttcctgtgtccatgtccagcaccgcgaagtcaaccgggataaagaaatcccgtgtcttaactgacacatcctccgctatccctgccgggtaacggactaacgaatcagccagttgaaggcgcattgttgttggtaacaacaccgtgaagttgagcttgtcgaagacgtcttttggcatgacgctgacactggctccaaggtcgcacaaggcctggtcgaactgttgtgcccctatcaagcaggtgatcataggacaccccgcatctttcttcttctccgggagcttgtggagtattacgttgctgcattgttccgtcagcttgaccacctccgttgttgggagcggtctcttgctgttgagtatgtccttgagataacgggcgtatgttggctcttgcatggcgtctaacaatggcacgttgatgtggatcttctggattacttcaacaaaacgagcgaattgctcgtccgctgacggtttcctactccgttgagggaacggcagcaaccgtgtgtcgcagtactcctgcggtactgtcttttctggctaaacctccttctcagccgagtcactagatgacgcttctttggttatcccattagtttctgcagggttaggatacggcggatcacgagtggacttacctcccctcgtcgtgatcgccttgacattttcagtggaggagtcaggttgccccaggatcctcccagtttcatttgcatggactaaggatgccaattgagctagctgggtttcaatcattttattaaagctcagctaattttgaaaagcagaagcaaagccatctaacttgacatttatgttttctaggacattgtcattggccgcaagctttttgcttatcgcatcggtggttttagcttgtgcaaaaacgagatccttcaaggagggctggttagaaaaattaccattgttgttacctccttgataatatgggcgtggttggttccacccctgacctccttgtggacgatgcccgttgttgttgttgtttcccatgtacatcgcctcctcacgggtttccgggcagtcattcccagaatgacccgtgttgtcgcagacttcacatgtgacgtgagagtccaaggccttgacggtgccttgtggccgtttctcgtggtcgtccaatcacttcatgaggaggtccagcttggtagcaagtaactccatctccttgacggtatgcatgcctcgctgacgggtctggagtcgttcctcgctccaacccatattggagacctatttctctattagatcaacggctccttgaaccgttttagagaagaacgctcctccagctgccgcgtccaggtgatcgcgggacatcggggtgagtccattataaaagttctgcaggatcaaccagtcgtccatcccatgatgaggacaggcggctacgtactcctgcagtcgttcccatgcttccggaatagactcatcccttgtctgctggaaacttgaaatccttccacaaagggcattggttttgcccatcgggaagaatttcgagaggaatgtcgtagagtatttgtcccaggtattgacagcagcacagttggcatagaaccactgcttcgctctcccgagaagggagaatggaaacagtcgcagcctgacggcgtcgggactaacgcctttgatagtgtacgtgctacagatctccaggaactgttgtagatgagcattggcatcctcattaggcttgccacagaacgggctagcctgcgccattgtgatgaggctgaacttcaagttgaaatccacgtcccctatgttgacctacggcccaatggccacattgtcagcagagggagcagcgaactcgcagagagtcttgttagccatagtcttgaaggtcggtggcactggtacggctggtttctctgtcggtagagttttctgcggagcagcaactcatggcctaacgctccggaagaaagcttctggattttctttgaagttttccggcaagttgaaaccagtcatgcactaccctattttcacaacaaaagtgaaaacaaccaaggttagcttacaaaagaaaatgattatacagaggcaaatataaaatattagttcaagtagtctctattatgaatcttccccgacaacagcgagagaaatacttgttggtatttcttaacgacattactagaaatataattcccagcaattaatggcgcagaaatacttctggtatattatggttacagagttcatccgcaagcgcatggatataccattgtagcatttcacccgagagtattccaagggtattgtatttattttatcccgtgggaagatcatgtagagagaacttgagtaataatttatatattacttgtgataatcatattctaagcaggggttaagataatccaagggtagagtgacacacaagcattaactactcattctcataatatatcatctaagctaagtggaaagaaaagagaaagaaaatctattcttatacttctaatatacatagtatacatacattctagttaaccgatatactagctaataccctttatccgatgccctcctggtacttcgagaagctatctctgactgtcgagttccttacgacagcccgtcatggccatacaaccggggctaaatacggaggaataccctcccgagggaataccctccaaccgtcatttggatgcaatcctggacgtccacgctgaaccctgcatccaacggtgccaggatgggttcggccgaaccatgggctgggccttcccggcccatcttcggctggcggcctcctctattgcttcactttgtagactcgtgaattttggcccaattcatcgtgtcaattctaagttcttggcctattcattcataagtctagttctcgacatcgtccgattgatttatcgtctaagttgatgtcgattctccttcactttattgtcattctctgcaaaaggttagtatacctattactagtggaatattattattctaacagatatatgcattgcaagcatcactagttctcctctattttagtaatattgacggtcgaaactgatcaataatgacagtcaatagtggatatcatggatgccatagatacttgaattttgctttcgaggctttcatgttggtgttatgacatcttaaacttggttaaatgttgtcaaagatagcacaatttgacttttattaaagagtaaatttcacaaaactacaggtattttgcacaatttatcacaaaactacagatttaagagcttgtttcacaaaactacatatttagtgtctatttttatcacaaaactataggtactttgtataatctatcacaaaactacatatttaagaacttgtttcataaaactatagatttagtgtattcgtttgtcccataactacacatttagtgtcttcttttattataaaactacatgtttagtgtcttcattatcacaaaactacaagttttaacaatgctaaaacatgtagttttgtgataatgaagacactgaacttgtagttttgtgataaatgaagatattaaatctgtagttttgtgaaacaagttcttaaatctgtagttttgtgaaataagttcttaaatatgtagttttgtgatagaatgtgcaaaatatatgcagttttatgaaatttactcttaaagttaaatttacctacttgtcttaaattaatgtactatcacgattttagtatgcttgtgtatattattttttattttttgtgatcttgcaaataatccctcgtttccgtattttccttttttcccctgaatttactcttttatgcttttttacgttttatataatttgcatggaatttccgtaagccttttccattctatcttgtttaaatagatacttctgtgttttttctgttgtttttaatgtttttgttaatttttcagagttctctacttatctttctggctccctacgaaactccccctccccatgtttccaaagtaaggacggggtaaacttcgtagtagggaagctgaccgtccccgccccctagcggaaaaactcccccgttccctgtccctatccccgcacacggggcgtggttttctcccgtccccgtccccgtgcgggtactggacacccgctgggttcctcacccccgacggtgagaaggagaagcgtctgccatgctgagaggtagcgtcagtgtggtgcgaggagtagtcgagcagaggcggcgtgatgcggagaggcggcggtagcgcatgcggaggagcaaagcatcggcggggagatggcgacgaaaccaagcgctgtcgcgcggcgcggaggcggcaacggcaggagctgcagcgtggatgtgatgacggcgaagcaccacagagctggttgatccacgcggcgttgcccagcgtggttgattcgagaggcatcacctgatcaccggcggtcggcggagcatggctgatctgcgcagcgcagcgtagaggcgtcgtcgtctcgctgcttcgattggatctgagtcgtcgtcgtcgatgtggaatccttatccactcgaccactccaccgtcctgtgtgagcagacatatacgagctggactagctctagctagagacaaaacccatcagcccatggcatgttaagtgttctcactgtgtcatatatggacattcgatgttgggctagctgggcttttgttgcctgtgggctgtacacatgctatgctcggggccccatggggaagagcttgtgaacacccccgaacccggcccacccgatggggaggaaatttagccgttatcagccccatgggggataacatgcacccacttacagcccctaatagagtttttccccaacgggtttcggggtacggtccccattaccatccctacttcgtaggaagaaaattacacgggatcgaagtcttacacctcgtccgaaggacttgtccctctacttgacacttgtcttgcaccattgcacgaatccttgagtaggctaactcccttgtctctccaagggtgtgtttgcaagagcaagttcccaacacttccctctcgttttcctcgtgtacgcttttcaaactactataaacggttcgttttttgaaataagtttctatacaaaagttgtttaaaaaatcatattaatctttttttaaaaaaaattgctagtacttaattaatcacgtgttaatggaccgctccgttttccgtggataggagatggttcccaacacccacctccaaacatagtccccatccggttcctcttctcggtgagctcgcgtccgaccagcagccatggagctcacggccggctgccactgtcaccggaatcaagcggcatccgcaatgtgttccaggaactaagtattccctccgtcccaaaatataataatttttagcatagtgccaagactattaaaataaaaaacactaatcatataaatgttactagatttatcattaaacaaactatcaataacacgcaactctttttatttaaaacatcatacttttatagatgtcattagtcacaatagtatctcaaagaccgtgtcgaagtctaaaaatgcttatattttgggacggagggagtagcatccaaacttgcacacgagtagggggtggatatcgagctggctcggctcgctctaactcgttaggataacagctggctcggctcggctcgcttctcagcgcgagccaacacactggacaaaagaaacttgcgatgcaactacagattatacaaccaaaatgtccaagaatgcaattgtatcttcgtatcaaaccaagaaatcacgtgctagctcaagtcaacaaatgcatcattattcatggtagctccacctttaacaaatcataaactcgtttgctggtggcaatatacaagatcgagcacccacctgaatccatcgccctgtgccggcaacctcctagcaagcagcaacggcgaggattggcggctcgttgcagcgctccatctctatcaactcctcctgcccggccatgacactaggggtgaaaacggtacggaaactttccggattccggacctatttttgaaaacggaatatgccggtcggaatttttcggaaacggaaacgaattcggaaatattttctcagaaacggaatcggaaatgataagggcagtttccgtcggaactcggaatcggtcggaaactttccggaaattttctcggaatttccggaaatttcctcggaattaccagaaattttgtgactgaaatacccttgattcttttttaagcactaaatagtgaataccatggtgtttggctgttatttttttaaaaaaatatttgttatgcaaatctaaaattacataagaatatttttttgtgctacattgggatttatcaataacattactcttttaaacatagataatttattcaattggatttattagtttgaggggctttttattccgataaattttcgttaccgtattcgtgccggttcgttttcgctccgtttccgatttcgataatattcgattccgttttcgtatccggggtttccgattctgatttcgattccaaaaaaatatgaaaacgaaaatgataaagatggtttccgtccgtttccgtaccgttttcacccctacatgacaccactcgaccaagccaagaacaggagagacgtgtgcaggtggtcgatgcgcttgaggtgtcggcgcagccgccgtcgccgccagacctcaaggaggtgtgccggatggagggagcgtgacgcgaggacgcgaggcacggcaacaaggcagggcggcgcgcggcagaaggaagatcgatctggattgggaatttgggaatttgggatgaggggaaagaggaagatgagagctacactgaccagatagggttctggtctttcccttttgactgttttcttctttgggcctaccgtgtttccttcatatgggccttggcctgcaaacttgtctgcctatgcttccagcttgtttaagctcgtgagcgtctcgcgagccggctcaagctggctcgttagctcggctcgtttcaaaaagatatcgaaccgagttggccacgagccgagcgagctaacgagccacgagtttttcgtccagccatacacacgaggcactcatcaagaatagaacagtcatttttgtaatcctggaagcaggaagctggaagattcatcggcaaacagaaatcctggaaagctcaatcaacttcaaccaccagagcagtgcagtgcaccatacagactaaaagcgaaggaaagaaaattctaatgactgaacaatttcactgaggcaaactgtttgcgattcatggagatggattcgatctaatcgataacgcagcttcttccaacccaaagattttcctcgcggcaggtcgggagcgcgaatttgactccaatttccggctgtcatgagcttgatgcggcttgacgccgcagggcgcgggcgcgcggcgctcgccgcacggtgctcgggcttgaccttgacgcctcgccgaggatacgaagataaatgggaattggagagacgagggagagagaggctattttgagattcgtgcgggacaggtgtcgtgtagaggaataaagtccttccgatgagggtaggacttcagtccttggcaattttcttccaacttcagagctaaggtcgtgtttagtttaccctcgactaccccaaacttccaactttccatcacatcacgtcacatccaaaactttcctacacacataaactctcaactttttttcaaactaccaactttcctcaaactttcaacttttttcaggaactaaacacaacctgagaaagaaaggacggggtatgtcacctcaaaaaattcttttgcaggaatttttcctagggattttctcccccttccttccaaaggagccctttaggccatcctcaatccaaaaattatcaagaaattattaagtaattttcatacttatcatgttcactatgcatagaaaccatgtatacaatgaatggtgtcttcaaattaaattcttatccattcatctctctccttttattcacaaggttcttgtgtagaaatagtttcttgcatgagaaatgatttcttcatttttttttacctctcttctcgttaattcttttaccacataagatttttttttacttatgtgataatgtattttaatgctatcgacattggatgatacggagggttgggaatgaccatatgttttttcatctaaggccttgtttagatttaaacttttttcttcaaacttccaatttttccgtcacatcgaacttccctacacacacaaactttcatttttttcattacattgttccaattccttcaaatttctaattttggtgtggaactaaacacagcataagggtcgattttgaataggatctattaaccataaaataaaaacaaacacatttcgcatctctcaaaacaaaatgaggtccctagatggaatgatgggctaggcaagtaccccctccgtaaaaaaaaaaaaaagccaggaggagtaggaatagacctggttgcatttagcttgggagttgggcaatagacctagtcgatgggctggatgtgggactgagcgttgggccggggcccattaccaggcctgcccattgcctacatgcctagtactccccagcgaggtggaggtgatttagggttccaggccgccgccctccgccagcagttccctgaccggcgccgcgacttctccgggccagtggaacgaagttgccgcatcggcgtcccctgcatcccaccgcatcgagaaggtaaatccatggatttggatgacggatctgtggttgcgcctcccatttttctttcaagatgagttgcgagctgtgtgccaaagaagcccatcatcgtctccatatcgcacagggacagggttgctgagagcagcagcgccaccagcccaaccgtggtgatggcttcgtcgccggagaagaaggatcctcctagttgtggctctcgggattcccagcccatcccttgcacggacgatccccccttgtctgaatccccaacgacggacctaggctgccacgatccgcgcgacgaggacgccgaccacccggcaccacccatgggcaaaggtgcatcctcaatcctcctcttgctttcatgtatgcatttccttatacgatatcgatcgtcattcgtcacccaaggcactaattcagactgcaaattcagacttttgtcccatcacacttttttgtttttcaattctaaaacaccacattggttgtgtgcctctccgtagaggccagagatgtaaaccatttctattatctgaaaaattcagattcagatgacgtctttgcctcagccaactcacacaatatgttgataggtgacatcgacgaggatagtgatgatgatggttacgcagacgaggagacaacttgcccaggtaacactactaataatccagtagagagcttcgattccagattaaaagacgaacagatactatcgctattttaatttctcagggcagaacttcacgaaggagcaggcaaaggaaataattcgcaagtggctagaaacatacgacaagaggaatagagaattcatggtggcgtgcgaggagttccaaaagcagggaggggatgagacgagtgcttcttgtccagtatttcctttgaaaccgctcccggagacaacagatttctgtaccaccaagagtttgtgctatcaccgtgaatacaagaccaatgatacttctgagagtaagtgcttgtcgattcctattataaaggattcaatagttattaatattgtgtgctaccaaattaccaaaatgtatttgtaaagtaacgacttttcttttcttttaaatgtttgtagctgcatctactattgggtggcttgaacccaaggagatgctccagatcttctctttgaggttgtccagctccatgtcctatcctattagtgtttacggaatctttgcagtacgtgattacttggaccctttgaggaattatgtcttcaaccgtaccagagatgatcctgtcatagttgaacaggtaaatacagtctatttttggaagttaagttatatatcttggctgaaaaagataccctaatatgcctatatatattatatatatgaatgctaataagatttttttttcttggataggctgaatgtagtgtgttagcagatacatattgttgacaattggttttatggttcttaaaggcatcttttgtatggtttatcgttagcactgtttcaaaatatatttttgtttctttcagtgctccattttgatataagtgcatcactgttcgctgcaactgtagtacattctcctgtcatcccttatattttggttacaatgggtctattgttaagtcttttggaagtattttggtgtaaagattttctagtgtgttaattaagaggtatatatatacctctaacactaagaggtctatatcagtagtgctcaatatctcattgttacgatatctcattatatatgatgtgcatttttgtatttcattttctgattgtactaacacgctgatggtgtccgcaaaaatatttaactgtgtatataccatcgagtttgtgcaaaatttgcatgccattctatttatttattagtatgcatgtccagttgagtttattctattagaatacttttaaaatatgtatttgtatgttctaattaacacacttaaaattgcttaagctctagctttggattctaacaagtccttttaaattgtaggattccttcacattacctctttgcagcccttgtcgaggaatgtatgtagtagaatatgcattgtttgaggttgatctttgggtgaaaatggaaggtggagtatctaatgacaagcaattagtatccgcgtatgtcgagatttttgcccgtggcgtgtttaataaggagataagggggcggatattaagcgaccattgctatctggacatacactatatgtatctttcacagagtattgaagctgtcatacaagtatccacagagattgacagtaacgatcctcgtcatgtgagattcactgcattttgtagtggctttgaccgtgagattttgctgttcaatgggaaattctgcaaggacaagtctttccagcacattgtggcaatgaagtccaagggaaaactggttgttcacttggagtttgagggatccctgttttgctggacttttaacaatggtgagcttggagctgttaattctcccgatgattcagtcctgaagcaatttcatgtcagggtgttgttttctccaaaataatgtgtaccagcctataatagcttctttgggtgaaggagaggaagtaaatcagtataaaaagcttgatacaatgtagtgcttgtgttaagatgcttatctgggtaataaactagaccagtacttgcattcagatttgcaaattgcatccagggccgagattgttggaggcactgttcacaaggaggcttaatctttgaaacctggatgggatgtccatccatcattgtgctctagcctctaatccaaacattgatggcattgtacacaatttgtgctttatgggcttaattt

SEQ ID NO: 67225 - DNA, 4924 bp, Oryza sativa
  unsure (1)..(4924): unsure at all n locations
gtctccgtctcaaataagccaaaacgtttctccaacctagctcctggattatggattaacactgtatagctcatgactttagaaaagccaaacaaaaaagatcataagctaagcttataagcctaaacaaaagagggtctactatggtccttgaacttttgcttcgggatgaatttacccctgacgtgagctagtttccaaagaactccatataaaatttgttatatactccgtactagctttctattggttcctggatcgacctaaagcgtcatatggactttggcatgctatccttatatgcaagatcaatattaatatgttaattttacccttatatgtagcacagagaaacagaaagaaaaatcaaaggcaaaggcaaaccagaaaaaaattacggatcagactgatcatgtacgtatgctttggttggatgcataaataaaatagtcactctctacagattgataatacttatcatttttgaacaatccaaattgataatacttatcattttgattgtcaaactttaaaactttgactataattacatctaaaatatttgtataaattggtcttaaaaatattttgataaaatcatatatttattgatatttccatatatattataataaaaagtcatactcacaattgtttttaaagatggtgtatctattcatctatctattatattattaaaatagttttgaaaagaggcaccacgttcgctgtgggggcaagaaattcccacattaatcagagaaaaagaaaagaagagtccaagtagaaatacaattcacaaatagctgaaattcataattaaaaataagcaatattgaaataagtgtccatataagaacccaatacgagattaatcaaaattcgaaataaaaataaaataaaatctaaaattagaaaataaaaggagagcctaggtaggaatataatttaaaaataattgaaattcggaattaaaaataaggaatattaagagaagagtttatataagaacacaatacgagattagttaatattcggaatacaaatgaaaatgaaatccgaaattagcaaaaagaaaagaagagttcaagtaggaatataatttaaaattaactgaaattcgaaattaaaaataagcaatattgaaagaagaatccatataagaacccaatacaagattaattaaaattcagataaaaaataaaacaatatccaaaattagaaaaattaaaagagagttcaggtaggaatacaattttgaaacaactaaaattcaaaaataaaaaataaaaatattaaaagaacactatacggtattaattaaaatttgaaaaaaaattctgaaattacaaaaagaaaaaaaattcaattaggaatacaattaataaataactaaagttggtgataaaaaaaaggctattgaaaaaaaaagaccatctaaaacacatgatgaggtaaattaagggcgtgtttgcttgctgccctcagattcgcgcctggctcaggcgtcaatctcaggcgtccgatttcggtcgcctgcggtcggatcgacctgcctgagcaacggtctccaggcgagggcagcaaccaaacagcccctaagtaacaagcctataaaagagtagagtagtggcggttgatacgacatataaaaattgctagtaaaacaccgaatagaatgctaatgatgattaaaaggagggacgacaggcatgccatgaagcaaacgggcaaggcggttgccgggacttctaaaaagtaaaaaaaataaatcccatttataatcatattctatttttaaaatctcaatgataataaaaaggagaagcggcggatggggtgtataggagtatagttgcagagccgccgactgttggcaggacttctataaaataaaaaatgaattccaacgatagttatgttcgatttttaaaatcccaatgacaataaagagtatgcggcggatgggtcgtagaggagtatagtatattagtatcatcgtttgacgtgacttctaaaaaatataaaaaataaaacccaacaagataataaactctaaaactacaggtccaattttaaaggttcgaaacttctaacaagtaaaaaaaccaaatgataatcatcttcaattttaaaatctcaatgacaataaagaagggagacatcgggcgagccataaaggagtacaatgggaaagccgctggcagtttagcgggacttgtagaaagtaaaaaatgaactcgaacgataattatgttcgatttgtaaaatcccaatgataataaagtgaaaatacaatgtacgggccttagaggagtataatggcaccgtttgacaggacttccagaattataaaaacgaaacccaacgagacaataaactcaaaaaactataagatctaattttcaaaggtttcaaggaaaatgaatagaaatagtggtagaccgagcaagcaaataaagaaggatatgacagaagtaaggggtagtagctggtgtgacttttaagaactatataattagaaatacggagatgatacgagaatagctatttgtcgaggaatgatcctctctagcgggtgatcgtgagatcccccttttgtgagttcggccgggggaaaaggtgcgcttgacgagatcgtttatccgccctgagtgcttcgagatcgtgcacgagtgtcaagattatacaggttcgggccgctatggagcgtaataccctactcctatggatgggatttatggttgagtgttacaaaggttcctaaactccggagagcagtctcgctcttcttctcctagggtttaggcctactgggagtcatccccctttctcggtgggtaaggtcctccttttatagttcaagaggataccacatgcaccgcttctacctactctatcacgggagggggacccactctactcagaccggaccacggtctgtgccttcgcccggaagctaagcggccgtccgtcctcgagtgggacccagcgccacctcccgcctgacacgggggacagccctgtcattccctcttaaatgaacgaagacttgtggcggtccttctcacgtggagggagttctggatgatgctttgatgggacggggcatacctgcctccactccgccgggtacaggggcgaacgtgggggcacggctgcccgtccgaccggacgtgaccagcgacaggccggtcacagtctggtcacgcctgattgacgtgggtcaatcgggccgcaccgcacgtccgcccttaccgcattaaatgcggtgagggacggttggggcgccgcgcattgatggcggttcagcntgagtctcctcnccgcgcgctcccctcgccacatggtagctgggcgagggcctcggggcgaggcagcgcgagggcccaaggggcgtgacgtggcaccccgaggccccctggctgcctttgcgtcttccaaggtgtgggggaagggctaggctgtagggccacgtggctggatgggaaggtaactcccccgtacttcgcacacccccgggcccatatcaccgacactatttaataaattttaagtaaaatcatactgaaaaatatatgattttgtttaggtgctagccgcgcaattgcgggggccacccatctagttttattttatttatttatttttactgggccacctacatgattaggcccatagttgaaatagcccgccacgtataaaagtaggggcgcaggtgaggtgagcaaacgagattattgtgctcgcttattttcttttttttcccgctcgctgttgataggtatgttgtctacactattatgacccgaacatattatattgttaggggactagtggatggtatacacgagtagtactcccttagttacttttttagttttcttaatgacatcatgtaacaccctgaaaattcgactaaataaaatgaaacccgaaattaagtactttcaaaaacttttaaataaattgcattatgctgatgttattggttcttttattgtgcattgtgttaactaaaatagaacataatggataaataaatttttgagtgaaaataaatattataccaattattaaatacggtaaaatataaacatacatggatctagggcaatataaatattgaataatatttaatttggggaaatcacatttgattcttaaattagtcactcaaatgcttttgggtgaatacaacaaattttctcaaattataaatcaaccaaaaccctaaaatgggggaaaatagagaaattagaaatgtatataataaaaataaaaatatgtccaatattaaatttgaatacaagttacatttgaataacttagagtttgtgtattttacattgtggcaaaataggaggcagtagtttatttagtttttagaagagtgatcctcaaaattagccacgtaagcgccacatcatccaaaaccaccatctaaaccaccgagggacctcatcagcaccggtttcgatagttgagggacccgttgtatctggttttcgttgacaagtcaagggacctcagatgaacttattccatctaaataaggtcccaagacttagtcaggctgagtgatggacatgggcccattaccaggcctagccattgcccagaattaaatttgaaaatataatgttcattcattttttttcccaggaatattcgggatgcaaaattttttacagaaatataacgtcggtctcgctcaaccattgcgcgaaagtgacgtgggaatgatgctgcgggcggtacgcgcggtagaggcgcgagactgcgcggtttcgcggaatggaagagtgagaccgaatggtctcgcaaaatcaaacagcgacattgtccaacggctcgatttgattagtgattaattacttaattaataattaactaataataattagcgattaattttcctaat

SEQ ID NO: 67226 - DNA, 19087 bp, Oryza sativa
taaatgtgttatggtctcagcggtgtattcacgggtacctaaatatagggcatatgtgtcttccatataatctgaaaagaagctacatgctagctcatctcgcttgctgttaaattgtgtttacagatattattatgtacacgcagctgagcttttaataaaaatttagtgagaccaggatttgtcgttggtttttatcttcatgagtatgtgttacagtatatatatatgtggatcagtggatgtgtgagggtagtagtgtttgtgtgtacgtgtcttctgtgtaatcgagaaagaaaagatatacgctagttcagtgcacctgctgattacacttagctgtaccgcagattcccttgttcttggacgactttaaaagcctcgaagatctttcaggccacgagctgttgatacgtttgctcaagattctttcgtgtataacaaggtcagatgtggtatagtttagtccatgtccgagttgtgttcttggcgttaagtctacttaggccctgtttagatgggactaaacactacgccggaccaggtcatctctgacgggcccaaaccctcacctttgacgggtttggtcttggtcagtgattagtggtcactgatgacaaaatcacctgtgacggatgaaacacccgtcacagataacccatctctgaccggtatataagtcatctctgacgggttaaaacttgtcacccgtcacagatgagtcatcagtgtcgtgtagtaaacacctgtccgtcgtagatgactcatctctgacgggttgtaacttacgacccgtcactgatgacaaagcaagaaatacaatttttgaattttaaacgcaacaaaaaacctcaaaaaaatattttgaattttactagccatcctatacatggttacacatcactacctacaaattcacaatttttcacgcaatataacttgtatgctacaagtgagattcaaactcaagacctcaacctccatatagagctcccttaccaactcacctactcaacacatattgactactaacccaatgttattattttgtctatgcttatctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgtatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcaaaatttaaaaagcccgtcaaaggtattgctcatacctttgacgggcttctattcaacggcccgtcactggtatccgctcacctgtgacgggccagaaatgaaagccatcacaggtggcggcccatcacctctgacggcttctaatgtatcggcccgtcacaggtgaggggataccagtgacgggttggaagcaaaactcgtcactggtatacctctgacgggttttcctttcggcccgtcacaggtgaggggatacctgtgacggtccgcggccggatggctcaccggtgacgttatcccgtctgacccgtcagaggtaatggtcactagtgaccaaatcgtttgcccgtcacaggtatcccgtcagaggtgtgaggatctggcgtagtgaaaacttttaagtccctatcacatcggatgtttaaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctagatctaaacaccaccttaacctgactagcactgaacaagacaatgcgttttgttctgtcagggtttgatttttagtgaaaactctggtccccagatcgaacagacaaattaagctgttagattagtcttgaaaattgtagatgacaaccatgacaaatctgtggagatatttcatgagttatttactaggacaaagtgtgctatatatcagcaataatgcaacctaagcttgatcagatcatctgatgagtggatttgtctgtctgcatttcctttcttgttttcgtttactcagtggaagctggaagctggtcaatgatagattattagtatgctagctgctgctgctatactatcagtactggcaaattacttacacctggtcaagaacagattcttagtacgctacctggaactatcagatttgagaataaaataacttctgaatttattaagcccatcatatgatcatatccagatgcagattttatgcactatttccagattggcaccaacaacatgctttaaagtatgtatcatgtcagacgtgattaggcatattaattatccagattttgtttccattcgtgacagatacacattggcaccattttcaccacaaatcttcatcagatatttcctggcacatgatccgatgatgagagtggagaggtatcaataaccacgcgttatcgtcagcataagcaaatcaatcaagtgttagattttcgcggcgaaattaaagtcacagatgtaatctgatggctatctaatcaccaactgttccttcaacaattgcgttgtgaccttgttaatatagcgttggaagattgcacaattaagctagtgacgacaaaaaagcttgggagatgcgtgcacgcgaccagcgagtggatctgtggatgtcaaacttttctgtcgtctaaaagtccccttttgcgtgattgtcaaacagtaaatcttctgttcttactttacccttttccttatttttctcaataacaacagagatgtacttgcacaggatatatcttaacggagtagggcatgttaggttactgtagtagacgttactcctatatgttaggatagagagaattgttaaatcttttctagtttcattgtggtttgtgccgcgctgcacacttgcaccggtgtgatcaacttgatttagatggaggctaactttgccacacaaatgtgactaacaattttttgaccataactatagtaaacattggttaaaaaataagagtatgaggtatagaccaatgtattaataaagtatggatttgctcaacaccatgccactcaaccaaatactagcataagaaaatgtggcaaacctaagatttagtgtggcgaactcgccaaccaaacaaccccaacattttccggtatctaaggaggatggactgagcttctactcactactagaattaatccctagaaccaaaaacccaagggaatggcgcaaaaactctagagtgaaccctagggaatgccctctagggaagcctagtcgatttggatagcaactagaacaaagagggattttgggggagattggagaacgaaacaacaacaaatttggggaggagaaacccttgtgctgttgtttaggggagttgggggggggggggggagaagatatttttgtctactatattgcccttcccgcaaaaaaaaatcgttgctgggagttttgcctccaaaattttatatgggatctactttggttgtcactgtggcgccaagaatttcactatagagcttatgtggtataagttctctaggttgcatattgttactctagagaacataaatcttccctttagttctccatagtcaccctagggattcttattatcccttgagttctaatttagactctagggaagttattgaattctagtagtgagtggcagattggtagctcggagattacagttcgcgatggacaaccaattcaataaacatgtttaggttgctttgagcagagaaatctaattagatttttttttacattttggcgtggtttatagaaaaccgaagcttttaaaaactaagttgatgagaatatggagaagctctagttccttgcgtcaatgaaagtataaccaccattttcacacttttccatatttaaaatattataaccactgaatcttagaatcacgacatctttttcagataatccaccaaattattacagtagattatttgctccacgtctttaaaactacgttttctgaaaaatatttcctccactataagctacttgtttgattatttattaggtttgtttatcaaagatatttattttttttctatattttagcagactagcaaaagtgcccgtgcgttgcaccgggtgattacagagtgtgtatattgaccaaaagtgttgtttggtttagcaaaagtgcccgtgcgttgcaccgggaagtttacagatcagaaaaatatgcaattaattaaaatacaaattcgctgaaatatttggtatttttaagtaggtatgtgtataattaaataaatttacaagtaaaattcttcattctccatggttaaataaaatgacatggttaaatttaattttattaaattctccataattagttacgctctttggaattttattggaattttcagagcttaattgctaattttattaatacaaacatcatttaacaattatttaattggaaaaagaaagaaaatacttttttataggtttgcttcgaaataaacatactcaatagaactataattgtaatgcttctgaaaaaatgagcactaaaaatgtacttattctctttttttcggctcgagggaccaacaatagacttatttccgacctatgccggtcggcccacggccttttgcgcatgagcgggcgcacttttcctcccccaggccgcaacctgggcttgggtcggaaaagaggcctcactctcgatccctcttgggccgatttcggcccggacgacaccggccgtccgatctctagggttttgatcggacggccgagcgtcaatagcggggaaacaaaacccactccctctcagccgcggaaccctagcccatttccctccctcccatctcacttcgccgccctctcctccgcgcccccgagcggcggcggcgacgacggcgcccctcccccaccaccgatggcggcggcggcggcacccccaccacccacggcagcgtcggcggcatcctcccccaccaccggtggcggatctagcgggaggggaggtgccccgcgagcggcggcgacggcgacggcgcccctcctcccgcgagcggcggcggcagcaccctcccccaccaccggcggcggatctagcgggtggggaggcgccccgcgagcggcggcgacggcgcccctcctccctcgagcggcggcggcggtggagtcctcccccaccaccgacggtggcggcggcgctctcccccaccaccggagagtgccctctgccgccgccgccggcggatctagcgggaggggaggcggcggcggcggtgctctcccctccaccggatccacagcgacagcgacggcggcggttcggcaacgacggcgacggcaacggcggcagcggcggcgacccccttcgatctaattttttgtttttatttggatatatgtgtgctggcggcgacccccttggatctaattttttgtttttttgcaaagtgctataaggctgcatgtgattctttgttatgtgctatgatttttttatatgtatgtaaatatgcacttgttctcctagtgatgctaaccgaataggacttggtataattcaaaccaagtcctattcgcccaaacagaaacaaagtcctaatcagctcaaacgaaaacagatgggagtttgtttcctatttttgtggaatcggacatattcttttaccgcgttgatgaatcggattcgttccggttttttttcacccggtttttttgacggacgatggaagcacctcttattttttaagtagtagtagagtagatataatccgtgtcaataaggggggtgtttggataaagggactaaactttggtacctgtcacatcggatatttggacactaatttagggtattaaacgtagactacttagaacactaattacataaataagagctaattcgtgtgataaattttttaagcctaattaatccataattagcacatgtttactgtagcatcacataggctaatcatggattaagtatgcttaataaattcgtctcgcgaattagtccaggattatgaaatatgttttatcaatagtctacgtttaatacttataattagtgttaaacatccgatgtgacgggtacttaaaaaaatttaaccccatccaaacattgcctaattcgagtgatgacttcactaacagtttgtcatcccaacagcacgaatctcaaagcaaagctggatatatatagcgcgcccatcacgcgcactcttccgccgaaccgagcaaacgcacaaaccaaaggcggaagctaagcaagcaagcagcagcagccgcagccatggaggcggagaaggagatgtcgatgagggagtggtgcgtcgcgctccccaaggtggagctccacgcccacctcaatggctccgtccgcgactccaccctcctgtcagtaccgccactccctctcctcccttcctcgctgccttcgcctgcctccctccccagtttttagatttcttgaatttgatagctagtcacttggttcttgatctgattctagaataggtcctcatggcagtatatttcttccaaattttagcccctatgcatcatttcatctgatccaagatcgtttggattaatggatttggtcgaacgattcttgatttctaggaggggagtttagcattttttttcttgagatggggaattcagcacttaaagacctaattgtgcacgcgaaattcgaactttggtaggagactaggagtgtgccattgtgaaatttgggttttgacaaagtgtatattcattcatacatggtcaggaagcatgaagaacaaatacagcagtctgcactctgcagacatcgggatcctggcactataaatttataatattggaagtgctcatgtgggacagaatctttgcctaccttttacatttttataatgctacttttgattaacataccacaaatgacttggcctccacgaaaatgacctcagttaggagttactggaagacaggcctgatagttacttcagtattactagtgtatgaatatggataattttgtttcccacttcagccaaaatattatacagttgtaaattttaactagctgtttaaacaactaataggtctgtattgttaccattaagtagtaccaaattgactaccttgattttaaaatgcaataagccaataactactttgtcttcaacaataaagaataccagacaaaacatatgtgattttttctgcagtagcattttgtttctatctttcaaaatgctaatgctttgttgtcttcttgaatagagaacttgcaaagcaactaggtgataaaggagacattgtattcgaagatgttaaggatgtaatcatgaagagtaagtggaagatttttatttttatttttttgttagtgttgttcagcagagttaccaagtctaagccatatcaaaagacattatgaactaagggtgtaaaagaacctctgaaatattaatcattaatcacatggttagaaaaaaaatgtctgatggatacctgtgttgcaattctttgtgagccataagtaattagggtgctcattaactctggcttctgaacatcttaaacagatggaagatctctccctgagtgtttccgactttttgaactgtatcatatacttacaactgatcatgatacagtgactaggatcaccaaggaggtattgtgatatttatagttttgtgatttgtatactgtacttgccggattcatcatcgagacaaaattggcaggttgtggaagattttgccatggagaatgtagtatatctggaaataagaacaacacctaaggtaatatttttatttgtctgttccgtattcctctggtacatttttttagtctctgtggaaatagtgtgatttattattttactttattttgtttcactgccatccagaataatgaagccaaagggatgaccaagaggtcttacatgaatgctgttattaaaggtcttaaaactgttgaagctgttgaagtcgtgttattcgattctaactcaagagcagataaaactcctatgagtgagctgggtggcgacacaaggaaaaagaagatatatgttaggcttcttctgagcattgaccgccgtgaaactactttggctgcattggatactgtatgttaagattttacaaactgtctaacattctaagcaaatttagcaatatgacagctaatgacaatatctataaatcgttcacctttgtttgtcaggttaatttagcaatggagatgaaggatcaaggtgtcattggcattgatctttctggcaatccagttgtgggggagtggtaaaatattctgtgcctgtgttgaactaagtggatacatcctacataatttttgtgctgacattcctgggatttttaaacatttatgaagggagacatacttgcctgccctggaacatgctaaagagcttggaatccccattacaattcactgtggcgaggtctgcaaatatattagaacaacttctgaaccactctctccttcttgatcattatttccctgcagaactagttgatcaatgaagtgaaaaacttggtgacaacaggtagcaaacaggaatgagatccgagcagtgctggacttctgcccacagaggctgggtcatgtctgctgcctcaacgacgaggaatggaagaagttgaagtcgttaatgattccagtgagcttttctctcattgtccctaaccaattccatgtcacactcacacacgcttaatccaaaactgaaattctgcaggtcgagatatgcttgacttccaatgttatgaccggtggtgcgccttcactggagcttcatcacttcggtttgtccctggcaatagtagtacttaaaaaaatcttgacaagaacttttaagttactgaatgttgacaagaatttttaagttactgaatgttgagaggattttaagtttctgaatcttgacaagaattgaagttactgaatgtttgacaagaatttaagttggcttcccagctgattaacatttttgagttactgaatatgtgcagccgatctgtacaacgcgaagcaccctctgtccctgtgcaccgatgattccggcctcttttcaacgagcctctcaaatgagtactacctcgttgcatctaccttcggtatgcgctctccttgaaaaaagatctgcaaatagtctgacaattgttgttgttgtgtgtgtgtacagtactctgaactctgaatgcaaaatccaaaatgtggcaggtctcagcaaggctgagctgtttcaactagctcaggacgcggtggagttcgtgttcgccggcgacgagttgaagaggtctctgagagagttgttcgagcgcgtcgggaaggagctgacgacgtagggtaatccaagatgcgttcctgtcgatcggcgtcggaacaaataaatgtatttattatccatgtggtctcgattgtgattttagattttccatcgtttctgcgtttatgttcccacgggcgtgtccagtttaagagtacaagcggccgacccgagaatccacctatatggtgggtttggataatgggaaataagggtgggattggaattagaaaataaatgaagggttaggattaaatggaagagggagaatgaatggttaggatttaaaatgggtgggaaatcatttccctttcccatttgccaaacactaccataatgtaacggaaataagtgggtaatctaaaaaaatggattacccatttattcgtactatgggtggattcgtgggccggcccttgcacccagtccagtcccttctcccgcttgcaaatcccggcgccggggatgcgagcacggtggagatctccggggagagtcgccaccgcgcgcctcgccggcgaggacagagaaaaggcgtgggccttcagttgggccggaatgggatgggattgcggccttcaagcggcctgttatgtatataggccggaacgggattgcagctacgtgcggcccgtttaagtcggccgggggagaatgaattcgaccggaaatgagtggaagttgacattgatttgaagtttgtatttgattgaattgaaacattgagctggaattttaaaactacacaaaacaaaggatggagtctttaaacgcttccgctactaatgtcgcacaaggcggtaatgatttttcagaagagtagcgcaagcaagttccttgaagaaactgtttgcaaaaatacaagtcttgtttcgatcaaaagcttcaggaactctatcgtagcaacctcataaggccacacctcagatctcatgtagttgttttgtacaaaaaaaaaaggtacgaactccaaaaccccgaaggcttgacacaaactagatgcaaatgctaagtcatgagaaaatttaaaaaattgtggacagtaagtaaggtgttcttgcatcagctactcctatttggaagatttaggttggttgtttactgctagtctacaaatattgccgagagagaacagctgtcaggtaataacagattttgattgccgcggcatcctgtccaggtgatcatttgtaccatccagtaatcatgtacctcagccaaaagcagaataggcatgacaacgcctgccagacatgaacacatggagttattattaccacagattgaaattcacacagcaagtataatttgtcaaaaaagcgatagtaacggacagcgatatgtttaagtagcatggggctactagagagaggattggatctccaagtaataaggatatcaatgtcaagatatctgaaaagtgattccatttgaaccaccattataccatataataacaaatgtggattagttaccgttatccaaaaaaaataaatttgtggtttaaggaaatctagtgaccacaaaaaagcagataggataaacggatggcttaattcaaagaacttattcctcatttaatgttgttatgcatagcacaaagttttagctgggattttgtttgcagatattccttgtgtactgacatttgcacgaaccctaggacaaggcttagccataaccataatggagtagatttgcaaataccaactactttattcatgataacttccacaatgaaacaaaatgaaatcagtagtttgtagtagtttatagcatcaatgcatttagattttacctgaaatatgagcagccttatgcaaagggtcctctctgtgcatcttccaaatatcctaaggaatatgtttaccaagttaccatctttggtacccgtcaacagtcctgtgtggggatcaaacctgtgggacgcaaacacattttacaatatttatcagaagttcaacccacacctcaataggttttctgaaaatatattctacataccttggcaacctgtgccttgggcagggaacaaacttaaacagctgtagcaaatagaagcacaaattaaagtgtaagcagaccaaatgcctaattaactaaagaagatattgtatcaattgagaggaaaataaaaaaaatgaaatggattcttccatacctgtgggactgagcacagaaagttaagaacctcaggtaaaaagaagagcaataatgtctcgctgcaagtagagaagagttattgatcagctgcagttgctaatcagtattgggtaaagcaaactgtatgcacaacgagcacatgctagaaacatcagacagatgcacatagaaagtattgatggcacaagagaagcctacacagttacgcttccaggatatataattgtatggatggtacacaggaagttcaacaggcaacatacttaacatttcaaaactagatattaaatccaaccaacactctgtgggctgtactagaccaagaggaccatcccaaaagatcaccatttacatgctttacattatatgtggcagaagaggtaagagaacggtgagaaagtgcaaggaggaaagacttaaatgtgcatgaagctagaacaaagattcttgactgtacttcactacagaatgcaggctgttaattgcatatccttccatatcacaaacaaccactccagatgaagctcgctaagtgcttcttgttttctttattgatagataataacggaacatgttttttagactaaaggtcagagacccggcttttaatcgaaagccacataggcagagtcttacaactggggataccagcgaaacagaggagcataacatagtttaaacacaaaactcaggacacaactcagcacgctaattcaggcagacaaagcaaaagcatcattacacaggacagattaagtcacaaccaaaggataataacggaacatgtaagggataactgaggacgtttacctgaaatgacccaaaattcccaccacagccaatgccattccagaaaaataggtgtaggtatcaccaacgaaaacagatgaaggatacctgatacacacacatacaaagtcattctttctgaaacaaagcaaaagaacttttttctttaaataaatgtgcatgcttcccatggtccttaccagttaaatgcgagcaaagctaatgaagtggtcaagaaaggcaggacaagataaatcgagaatgcatgggcttgttgcgcttcaatgtccgtagaagatcctatgcgcattacattatgtatcaaaacctaaaaaatgttatacaacatcagtagacaaatagaatttgggttacaaaattctcatcgacagatattttgttcataccgcagcagatataataactgtctgcccaacttcaagaccattcaggccagcatgtatattgatcgaatttgtacaaaagactgctaataggagcataaagagcttgtacagagaacctgcatatggaagacaatgtcaggtcagtgcattgtatagctatttgctagcaataatagaatgaaggttcatccatagagttaggttgaaacttgcataaagaaagcaaataagcaaaatgaagaagtatatcacagatgcactggctcaaaaatcccttctttcattcattttatcttcaacagatttaggtcacttgtggaagaagcatttaaagtggttcactggaatgagtactgatggtagattatcatctagcacgttagcagtcagcattcacatatgaagcaaaaaaaaatagttgccaacaaggattaatagtgctattacaaaaacgtaggatcaatactataagatccccctgtactaatttgcaagcctcctacgacctacaggattaagtgatatacgagatcataaattgatgaagctaagttcctatgaagtaaaccatcacacaagttgaccagagtccatgttaggcccaatgtttcaccaagtccccctgtccaacagaagtctttatttaaaagtttataagcccactgcctaaagcatctaggccccggtgttaattttggtaattaatgacaagcgctaattgtggactaaccgttgtctttgagctatacattttaagtcaggtccacgtcatatgtgcgcatggatgattatcgatggattaaaattgacggcgcaaagcaaagagaaagaagacggtaaaactagtgctttaatttagaattgatcgaggtgtagggcgatcaaaattgctagtttattttctagtttcgccgtactattaagaggggtaatgacctagcaaagagatgattgaattgccacattaggtcattgcattttcatttgtgctctctttttcatcacacacacattcacttgcaaattcactgggttcggcctgaccagggggcggtcagaccggccacatagtggcggtctgaccggcgtgccctggctggtctgatcagcccccaagcgggcggtctgaccggcgcataaggccggtctgaccggcggcacttgcctggtcagaccggccccctggaggccgagatgatgttgctcgggatggccgatacagagccgacggagccgtagtcgatcagaccgagccgaggccggtctgaccgcccactcaactccggtctgaccggccaggccgatggggccctctgacagcacttcaacggctagttttctagccgttgcagagtagcacggtctgaccagccacatacctccggtcagaccggcagagcacaaagttgggggatttcgcccccaacggctagttttggtgggtgggagtataaatactcccccaccagtagcaaggggactctcttggcacccaattcaattgcatacatcccttgcacctctctcacacccacttgagctttgtgttcatccatctagtgtgttagagggttgattagccaagagtcaagtgcattgcttccatttgtagagctagtgtggcacttgattgatcatctccacgccgggtcattgcttgttactcttggaggttgccgcctcctagacggcttgtggatgagttgcccggtgacctctccgagaagattgtggaggaggcccggcgccggtttgtgagtggtttggagttcaccaccttcggagtgaaagaagaactaccctagtgatcgaggcttgggtagtcctctccgtgggccggctcccgccttgcccaccccttgacgaagggggcgtgcggtggcttcatggttgagcggtggagttggactcgcctcaacggggagtaggaaaccggcgagtttccgaacctcggtgaaaaatctcttgtctccttgtctcatttgattgtcgcatttacatttgtgcaaatttacttttctagaaacaaactagagatcatatcaccctaagattactaaacattgacataggagtgtgatttactttcctagatatatagttgagccacaatcaccctaggtttgcaaaacataacttagttgcttagttagagttgaccctcaccaagcctagcaacttaggttagttttgattaggtgtcatttagttttaaatcgcctattcaccccccccttctagtcgacatctcgatcctacactgccactgacctgagggacatgcctacttatcagttacacggataaatttatttggaccaagaaataacattgagggcttatttagaacattgggtgactggaaaagctaaattcttacagaggaccttggtgaaaggaaaaagtgaaatagctccagcagaccatacttactgattgttccataaattctcataaaaaataatagccagtactgtggtactttcatgtcactgataatcacaattctaaatgatataggtcgtaattaagagatagtgtctagtaactgcatcagtgcatacaaaaaagttagtgaaatttgatgaaatttcaccaattactttaagtaaggaaagtatcaattctcccaccttccaacaaagatcatcagtgctgcaaccagaattaaaatattgcgcaactaatgaatattcatcatcacaacgttagcttattttggacttatcaacatacctagctccagaacagctactccaacataagatgttagaggctttggaatgctgacggaagtaccaccagcatatgccatcagcaaaggaagtgctgcaattgtgggtagtagaagtttcctgttgaacacagaccattccaaaataatgttattatcataaaagggaagataatagtacatcatcggagtaaactggaaggcattatgaaaaacaacatacactctccatggaacatcaagaacatcatcaataaatccaagaagcaccataaagcagactgatgctagtgccgcgttgtattcaacaagccactgcaacaaggaagtcaaaaacagtaattgtaacacatgtttcaggtcacaaagcaacgtttatgaatgccaattatagtaacttctagtcaacataccatagagtctgctgtgaagttgaaatgttgaaatagaatagcaatgaccaagtagacaatcccaacaacaatgccaagtgcctcaggcctgcaaagcaagtaaaatgcttagacaagcaagaatgaaaactatttgatttgtacctccagtgagtcctgctaaactcttaaatatttcgaacaaatagcacataatgggtatttttcatatcttaaaatattctcttacatgctcagtaaaactctagaggtatgctgataatttcctaaaatcctactcctatacttcatgagcaggttaagagtgtctccaactgaatttttaaaaaccttgaagcatatgtatgcactagcatgcattagtaacatggcccaaaggaggtagtcacaactcataaccttccttaaaacaacttttgtgtccttgttttgagtgacacgtatttccgagaatcaagaacttttgccaagaagaaaaaaaaaaagagaaggaactgttggatgaaatttgagtgattgatgaactccaatgtatcagttcagtttacactaaacaagtagttagacaaaaacggtatggtgcatcaactctacctctacgtgtcggcatgcaagacaaaggaaatgcttaacatcccatagaaatgtaaccctatgatgggcccagaagaaaaggaaaattagttagaacacacaaaatctgaactatgttattcttcagtacatcggtgaaacactgaaactagacaacacaatttaagagtttacaactaagatagatctttttttaatagaacaacttactctgcaacccaaatgtgattatcttcccaaagtgcactaaatactgctggcgtgtttcaaattcccaaagcacactaagtcatgctaacactttccagagaccatacctacccaattactagctcccaatcctacaagacaaatttgagtgaacctgataaactattacacgtacggagcatgcatgatgtgtcaggttccacaatcaacatttgtaatgcgaatgtagaatgtaagacaggtcagctaccgcaacaacaattaccaacatacagacgcatcacttgaggaaattcctacttgagctgtcatgcaaaacagtcaggtaggactgaacaaatcaaggtattgtagtagcgtgccctctaattatggcgtataccccaaatgcactgaccccaactgagctaaatcacaactagtatcagtaaccgctacgagctacagtaaccatctgcgtaacaaagatcccaaagtcaaaatcctcgcccctgatgcttccaatagcagatcctcaacaatgacacctaaattctgatgctaaacgctcaaatctggttaaatctaatcctagggaaatcgcatttgcaaacactgcagttaaagccatctttcagaaatgcaatcggtgactaacactctgatctcgcccatgggcaagccgcgcttgttgatgtccttcccccacatcccgcgacggaggaggtagcgtgcggcgacggggacgaggcggagcacgacgacgaagccgccgaagctcatggccccgcagatgaggatggatcgccgcagcgccgcgtccagcgggtagtgcacgaacgcaaggtacgagaagggcgcgaggaaggccaccatcgccgcggcgaccacgcgcaggttcggcgcccggagcaccagctcagcatccgcggcctccgccgccgccaccgcagcagccggcctcgcccgcggctgcgcatcagcgggtgccgccgccgccgccgccgccgtcgccgcgggcctgcggcgggcgtccatgggagactaggaggggagtgctagggtttcggcagagcttctccggcgagtcggctggtgcggcggcggtggcgggggtttggtcgccggcgaggggggccgggccgtcgaggaggtcggggaaaatttatagccgcggccgtgttgtgacgtggcaggctcccattggctggagtcacgtgttcggcggccactggaatggctagcgaagcatgaggaatcttgcgtggaatcgaagtgatcagagaacgagatctggaccgtccagatgttatctaacggtgtaaatcttcctcagttgaaactgcccttggcctgcattggcattggcattgatactgtgctgaggtgatctgagccttagatttaagatccgatggttgtagggactgcagaaacataaccgagtggttgacaaggggtttgatatatttgataagcccttgagaaataaacaaaagtaaccaaaaaatatttttagttaaaactttttatctctattcttagagttttataaactcagagtgtgtttgataaatgggatatgagagatgggactgggaaagggaaatggatgaatggctaggattaaataaagtgtgaataatagatggttaagatgctatgttgctctttggagggtgggatattatttttcaatcccatttgccaaacaaaacctcaaggttaaaaaacaagcttaaataaacatccaattttaaataaaactttgaaaattaattttggttcttatggactcctaatttaactattatactttttcacaaggtttatagcagatttatgttggcctcctatgataagcatgcgtaaaagatttggaatgcacgtttttattggatacataactagttacaaacaaaatcacaatcccacagaagaagcaagtggt

SEQ ID NO: 67227 - DNA, 2064 bp, Oryza sativa
gcaccggcattcttcaacccaaaagtcatgacaacccactcaaacaaaccaacatatcccgggcacctaaaagccgtcttgtacatatcctcttccgccataaagatttgattgtagccgacattatcatctaaaaagctaatcaccttatgacccgaggcatcattaatcatcatgtcggctataggcataggatattcatctttgggagtggctttatttaaatctctaaaatctatgcaaactctaatcttaccacttcccttcttctccaccgggactatgctagatacacactccgcataacgacatggcctaataaaccctaccttcaataaccgatcaatctcctctttgactcggtcatatagcaaaggattaaaacgacgaggtggttgcttataaggcctaaaacccggtttaattggaagccgatgctcaacaagctcacggctaagacctggcatctcatggtactcccatgcaaagtaatcaacatattctttaagtagctcgattactttaaccttgtaatcggctctcatatttttgtttacaaaagtcggcctcggtttagttccatcacctatgtctacttcttccaaaggatcggccgatgtaaacccttttccaagcttctctacttcttcaaaatcctcaacggtttcaccaatatcgttctttgtagaccgatattcttgcaccctcttttgtaaccactctaaattagcctctttactcattatacaaatttatgtggcttagccgtgctacactagccggctttacagagataggtacaaatttgccatcggagatactaataaaatcataactagaaagatctctccccgaaaagcattggatattcccatgacgccactcaaaagtaacatcggccattgcaacttcggccgatgtatccgcttgaacaatctcaacatcatcgccgtcccattgaattaaacattgatgcaaggtagaagacacacaaaaattggcatggatccaacaacgacccaaaataacattgtagttaccttgcacatcgacgatgaagaaagcagttggtagcgtcttgtttcccacggtgagctccgccgaaaagatacccctcgcctccgttggttcaccattgaagccattgagaatcatgttggtcttttttaactcatcatcctcacgccccaacttcttgaataacgaatacggcatcaagttccggcttcccatctacatggcctttgagataaagaggcttcatgtgacagtttgattcatcgggcttctcaaaaactgcatctttaggacctaattagaattgagcaacctcggcttcatccatagcacaaaactccataggcaacatacataccatgttgatatccatgtcttcttttggagataattcacttttatcaactgattgttcttccttctcctctacatcaatcggttttgccttctctatggatttaggcctccataccggtggtggtcgcaactcattgaaccttttatccctatgttcttcggcctttttctcccttagctcttgggcccgaagacgttgcaaccttctcttttgtgtagccgtcaaatccttaggcatctacctaggattcggctctgttccaggaggtagataatgtcctttattaactttgcttgaagacgatgaagccctcacattgccctttgcaatcctctcatcaaaccggcgctggagcccagtcagactggccatagaccaccggtcagaccggccagacgcgccggtcagaccgacgtgtggcacgcggttagaccggcctgaggcgtcggtcggatcactgtcgggtcgacggtcagaccggcctaatggcccggtcataccggcaacatggccgcggtcagaccggctagagggcctggtcagaccggccgactgcgaagagctggtaccggcttcggattttttgcttggggactttccaactccatctccagaaggtataggcacatcatggaaccccactttgatagtaattacttccgaagccctttcctccaccttgacgcgct

SEQ ID NO: 67228 - DNA, 5438 bp, Oryza sativa
ctcaccaccttgcctcttatatttctccaagagcatagtaaaaatcaccttggtcttcctaggggccttagaagttgaagctccacttttgttctccttccaaacgccaacctccggcttctttggcactatcatcttaggcctcggctcaccaatgaccacttccttttccttagtagattcgacttgcttcggccgaatcaacacctttttatcattgaaactaattgtattcaccggaaaaggatcatcatcaagcttcatcttggagccttggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatctaatttgtttctcttgcaaaagataatcaaaaatcttatcacacttggccacatcaaaactatatttaacctcactttggcgatctttgcgaggagtcggcattaagttagaacaaacaaaaggcttatttttattagtccatgaccattcggcaacataaatatcatgatcaccctcctcctcactatcactagcctcagggtaatcaactacattaacattaggctttttgtcaaatggtctagctaattttttattatccttaacccggctttcttgagccagagccctttgcatgagttgactaacatcaataaattgttggccttctagtctctctctaagaggaacaactaaaccattaaaagcaagaccggccaaatatctatcagttatattcaaagtataacattggtttctaacatctctaaatctcttaatataatcaatgacagattcattatacttttgcttaaccgatgttaaatcacataacctaagctcagtttctccagtatagaaataatcatgaaattgttcttctaattgagcccaagtatgaatagaatttgccagtaaagaagtaaaccatgtgaaagcattaccggataaagatagagaaaacaaacgcaatttaaaagtatcactattagcctcaccacattgcgccataaattgacctacatgctcccatgtggtcttaccatcctcaccactaaacttggcaaattcgggaactctataatttcgaggaaacgacacattatcataataatcaggatatggctttttgtaagttctagcacgattcctagtttcaatccagaatctattcctcataatatcactaatcatatcctccatgttattaggcccttgttgatttggcggtgggtttggtggcctaataggttgtgtttgtggcgcaatatgattatattggccttgtctagtatcgggaggatatcccctagaaacattattataagtattaggaacatgtgggggaacttggggattacttgtggcagtagatacagaaggatcaaatgttttaaagtgatacaaataactagcattagtcatcggatctattccctatatcataatatgcggtcggaccggcctgagagctggtctgaccgccggggtaatacttggtccgaccggccatttggccggtcagaccgatggctgtgtcgcggtctgaccagccaccaggcccggtcggaccggccgtgaacgccgttctgtcggttttactacccgtttgatctataggaggttgattagcagtggtataggctttatgctttaatgtgtaatcatccataaaagaaccaagcctactccttaaaaacccatcaactttatccttaaacattacatctaatcgatctttaaaattagccatagatgaatctattgtagatgcaatttgttgttggatagattgtgatacctcgtcattacttaccacgtcgggagcgagcttgggacgtggcccgggcttgatgatcacgccttgacgagtcctagtagttgctctcatcaacgcctcccgtgtgagctcgttgatgtactcctccatagctttacgatcttctccttcgaagtcatccgatgtgaccggcatcacattagatggctccacctccgtcttggatggcggcttcgtcatggcgaagtcgaagttgagttgacgatgaacggatctcctccccagcggagtagccaaaaatcgtgttggcaactttttgtgacaagttggcaagcacgatcgcagcaccttatgccttgcggtgatcctagagtcgccaaccacttagatgggttttgataactaaaccggctagcggagccgatttctagataactacccgtctcgtgggcaaaacggaaggttttcaggacaaacctacaaagaggtgttgcactctcgcagcggcggcgggcggtttacggcgcaaaccgacaaagatggacaaactaagagaaaactaaaagcaatatgaaaaacgattcgattgattgatagtagattggtcttttacaatgaaccggccatgtcccttatataggggttggtcttgccctctacaggccctcctccacgtccaactcgggatagaagccaaaggaaacccgaaacatgccttcccgagcaaggaaacctcgagacccgacgaaacagaatcggactcggtcctgccagttagaccggccacacaccgccggtctgaccggccctcaaccggcggtctgaccgcccaacacacagcggtcagaccggcccactcggaggaaaccggtagacttccaaattttggcaatctttcctattttaatcctaggtgccaaatttgggtgtaaacactatgtatgttagaagtataggaatagattatctttctctgttcttcccaattagcttagataatatattatgagaatgagtagttaatgcttgtgtgtcactctacccttggattatttttaacccctgcttagaatatgattatcacaagtaatatataaattattagtcaagttctctctacatgatcttcccacgggataaaataaatacgatacccttggaatactctcgggtgaaatgctacaatggtatatccgtgcacttgcggatgaactctgtaaccataatataccagaagtatttatgcgtcattgctgggaattatatttctagtaatgtcgttaagaaataccaacaaacatttctggcgccgttgccagggaagattcataatagagattacttgaactaatactttatatttatctctgtataatcattttcctttgcaggctaaccttggttgttttcactttttgttgtgaaaacagggtagtgcatgactggtttcaacttgccggaaaacttcaaagaaaatccagaagctttcttctggagcgtcaggccgcgagtcgttggtccgcagaaaactctaccgacaaagaaaccagccataccagcgccaccgaccttcaagactatggctaacaagactctccgcgagttcgctgctccctctgctgacaatgtggccattgggctgcagatcaacatggtaggtgtggatttcgacttgaagtccagcctcatcacgatggcgcaggcttagcccattctgtggcaagcctaatgaggatgccaatgctcatctgttacaattcttggagatctgtagcacgtacaccatcaagggcgtcagtcccgacaccgccaggctgcggctgtttccgttctcccttcttgggagagcgaagcagtggttctatgccaaccgtgttgctgtcaatacctgggacaaatgctctatggcattcctctcgaaattcttcccgatgggcaaaaccaatgcccttcgtggaaggatttcaagtttccagcagacaaggaatgagtctattccggaagcatgggaatgtatgtaggagtatgtggccgcctgtcctcatcatgggatggacaactggctgatcctgtagaacttttataatggactcaccccgatgtcccgcgatcacctggacgcggcagctggaggagctttcttctctaaaatggttcaaggagccgttgatttagtagagaagatggtctccaatatgggttggagcgaggaacaactccagacctgtcagcgaggcatgcacaccgtcaaagagacggaattacttgctgccaagctggacctcctcatgaaacgattggacaaccacgagaaaaggccacaaggcaccgtcaaggccttggactcacacgttacgtgtgaggtctgcagcagcacgggtcactctgggaatgactgcccggaaacccgtgaggaggcgatgtacatgggcaacaacaattggtaccgtccacaaggaggtcaggggtggagccaactacgcccatattatcaaggaggtaacaacaacggtaacttttctaaccagccctccttgaaggatctagttttttcgcaggctaaaaccactgatgcgctaagcaaaaagcttgcaaccaatgacaagatcctagaaaacaataatgtcaagttagatggctttgcttctgcttttcaaaatcagctgagctttaactaaatgataaaaacccagctagctcagttagcatccttagtccctgtaaatgaaactgggaggattccggggcaacccgactcctccattgaaaatgttaaggcgatcacgatgaggggaggtaagtccactcgtgatccgccgtatcctaaccctgcaggaactaacgagattgcaaaaaaagcgtcatctagtgactcggctgacaaggaagatcagccagaaaagaccgtgccgcaggagtactgtgacacatggttgctgttgtttcctcaacggatgaggaaaccattagtggacgagcaattcgctcgttttgttgaagtaatccagaagatccacattaacgtgccgttgttggacgctatgcaaatgccaacatacgcccgttatctcaaaggcatactcaacaacaagagaccgctcccaacaacggaggtggtcaagctgacggagcaatggagcaacgtgatactccacaagctcccggagaagaagaaagatccggggtgtccgacgatcacctgctcgatcggggcacaacagttcgaccaggccttgtgcgaccttggagccagtgtcagcgtcatgccaaaaaacgtcttcgacaagctcaacttcacgatgttggcaccaacaccgatgcaccttcaactggctgattcgtgagtccgttacccggcagggataacggaggatgtgccagtcaagatacgagattttttcatcccggttgactttgtggtgctggacatggacacgggaaaagagaccccgctcatcctagggcgcctgttccttagcaccgcaggagccaacattgacgtgggagcggggagtattgttggtatttcttacgaccacagataaatccgcaagcgcatggaatac

SEQ ID NO: 67229 - DNA, 28633 bp, Oryza sativa
ataaaagcgagagggagagggattccttaatggataagaataaccgatgacacggcattgtttcgatcgctcccaggtttggttccatgcactggcgcggcatgattgcctagatgatagggttccaggagagggttcattagctggggagggaacaccctaatatccagcggtctcggttatgtgcgacggcatggcgacacgatggtgactcgattggcggcgatgtgcagtggtagcggccttgataggggaggcgcagggctatgccctagggtgacgcgcggtcgtcgtggcgaccgttatccctcaatcccgaaggcgacgcgcgaggggacgggatgacgcgggctctcgtggcggcgcagctttggcgcgggtcttcggcgcctcggtcggcggcgggcccacgcggcgtggcgtgacgcggtgcggcgcacgggcacgaccagtgcggcgcacgagtcggaaaggcagccgcgcggcacggcagtgattggagagggcggcgtcgggtgttcggtcgggttaggcacagatcgaacacctagcgcgtaatgaacagtagcaacccgggaaaaatcacaattagggcttttcctagactttttgtgtgaataagttttagatgttttaatctccttatttcttttagatacttacctatatttcaacacttccaatcttgtgatttattgcaccatatattaataattattttttctaattccaacatatgtttctattttccccatatttaaggttttagtatttgtcttgtcataccaatatatttgtcttctcacattatttaatttaaacaatacattttgcaacagagaaacgaataacaccagcatgatgcaaaagtttttaaaagttcgaaattttagtgatttttattgtcaggaattttcaggatgttacaagaacagagtatgcatcggctgcgaaggcatcggctggagtctgcataggctgagaaggatcggacagaggacagctgacacagctgatagaggtggtgcagccgattgcgatgaagatggtttcagggctgtttcagggattgatcaaagtgcttcacggggattgccacgatggagataaagctctcagataggcaattgtatttattaattaggatatttcatgtaaattccttagagatatgtttgggcaaaagtctgccacgaagacttatggtatcgtagagtttgttagagataagtgtcgtgtccggcaaggacgtatcttgtatctcgggtataaatagagcccgaacccatgtaatcaattaacaacagtttaatacaatctcggcgcatcgccacccttttactttcattttgtttcgacgagttcttgctttcgggttgagctgcatcgattcgatcttcaactagaggtaaaacttgttatggcggcttgcgttctcgggattaatgcttccatctttatgacactttaatactgtttatgtaattcgtcgagttatcatatgcatgttgcaatctctgttagttgcgctatataacttgttatcggctgattcttattgttaggaagtgaccgatagagttatgttttgttattaatttagattgtatcgtgtatctaccatctcttataggttttcatcatcttgcctagatcttatacttgtctttatgcttaatgctgcatcggttgagttcgatctattaagtaatatctataattatgatatctggcttgttttatgatcatcgagagagatagtatcggggtttcagccgatcttacctgatttagctttatatcttatatgcttaattgatatgctagatctgccctttatattaagatcttatcgcaataaagtatattaggcttctgtttgatatattctatctgttttaatatcttaatatagagtggtatcggagtattagccgatacatgctagatctatttgatcggctatgctatatgcgtttataatcttcatgttaatatatactttgatctaagtgatttatattgtctcggcatggcgaccgatctatcccaatcacttgatttaaatatatatcgacagaaagattatatatcgttaatatctatagctgatcgagtagatttagtcttatcttgcttatttataactgccgatcgattcacatatgacatcggctcgaaaataaatgatatgtcatcaacgactggccgatcggctatcgtttatggatttaactgcggtttttctcatctttgtttcttgttgattgcaggatcaaatcaactggcaggctcacgaacctaaaagtaagattttggacccgcactgaagttaagcagatcttccaggctagtgtgtttttcgcatcaatagaactcaaatttgaaaagtttcatctgaagattttatgaaaatttcacctgatatttgaaatctttcaaaagtcaaaatttaaaaactttcaactcgtgtttgaaatctttcaaagtgaatgttagaaactttcaactcaagattttttggaactttcgactgagattttaatattgtcaagtccaaatctaaatactttcaacttgtaaaatataaaactttcaactaacgatttgaaactatgaattccaatttgaaaactttcatagaaatatttttttgaaaatttcaaaacatacaaattgattttgaaaactttcaactcgtatttgaaaacttttaaagttaatatgtgaaacttgaaactcaagattctttttttgaaaagtttgaagttaaatttgaaaagtttcaaaagtcaaaatttgaaaactttcaactcgggtttgaaaactttcaaagtgaatatttgaaactttcaactgaagattttttgaaactttcaactgagatttgaaaattgtcaagtccaattctaaaacactttcaacttgtgaatagaaaactttcaactaatgatttgaaacaataaactaaaatgtgaaaacttttcatcggaacattttttgaaaatttcaactgatatttaaaaactgttaactcaaattagaaaactttcatctcggatttgaaaactttcaaaagtcaatatgtgaaatttgcaactcaagattatttatttcaaaaatttgaacttagatttgaaaactttcaacttgggattgaaatctttcaaatttaatgtttgaaactttcaactcaagattttttgaagtttcaacatatatgtgaaaattgtcaagcccaaatctaaaatactttcaactcggaaaatataaaactttcaactaatgatttgaaactatgaactcaaaaatctttcatctgaagatttttttgaaaatttcaactgatatttgaatactttcaaagttaatatgtgaaacttgaaacttaagatttttttttgaaaaatttgaaatgagatttgaaaactttcgaaagtcaaaatttaaaatttttctacatgggtttgaaatctttcaaagtgaatgtttgaaactttcaactcaagattttttgaaactttgactgagattttaatattgtcaagtccaaatctaaatactttcaacttggaaaatagaaaactttaaactaatgatttgaaactatgaactcaaatttgaaaactttcattgaaagattttttgaaaatttcaattgatattttaaaactttcaactcgaatgtaaaaactttcaagttggatttgaaaactatcaaagtctatatgtgaaacttgcaactcaagattttttttttcaagaatttgaactcagttttgaaaactttcaaatgtaaacaaattaaaaacttttgaatcaagattttttttgaaacttccggcatagattttaaaattgtcaagtccaaatctaaaatactttcgactcgaaaaatagaaaactttcaacaaatgatttaaaacaacgcgcacgagttaagatgttgtgtgaataatgcacacaagatattatctactcaagctgcttccctcggatccaaaaaaatcggtgaaaatagggggtgggtggttggttatggtggtggaggcctggaggtgtgcaattggctccacagatatatttgaagatgatttctcaatgagtaaaacttttactacgcctgttacgcaagaaaaaaagttccgggagggagggggtggggcgggggagggtgtcacaccctgaaaatcgctaaattataaatcgttgtgaaaaaggaatttttagaaattatttaatgattaaagtaagtgtgtgaataaaatctatgaaaaatttgaacataaacttgagctagataaaattttattaaatactttgtgtgcccaagtattttcaggatttttcttggatttatttgagcaatggaagtatttttaataaatgaaacatcatttcagtaattatttaaattaaaaagttaattaaattccctctcttgtcttgggctgaatccgacccactcctttctctcccctctcgaccgaagtctactttagctccctcctctttctttctcactgacgcatggggcccactcggctacagtgccgccatcttcctccggccgcctccatcccgagccgtgcgtgtgcagcgccgctcccgcaccgaatccgccgctgcattgctcccgttccaaaattagttgcgggaacatattcccctcgatctcctctatcttatcacaagaaacccccttgaatcccgttgtaaattgcgtggattcgacgcgctttcgagctccgttttttcgtcgaacccaaactaatccgtcgccgattccatccgtttccgagccgatctctccctcttccagctataaatagcagcccctcggcatcctcttccgttttcccctttttcccgaagttttccctaaccctagccgcctccccgcgagctccccctctctctccacagccgccaccatctccagccgcacctccttgtcgaccccgtggtcgccggacctcgctgcagtctctgccggcatcgcagcaccaagccgaagcccgttcaccccttcgccgccactgcaaatcactagggctacgtgtcgctgtcaacccgaggcaatcttccgtcgctgctgtcgacgggggatacccatagaccggatatagagggtattggggtacgctggtatgaggatctacgtaatacgacatcaagcaaatagaagataaggattatactggttcaggccccttgataggtaatagccctaatccagttggtatgggattatatggtagaaaccacagattacaaagggaatagcagaactcgatgataccgacgagaccgtagtcgagttggttcgactagatcacccggcaacttggctcctgttggcttcgatttcgtaggctgtggtggttgtattggcggtgagattcgatgccttaggccctcccggggggtcccttttataccgcgggtcagttgatctccaagtagaacttggagatatcggaccccacgcgatacagtaacgacccagttctgtccgagtaggactccttccatccgtggactctgtttctgttacgtgatggatttccttaacgtgtacgcaacatccgtatacgcgcaggtataccgtatcaatatacaacatacatccaagggtagagggtatacctctgtaaccctgaaagtagcccccgacttctgcttaaatgaactcatgtgaccgatcgcgacttctgatctcggaatcattatcgctctcaactggtcgatcttggtatgagaaccgtagagacgtagagttatcgataacattgcatgaagttcaacggtcatgagtgaatttaaattgaagtccaaaaactgctgcgggtaacggacccagaaacttctggcggccatctctctcctttccttggaattcgcaccatcggtagtgcgcttatttacgggagttttggggatccattttgaagtccgtttgctgcaaaactttccggccttcaaacgcccctcgtcttctccgcttccgtagaaaagccctagctttcccatcttgtcctgttctccggcgatcttccggcagtgatggacctcgacaaatccacatccaccaatgcgtccctgaagaagctgcaggacgacggtgccctccctggtcgtgggaccatgcagagggaaacaggaggtactgaccccaaacctgtcctaggccacatggttgcggttgaggattacattctttgcggttttcttcctccgccttctgagtttcttcttcttgtcttgaatttctacggcctttccttgcttcatctgaaccccaattctatcgcatttcttagcattttttcctatctttgtgggccctacattggggtagagccatttcttgatctcttttacttctactatgagttgcgctggatggaacctaaaaaggtatctggatgtgtcggtttctaacttcaggatggcctgaagtcgtgatacatccccttccagtgcccttcttctcgtagaaaatggcgagcgatgtggttctatcttcagatagaaaattcggatccagtctttgttgtccatgaggaacaaccagacaagattccggaatggaccgccaaacccgccctaactccctcccttaagtctttcatcgatatcatcgatgacctccgagtacgagagttgtcggggtatgaagttgctgtcaacttcatcggtaggcagatccagccgctccaggctcgagcccacccagcctttgactattctgggccggaggacgcgacccgggtttcttctcggggtatttttcttgtatttcagatttcattttttatgtgcatgttcctgctgacttatcgagttctggttctcgatcctacaggtttgaacagcaaaaccgtggagcgccgcgtcagtcagcggccctacgacggtgagcaacgtccccgttcccctttgcaagaaggggacgaccgagtgcgaagctgcaatcaacatgagtgtactcgatggctcctttacttcttctttccttggatcgcattgtgccttcatgtacgcaagctctccctctgatagacgtcatcgggccgctcgcggatcacaaggcggaggcgtcgttaaaggagggcgttgccaaggaggcgtccgatattgctgttgctgctgccacgatgaatggcaacaacgttccgaagaaagggaggaagttctcctctgtacttggaaactgttggaaagtgcctactccgtcggtaagcctctcttgtttcttaatcatgtagtcagaatactttgacctcatatcgtgctatcttgttcaggcctcggatgcgtctcccccgcctctgcgaaggcaaaggctggtgacgcttggcgagaagtaggtagacgttttagaagtcatcctattcgcaaactcttgcttgcctgtcttcatgaaattgcagaaatccttcgcagggcggcgtgggtgaaggcggcgcaagacgggtccggtgcgacctccagcgtgtctcctgtggcggcctcgacggatgtcgtggtcacaactagggaccgggaggcgacgccgagtggacccgctggcggtcttgtgcccgctcggggcccgcccattgatgccctcacctagggggagctccaagctgagatggagcgcatcctctaggctggtgctcgcggcgtgggctacgagatcgaggaagccagggcggtgacgttgtcggcaacccaacgcgccagcaactggcgcgcgatctgtcggagacccgcgaggacctcctcaagatgagggagttggtggccggcaacgaaaggcagcggcaggggctcgaacaccggatgtcggagctcgagaacaacctgtcagagatccgtggcttgctgcgggtgtcttacaccggcctacaccaactcgccggggagtgcggcgtcacgaccaccatcccggcaacccccaacgagttctcgctgacgtcctcgctcgcggagctcgctgcggcgatggaggagatcccctccaagcatgcggccaggatcggcaaggagacgtcaaataggatttacaccggggcgtgccacgtcctcgcttgcgtgaagctggcataccctgaactcgacctctagaggattctggatcagggggccgccaatgacgcgcgcaagggcgtgatgaaagaagtcggtgacttgggggagtccattctccccctttttgaagagtagggttgtatttcccttgtactccttaatcaattatgcttgtaaaactttcgtcggttcaaactgcctttgtgtatgcagttgtttccttcgttttctttagcatgttgattccgagtactttgctgtcattgtagagatgttgatatcgaggatgtccagcagcgtgggcagcctgagtcgccggtagtcgttccggcacttgcgcttgagccgtacgtgccgcgggacgatgtcgatcaaagcctgtctgtgaaggcggacgtggcgacgacttccttaggttggtactttggttttcatctcctttattcttttgttcggatcgacttaatttgctgtgttctcgaaagaggagaacgacctgacttagtcatttccgtattgagcagacctcgagagtacgttggccgaccgagatcgtcgaatccaatattggaggacgaagttcgaggtggccgaactcgagaggactatggtggaagtgaagaaggaccaagccgtggaagcactccgaggtcgcgaggtgtggttcaactcgtacctcaggagttgttatacagcgatggctggagtctgtagagagctccaagtaccccgcgggaatctcgaggagtcagcggctgggtatatctcgtggttgaacggggcctgcactctgcttgaaggcatcgggaagcgtatcgacgaggccttgaaacaggagtgtcgtcggtcgagccgatatgtcggagggcatgtgctggcctgtatccgagatcaccgcccacagctgcacctcgagttcctccacgaagggtttgcacgttctcggagggctccacgtgtactctcctgattacttcctgatgacggttgaagggtagttaggacatttaccatggccataaccgtcatatggtagctataaaaggaggactccatcacacttcgaaacacacaactttgagctgaattataagaggctctattgtatcttttgtacattagaaaataggtagagagtgaggagaagctctggaggagtgcccggaagtttggcactctctctgacttcttcctcggcgagtgtagctttctaggaggaatttgggaggagtactagagctgccggtacactctgctccgggttcggagaaacttcttctattaagttagcattcgggatactttgttatgttatttaattatttagtataagtaagtgtcacgccctgaagtttagccatgctctaatatgctaacatgatttttagtggaattttcagagccttttaaataatttttaaccaattaaaatcaattatatgcaatataagtccctggaaaatcccccctttttttctttttcccttctttttctttctttttctccctctccctacctcatgggtcgccggcccatctctcctgcaccctcccgaagtcaaccctacctccccctttctctctcgggcgctgacggatggggcccgcctgcagccccttccccttcctccaaccagcggcaaccgccatcccaatcgccgccgcgtgccgcccgcgcccactctgtgcccatgtcaccacccacgcccccggttcccgcccatacacccgcgcccgcaagggcgagtttcgatttgaatccccctctctccccctccccacgtcaccggtgcaattggccgcccaccggccacgtccgtctctcccaagcacctataaagctcccccgtactctcctccactgttttcctttttttcaccgccctctcctgtgcccccaccgctcccacgccgatctcccctagcgccgccgcctaccgcccaactccagccgccgctagggccgccgccgccgttagcttcgcctgttgaatagtccccattggttgtggaagggcaaaggacctaacatataagtgggggagcccctcacctcaatggctagcttttggggtgggaaaggccctttacgatcctaaaattggtatcagagcctggctagtttaacatctctggcccgatggacagtgcgtgaaggcttgatggaccgtgggtgcttgcggggcccatatacctgagggaccatggtgaaatggtgaaggggcggtgaagggctgagggacaccaatatgtgaagtgggagattgttgaatagtcccacattggttgtggaagggcaaaggacctaagatataagtggtggagcccctcacctcaatggctagcttttgggggtgggaaaggccctttacgatcctacatcgctgtcgtgagagctacctcggccgccgcctcccatcgtcgaaatcccaccggaaatcatccttcctcgcacgccggtgagcccctccatttccccccctttggctggcattgccgctcaccgtggacctcctctctccctctaaatcctctcatttgcttccctaggtcacttcggacgtcgtccacctgctcgtctcgccgtccgccgcttgccaccgtcattcgccgtcgcaccttcccgcgccggccagccccacggtgagaactccctctccttcctccttccctctctcccgtatgcgccaccgctttccgcacgcttgccatcaccctcggccgacgccgccgtcctatgcgccgtctgccgctgctggtcgccgccatcggaggccgcgcgcgccgccgcccacgccatagccggccggccgtcttgaaaccgagtcgtccgataggccttggggccgatccgggctgttggtcccgtggaccggtggtggaccacccacatggtcctggtccacggtggaccgactgtcccttgagccgctgacatgtggggcccgcatgccagtccccccttgatgacgtcatcacctgggatatattgcgcaataaataattaaggctttttcttttttatagtaaaaacagagataatcttctaaaaatcataactaattcatccgagctccgtttaagtcaattcaagtctcagtaaatttataaaaatccctagaatccattgaaaatggttttgcttcatgtttcagtagacttatagcatgttttgcttgggtgtttgtttgtcgcgtagttttcggttgtttcgtcactctgtggtgcgtcgaagtcgttgcagagatctcatcagtgcgagagtagggcaagtcattcttgttaattgaccatattgctcccatattgcaaatgctctactttgctctaaatactgcattgttttacaatgtcacggtatgggctttttacctactgttctcagccttattatttgtatgccattttgctttgttaacttgggatgtaacatgcctagatgttggattagaattgctgagccctgcttagttcaactagtacacaaaaggggaaaacacattaaagcctagacattggttattagcatagctttggattggtgccaccgcaatggtgctagttaattaaaatacactaaatggtgggctgtgggtgcatacttttgctagtcgtgccatggcaattaaagaccggttcgcgggaaaccctggaagaacttatcgtacttaccacaagccagcgtgggcaacggctaggcttgtagtatagctttcctctagccgacgtacccaggctagggtgggtgtgatggagttgggtcggtcggggttttcggttgatcggctgccgaattcaccgtggcacgaggggggagggggctacccgttgcctgctggggacggggcgaaacctgaggtgtggttcaattagttagagggggttatgtgaagggtcctgtcacggactctttctgttatgtcatggtggcatgtcgacgcacggaaacgtgttgtcacatcttgattttcgtttcaggatttataaattatttaataaataattattagaatttatattaaatgttcattaatttacaagtgaagttaaatgtgggaaataaaatttcctcaatataaggcatggttggatttaatttttattaaattctccatgattaattatactctctggaattttctcggatttttctgagctcaattactaattttgataatacaaagaacatttcagttattattcacatatttagttaatcattaaatggtctgcttataattttgttaaatacttatagtgttcatgtaatttcatgatttttcttgaaattattagagcattggaagtatttttaacaatttaaatatcatttcagtgattaatttaattggaaaagtaataattcaataataagctaaaattttttttcatcggattatattcatgtgtggtcttgttttaaagatttaattgcaacgaatttagtagtgcaatcggatcgtgaattggataagtaatttgagagaaaatgtagtttaaagtttatttaaaaaacttgacacatgcatggctgcatgttctgtgaatgcatttcatcgattatattcatgtgtggtcttgttttaaagatttaattgcaacgaatttagtggtgcaatcggatcgttaattagataagtaatttgagagaaaaagtagtttaaagtttatttaaaatagtggacacatgcatggctgcatgttctgtgtatgcagtgagtacaaataatatttctgtgcatgcctgtagtagttttgggacctgtgatttttttctcccacatcggatggctcccgatttttttctttcggatcaggccctcccggtttttcgcctccaaatccggcctcctctctcctgtattgcgaaaattagttgagggaaaatattcccattatcctcctctatcttttctcccaaaaatccgactttatccctttcaattcgatgcgaatctggattcgttttcgagtttatctctcctgcaaaccctaggttttcctggcgcaattccttgtgttccaagcccgatctctccctcccgtggctataaatagaaccccaagacctcctcttttctttccaacccctagcacgagctcccgtgccctagccgcctctcccgcgagcgccttctctctccgtcgccgctagccgctccagccgctccagccgctccatccatcgccgctgctgccattgggttcgcaagaaggagaagaccagcctctacttccccgaagcctaaatccaccggagctccatcgtcaccatcaacccgaagttcaccgtcgcgttttgatctccggcgaggccctgctgcacctcccgtcgtcgccttcggtcgccgccacctcctttggattcgcagctgcgaggagaaccccgtccacccctccgttgccgccgaaacccgctggagaaccgccgacaccatcgacccgaatactaccaccacctcgaccttgccgccggccgttttccgtcgtcgtcctccgtagcgtcggccctcggtgagttcgtctcgccatcctcttcacgtagatgccctcggtttgcaccgacgtgccctagatcgccagcggtggtgtggtccagtgctatgctcagtggtgatgtcatcatgacatcattaatcctttatttaaatcgtaattcctttttttataaggctaaaatcagtttaatcttgtaaaattcataactaattcatatgaggccgttaaagtttataaattcatctaaaatcatgatctacatgtttgtttactttttatgtactgtttatttggagtttcttagtctttttccccgttttgtgtgatagcttgtcgtttctgtcgttgcgaaggttcgcgagtgcgtcggaagtggttctgaagactaattaaagaccgattattgcaaggcaagtcacatagatctcagacacaatcctttgaacatgttggtcctatatttaaattctctatttatttcaactgtgcatttattttcgaatgtcatcgagtggtgtgaacctattcctttgttatggccactttgcattgattactctattccttgataccttgggttattataatttgactagttgagatttatatattggttcagctagatgttagacataattgcttagccatgcttagaaacattagcacatgattgggataactaatgttacactaccacgtatgattatatttaatggtagctctcgatggtcaatcgtgatgaggacataactagctcggatataaccatgactaccttatgtattaatcaaataaaggtgcatatgttctacattagatttacttgttatatatttgaacaaacgttgctacacaatgagttttgtgtgttttcgtttgtagaggtacttgcttgggcgaaggaaaagagatcgagcataactaatgcatggatgattaaagaagttgattggggaccaaaccaagaccttctccaagtcttcttttatctcaccacgtcacttttagtccatagaagacaatagataaagttctacacgttttggattcggatttgggcctcctgacaacatcaatttcaaacggacctagctgctgatctagaaggaatttcggggcccataagtacttgttggaaagctcatggagtctattttaagatggttttggtcccacatcaaaattcctaccgagctgccaggaatctgcaaaacaagccacatacctcatctagtccgaatctgatttgagttttgggccttgtaattgtgtcgtaggcttagcccaatggggtgtgggccctagggcaactctaggacgaacctaatcatattaattcagtagctgtcatcatttagagttgcgttttgcttagattattctgtcgagaacagtttcgccgctagatcggtttgtaagaccccaactcgtgagcttaatcattcatctgtaattttggttgttttctatctcgttcttgtttgtgttcttcgattggcaaacagggattagccttctcggcgaggtcatccgtgttttgacacgggtgataatcagaagagacgtggtgctacgattgcggggctcaagagtgtgcgcgttcaagaagccggatctatttgtgtcgtgactccacccaaatcgttgtttatcagaaccttttggaagatcgggaactctagtgcgcatcaaatcatgattgattaattaattacttgccaactaaaacttgataatggtgggttgtgagcacatggttttgaaggtcgtgcttatgtcaattaatgaccggttcacgagctactgttgtgagacatttaccgtactaacaacaagccagaatgggcaacggctggacacatggtatagcaaggcttgttgtggtgcgccagactgagaagcagcgagaagtccgtgggggtcgctggggagtccatgcctctggttttttttgagggggtgattattatccaggaaaggtgcgctgctttgagttgagctatgcgaggggtcttgtcataactacacaaatggtgacatgttcagcatgggcacatggtaatatggtgacatattgtggagttgagtcttatgggtaaatttgtacacctcttgtcgcgcccggaaaaataccttttccagaatgctagtgtattaatcctcatcccaggaaaagccggggtacaccacacaaacatgatataaaagacacatctttattatatcgataatatttacattattacaaaggcacttcaggcctgacaatcaacaataaacagcagtggactagcggttctacggttccatcttcacaagtgctcaactggggtataagccaggactccacctaggacttcttctccaaatcttctcttactgaagggggggaaagatagagcaagaatgagtacaaccaccgtactcagcaagccacaccgggagatgcatgattaatgcaagggggtacaaggggtaataataggggttatgttttgcagtaaacagcatttaaaagacacttagttgctcaaagctattttgtaaacacgatcctagagctacacaatattattaatcaaggctgtgaacccacacgaacctgccttaaccaaaggcctacgatgattcagaccaaactagtaacccgacctgggtcccagctcgtcccatgtcaacccaagccaaccattccacattttagttgttaagcaagttttaagaattaaaccactaacttgggaacattgctaggcttgcccataaccgagagcgcggctattcgaatagatttactctgatcagaggtgtgcatctttacccaaagacacatctttactccgcattccatggccttggaacctgtcgtaaacatgtgacataacccttcacccatcctagccgtgaacaaaagtaccgacccaaccctgcctacggccagtatcccggacaggcagggccaggattgagcccctagcaacaggacctagaccgggtgcgccacacacataggggtgagaccacccgcgtactaatccagtgccatgacatctcgactaacggacatagagctgaaggttgaaccgagctttagattccaactgtttaggttaacttcttgacttccttgtcctcatagaagtacttctacctgtggtcatcttgcttactcgcaaattcttctaccttaatgacagggtgactgttgtagggtcgattgctatcgggagtcttcctcgagtgacacaaatcatgtttctcgttatcctttatcaatcacctttcgacctacttcttttcccagtaaccaaacatattttccgatctcttccatcaatcaccttttgacctttctcaaccaggtactcttcgctccgggtgttgtgggtgcttctggggcaatgaggtccttgggccctgctgcctttcggagaaaccttgaagtagttcgtcaaaagctatactgactgtcgttgcctttgatcagaaaaagacacatatgaaactcttagtccaaacaaatatctctttggttgatcacttgattttcttttctatctacaactaggttatttgattcataatagagtaggagctcacggaaatgagaccctaggtctccttaatcatcaacaaaacgtacataactcacagcacttgcaatcttaacatggatccttcataaacatgccaaactcattcattatttcatgtttctctcttattacatggttgacggggaatagctataaaacaaaagttcttgaacaccgatacaagagtattatggttgctactgactagcactaggcttaacaggtactgcatttgctccagtgaccctgatattgtggtcatgtcttcttcgtgcataacgaccggaatgatggcgcgggttacgctttggttgtggacaatttctggagtaatgtctttcttcactgcagttgtaacaaacaataactttcttacgcccaagttcttcatcaagtacttaatttctcggctgctgtactggaacatccaaaggtacaacgcagatattggcctctgtcttgtcaactggtggctggggctgaaattaagcattgacacctttgtggtagtgcactcagttgttgcaactcaggctatacgactgcttcgggatgcatggatgacaattcgctaaggaacaagcttctgattgtggggagttgcatggactgacatgctggcagctatgtttctcagtttcgggcacctggcggcgaaatgacccaatttcttgacaatttaagcaactgatatcttgccgaactcgggatttgcttttcccattttgattcctctgtcctactctggagttaggctgaaaactgtattcttgtcgaggatttacgtggtcttgatgcttctctttgttggaactggcggggtggttggccatcttcttcgtcagcagaaaactgaattgacaatcttttggtacatgatcagttccttcacacaagaaacaagtgatcctgctcattggacactcgccgggtggatggtctttctcacaatgaaggcaggtagtgacacatgagctagcaacatgaccgatttctccacaacgagagcatgccttatgttccattttattctgcttgaaaccttagggagacttctcatcttcatcccctgaggagacttgatctgaatcttcactatcagacactctacctccattagctaaaagatgttgggtcaactgtggtgcaccacgaaagaaatttcctatctgacgttttgtcattcctggtggaggccattctgtgccggtaatggtcatcttacggacttcatcatcggttcgcattggtgcttttcttttctgctgaggacagttccttgcatagtgcccttgttcatcgtagataagacaaatgattatagcttcttttgagtccacatgtggcatggcacaatgggcctgttgggatgctagtggcacgttgtctggcgatgtgggtgcttgatctgcctcaaattgcacttgaggttgcatctgactcgggttcagaattggcgtctgatgatgttgtaatagatctatgagcaatttgttctggttaattaggtgttggaccactaccacacaactggtgtctggtgctttattcacttgggagcatgaggcacccttgtcctgatttctgaccttactgcctttttcattgtcagccatctgttaccaggtttggagagggagagagggaaaacaaaaggggagggacagatcagaaactaaggatagcaccttaacagatctaatctttttctgttatgatgtatgttaggtttattctacaagttgattaagcaaacaacctagcatggttacatcacaccccactgatgcaaaccacgcgctacgcacacaagcaaggaagcacacgactatgactctaccctagagggtggcttaggttctgtgacgggttctccaagatcttcactcctgcttcacagctggcttcacagcttcctttgcttcgctagcggacccaacagtcttccggagctttggcagacaattgacggcatcttcttcttcgcaaagatgaccatctagtactagttgaaattcgaagaaggaagaagggagtaaaccttttgcaaatagcattagggaatggagaaaaaaggaactttcacaaatagtttcatgtataaaatatgtccttaggttttatccacttggcttaacctacagtcgagatggctctgataccagcttgtcgcgcctggaaaaataccttttccagaacgctagtgtattaatccccgtcccaggaaaagccggggtacagcacacaaacatgatataaaagacacatctttattatatcgataatatttacattattacaaaggcacttcagacctgacaataaaaaataaacagcagcggactagcagggactagcgggcctatggttccatcttcacaggcgctcaactgggatataagccaggactccacctaggacttcttctccaaagcttctcttactgaaggggggaaagatagagcaagaatgagtacaaccaccgtactcagcaagccacaccgggagatgcatgattaatgcaagggggtacaaggggtaataataggggttaagttttgcaataaacaacatttaaaagacacttagttgctcaaagctattttgtaaacacgatcctagagctacacaatattattaatcaaggccgtgaacccacacgaacctgccttaaccaaaggcctacgatgattcagaccaaactggtaacccgacctgggtcccagctcgtcccaagccaaccaaggccaaccattccacattttagttgttaagcaagttttaagaattaaacgactaacttgggtacattgctaggcttacccataaccgagggcgcggctattcgaatagatttactctgatcagaggtgtacatcattacccacaagacacatctttactccgcattccatggccttggaacccgtcgtaaacatgtgacataacccttcacctgtcacaccctgaagtttcccctttttcttgctttaaaaattggttaaataaattgcccgaagaaattatcttaattaacctagagctaaatccctagttaataaatgcaattaataatcggaaatagcgtggtggaatttttcttgagttccccatgctccaatgcattaacaagatttttagtggaattttcagagccttggaaataattttaaccaattaaaaatcaccaaaatgcaattttaaatcccaggaaaaatcctttcttctttttctttttcttttccttcttttttctctattgggccgttggcccactctctccacgcgctcggcctccttcctttgggccggcccgttcccctttcccctctctccgggacgctgacaggtggggcccacctgtcaggtcgtccccttcctccagccgcccgccccacgacggcaaccgccgccaaaaccgtccgcgccgctgccttctccgctccacgccgcgcccccactccgcgtccccacgtcgccgccctccccgccattcccgcccgcacgcgcgcccgcaaatgggcgggattcgatttgaatcccccccactttctctctcttcccccacgtcgccggccaaatcggggcgtttcccggccatgtccgcccctctcaagcccctataaagcttccccgcatctcgctctcccttttccccttttcgccgcgctctcccgtgcctcctaccggtcgcgcgccgctcgccactagcgccgttgcttgccgccacctccggtcacgcgccgcagccgctagagccgccgccgcgccaagccgccgccgccattagcattgccgccgcgtgagccaggccgccgctcggtttccgctaaaccccaccggagcccggttctcctcgcacgccggtgagctatccattctccttcgtctccggccaacaatggtggccaccgtggtcactctctctactcctaatccttctcaactccctcctccgtaggtgccgccgccacccgtccgcccctcctcatcgccaggtcatcgccgccaccttcatcctccgctccggccgccatactcgccggtgaggatcctcccctcctccctcttcccctctctctcgtttgcgccgcctctctccacgcgctcgccgtcgccttcggtcgacgccgccgtcctgtaccccgtccgctgtcgcttcccacgccgccgattgctgtcgccggcgaccgtgcgcgtcgccgccggttgccatggccggccggtcggttttgaagccgagccgagccgtgcctagccgccgccgtgccgtccgatcggcctcccggccgatctggaccgtcggtcccgtggaccggcggtggaccacccgcgtggtcccggtccacggtagaccggccaccttgagccactgcccatgggccccacctgtcggcgccccccttggatgacgtcagcctaggtattattgcgcaataattaattaaggactttttctttattaaagaattcataagtaattcatccgagctccgtttaagtccattcaagtctcagtaaatcaagaaaaatgcaaagaatccattaaaaatggttttgtttcctgtttcagtagtcttatagcatgttttccttgtgtgctttgtttgtcgcgtaggtttcggccgtttcgtcgatccgcggtttctcgaagacgttgctgaggtctcatcggttcgagagcaaggcaagtcatccaatatgtttgatcatattgtacccaatttataaatatcccgcatttctattaaatgttgcattcttttacaatgtcatgtgggatgggtcctactactcagccatatattgatttccttatgccattgacaacttcggtattaaaatgactagatgttggtttaggaagtgcttagccatgcttagttcaactagtacacaaatgggggtcacattattacatagactttgactatgagcatagctttggattggtgccaccgcgatggtgttagttaattaaaatacactgaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcagccggggtgtccggttgtctagctgccggattcaccgcggcgcaagaggggactgcccactgccttttgaggggtgggggtgaaaccttagcgtggtgtggatggttaggggagggttatgcggagggtcttgtcacgattttcccctttgcagtatcatggtgatacttcggggcatggcgacatgtgtggaatcgtgtcttgtgggtacagttgtacacctctggccagagtaaaactattcgaatagccgtgctcgcggttatgggcgatcaaccagattcaccgtgattagtctcacccctagtttagcttaatgaactgctgtagttcaggtggatggttgggcctgttgcaacgtggtgtagcgttggacagtgattggttaatattgattaattactacagctgttttactgctttcaactactgctttgaaatgcctactttatgcagaagaacccctagcttcctttggttatatcctgcatcatacctcctcttccggtatgacttgctgagtacagtgggtagtactcagtcttgctctcttttcccccacaccagagttgaagttcttctcagttggagccgtctcagaaaggttggtttcgtcgctgccgtcaaggtttgcctgtggagtggagtggcccgctgctgaagtcaagcttcccggtttagctcgctttaatctttcccgctgcatttgtaatcttttatattttttgtaagacgtgggtctgtatgtcaacaattgtcgtttgtgtaccctggcttgtcctggacagggatttaatgcacattcagcttagaaattctggttcgagaatttctgagtgtgacatcacccatcctagccgtgaacaaaagtaccgacccaaccttgcctacggtaggtatcccgaacaggcaggctaggattgagcccctagcaacaggatcttgaccgggtgcgctacacacataggggtgagaccacccgcgtactagtccagtgccatgacatctcgactaacggacaccggcccgtgcagccttcatttgcctagacatctcgattaccgagccgcagctcacgtagccttcatttgcctcagagatatccatcgtcgcaacgaattcatccatctctatccgtgtccttttgttcaggactagaccgagcaccgagttaagccttaccaattagtcatgtggttagtacggtagtgctttgcaacagaggcctgagcttaatccttggccggggttctacttcccacaactggcatgcacccaaaccccaccggaaaacaggttttaggggttttgaaagaggaagagtggggcatgtccaattccaccataagccaaccattccatagtgtccaagtgatatgagaattcccaaagtctaaagttataaaaccacctagtgttgcctaattaatcagcgaagcatctacctaaattcatacaaatggaaccatgaatggagtacccactagttggggttttattttccttgggtgaacaaggtaataataaacaataacaatgataaggctataacaaggattaataggaagtgctaaataaaatagtgataatgcgggaatttaaataaagcggtaatgcaataatttaaatcaaaatagttttatatactaggattcaatatgctcaagggtgatgcgacttgccttgctcagagagaacggccttccgaaccatcggcgacgacagcgaaccacgcttcgggaacctccggaatgacataagctacgcgaagcacacaagcaaagctacaagcctataaagaagcaataacaatacataaaaagaaagcacatggttctttgggttataacaaacattaggagacttgaacgggtcgattcggggttcgtatgaccaagacatggtcatccaaagtttactgctgttacatgaagatttgcggattattataattaggctttgcaactataaaacatgtgtaagcgctagcctggaaaagacaggaaggctgcgcttgtcgacatgcagaccccacatgtcaacccaaaggcccacggtagaccgagtacacagagacggtccacgggtcgacggaagcggaccctgtttgtcaaccaaggtgagtggccgacaaacggactccactagacaccatgcgggctgcacacgtggaaaccacgcgactaccgagcgggcacactaacacggtcaccacatgcacacatgaacgactactgacaccggtacacgggtacctgggtcgacaaccgcacgacgggcacggggcgacaccaaaaggacgagaacggggtagcgagaagagggatccttaccaccacaagacgaggcgcggaacgacgatgacgaacgggcgcggcggagacggctcggggacaacggaggcgaacggtgatggaatgacttcggtggtgatccttggacgaaggcgagacgaggcctgcacaaggcttgacgacacggagccgaggacgaagacgacgaagaggctgcagcacacttgacgaaacgcgatcggcttgacggagggacgaacgccatgacgaccgggaatgacgagagggcgatgatgaccgggccggtggggaggcgacgagggcagccggcagcagctgcacggatgcgaggacggcatggaacacgccgctgcaatgccgacgacggtggcggcgcagcaagatgacgtgccggcgaggaggatcggccgaccggaggaggggatggcgacgtcggatggagacgacgatgacaaacaccggcggggtacgggtggaggggaggcgaggccgagggcgacgttgccgctgcgatgccggaggagacgacgacgtcggccggcacacgggcacggaggaaggagtggccgaaggaaacgtcggtgaggtggaaggagaggctagggtggaggtcgatgccgcggtaccgaaggaggagatggcgacgtcggcaactggaggtggtgcagtggcggcaacaccactggacgtcgacgaggacgcgcctccggcggtcaccgcgcgaaatggagggcaggccgggggagaggaggcggctgcgacgccgagaatggtgacagcacggcctaccggtgcatgggcgaggcggcaaaggcggctggaggtggccggcgacacgggagagagagaggagggctgcggggagaggcggtgcggccacggggtggcacgggaggaggctaaaatgagagaacagaggaagaggatcccattttatagcggaggggagctagccgggcacgggagagggcggaacggcgccgagaatggctgccggcggccatggaaggtggccggggatggcgcggccgttccgggcgattgagggtgccattcaaggtggaaattaggggggattgaagaggaaggaaatgggattaattccccctaatcaatttggaaagaagggaattgattcgcgcagatttgagggaggaaattgatagggtttcatgggagaaggaggagccgggcgggaggaggacgacgaccgggtgggtgggacccaccagtccgcgcggtcagcgcgcgtgcggcgcgcgtgcgcgggagggctgcggctcggcttgggccggggcaggcctaggcgggaggaggagaggagggagtgggacgggaaggagaggagagaagtgcggcccgggagaaagaagggagggggagggagatgggccggggggggggagaggaggcccgagagaggagggaaaatggagggaggagagaaagactttgggatgaactcggcccaaaggcggaaggaggattatttttagttttctttttaataaactttgataaaggttgttgttgcttatagttatttccggtgttctgaaaattcaagtaaaatttgagggctcctttttgaccaaggagaatttaacaaaaattctccgggccacattcgaatttttcttgtttgctttttaaggttgccaatttcttttcgagttttaattaattctattattccttttagagaatgatttttatttcgagatgaatttatcaggacgtgacacctctggccatagtaaaactattcgaatagccgtgcccgcggtaaatggcgggttgagcaatatttttcgtgattagtctcacacctctcacaataattattgatgctataactggtaataatttgcttagctcctggtttggagttagatctgtacagccgggtatgtttgttcaggatggttgggcctaagcagcatgggtgtgctgttcagtgttgattaatattgatgattaattactctactgttttactactcttaaatgtttgcttaatgctagttttccaaatgagcctatattatgccatccttcggtatccttgtgcacttgcatatttgctgtgtggcttgcggagtattccatgtactcaccttgcaataatcaatcaaacctcagttgaagagaagtcgcaaagaagaggacgtttggcttatacccaagttgagcttcctgtgggagtggagccggagcttcgctagaccattaatccactgctgtttttcttttcttttgtaagtatgcaatgttattattttgatggacttgtatattaaattgtcagtttgtgtacctcggctgattcctggacgaggattttatgcacaaataacttcagaaattactagtgaatttctgggcatgacacgacgtgtcgtggggttgtgtcttgtgggtacagttgtacacctctgatcagagtaaaaactatttgaatagttgtggccgcggttatgtgcggtcgaccaaattcaccgtgattagaatcacccctagattagcttaatggaactggttagttcaggtggtggattgggcctatctcaacgtggtgtagcgttgagcagggattggttagtattgattaattattacaattgttttactactttcaactactgcttttaaatgctagctttatgcaaatgacccctagcctcctttggatatattttgcatcataccttcccttcctgtatgacttgctgagtaaagtggatagtactcagtcttgctctctcttccccacaccagagctgaaaatcttcccagttggagctctcccggagaagttgggttcgtcgttgccgtcaaggatgcctgtggagtggagtcgccccactgcaggagtcaggctttcaagattagctcgcctttctcttttccgctgcatttgtaatcttttaatgtttctgtaagacatggatctgtatgtcaacaattatcgtttgtataccctggctggtcctggacaggggttttaatgcacattcagcttagagattctggttcatgaatttctgggtgtgacaagttggtatcaaagccgaccttgattgtaggacaagctaactggaaaccctaagagcccttcgaatccttttcatttgcatatgctctttgcaattggatttgtttcgggaaaatgagggtttgttcttgtggttgatgggaaaaatcttgatcgcttgttcaattgaaatttatgaaaatgagatcagtctagggttttagtaaaattctagtttgaatttatttgacagtcaatcgggatttatcggggtatatgcgttaattcgtgtctagacttgatggggcgcaatctttatgcgcatcattactactatgtagtatctattttgggcattaatttattgcttagttagtgtcatttcatgtacaatgctctatgcataaaaaaaatagtgcttggctagatacttgagttatttgttgttttgtttaatttggatttgagcgtgcattagttcctaccccttgtcttccttagatgtcagacctgttccttgatcacaagtgtcgctccaagcttcagagacaccgcctttagctttattgtcttcttagttgtatgcttggtttctgtgtttaggtttgttgcttgtgggttagtcggcggtcgatatcatgtgtcagtggtatggttgcctgaattaggagttgcttgcctcctttgtagtgttttaattcaagtcagatcaattgcagttaaatttataataaagattagtttctaagccatctgttttcttccttttctcttatttctatctatcccctcaagatgaagtcaaggaatggtcgcagtgtctccaatgacgccagtggcagctgaagagcagatcaatggagcacacgccaacggtgcatctggcagcagttcatcgccaccgttcgagaaccgaacgatcactcaggtgctg

SEQ ID NO: 67230 - DNA, 14015 bp, Oryza sativa
  unsure (1)..(14015): unsure at all n locations
ccttgcaaacagcaagggcatgagcgcatggtattccagtgaggtttggctttaggcattcgcacataggaggagtatcattgtgtattattactttatacttgaaatctcttcgaacatatgcagtatgatttccttgcactactgcaactcgctcacggtcaaccttgacctcatactcaccaccttcatcaccataagaagtcacgtgcatggatccagccttattccctcgctttactaacaaattctcaacccgatgggaccacattttctctgaatctgcaagttcaagagcagattttcttctatcagcaaaccattctaagcatttattaaatgtttcctccactattgctgtcacaggtaatctccttgagtacttgaacacattatttaatgattcagaaccattacttgtcattataccccaacggtaaccaccatccatgcattgaaacacctctcaggtttctcaggctcatctttatcctcctgtcgatattttccaacactttttagataatcaattgcatttggacaactttgtgtaattgcatccatgccttctacaaacctgcgtggtttcttcttctttacagcccacttgaatgtttttatcacatcatcatttttacatcgcttgtacagattctcagcaatatgttgggaacaaaatcgatgcacacactcaccaccaatttcgttccatccgatatgtggctgcttgaatacccactttatagccttgtgacgatcagaacaacacacatgaaattaccaaaaccaatcacctcttttcttagccatctcataaaccaaccccaattgtcactatcctccttttccacgattgcaaaagcaagtggtagtaacctattttcagcatcatatccacatgctatcaacaacctgccccgatacctaccagataaaaaagaagcatccacactaattaccggtcgaaggtatgggacagattcaatgcatggcccaaaagcccaggccaaacatttgaatgattggtgtccttcaggagatgtaggatttgatagaagttgatattttgtacccggattagatgctttcattgcctccaacaacggtgtgacaagtgcatatgattcttcccaactaccaaacaattgaactatggccaactctcgaccacgccacaacttgttgtactttggtttcacatttttatatctttgtcgaaccaactgacgtatgcttaatatactcaactccaaattctcctttagatcatcacgtatcacatcagcaatgaccgctgctgttagctgtgcatgatcaaatcggtcagcaggtgcacgacatgtgtggggaaattggcaagtttgtattttccaactcgaaccaatttttgttgtttttgcatatagcttccacttgcaagtactatctttgcacttgaaatctagtcttgatttgttgcttgtagatacccttacttccatattattactaatgtgaaattcatttactgcaaactgtaggtgttgcttggagtaaaaaattcgacctttggccaatggactctcaaagtgtctctttgaaccaaagaaacaatcatcagctcttgtctgacgcaacacagaaatgtcatgaaaggcacttacggggtgcttaccagacctacccatgagtggctgcgattttgcagaattaaccaatgcaatactatcattcatattctcttcgtcttcgctaccctcctccacatcttcctggtcttcatcctcgtcaatattgccttcattgtctgtctcttctccaacataagcctcctcttcaacatttgtttgcaccacattcctagcattatgaccatcaagggaaggcatcacaattgattcttctccatcttgattagcttcagaagagatgacatgactaggtgattgattaactaatccttgctcaataatttaaatggttggagcagtgttaggttcattatttcctcttgtcatgacaccaatacttgaagtatgacttctcccaatattaattgatgcagtctcaacatacaattctaccatatgccaattggtccgtgctgatgtcatttcaaggatcatttgccaagatctttcctcgtataaagggattaactggaaaaaatgtggaccaggtgccccaacatcatacctcacttttataaccaatgaatatgcaacctcagaaaaatctaggccacggaaaatctcatttttcacatcttctagcgtagtagacttgatagcaggaaaagtgatcttgggaggaatactatatgatgcacctgccttctcttcgtatatgatttcaccacccgcatacacaagaacaattatcatggctcgtgtagttgtgcctaaaaaacaaataacatgttattatcattcacttgatatacatgtgaaagtagcgtgaactatttaccaaacatatataaatgttgaattcaatctaagtttttggcataatataatagacaatttatatataaaaaaacatatgcggaaaacggtgccccatgaaaaaagttatctaacttatcgtatatatgggaaaagcgctatacggtccaatgtagacaacggccaagttgtagtgtgtgtatgtataaaccatttaatataaccttcgacagtgacaatgttagtgtggccatagtgcaactaaaattcatcaattctgagcacatgagactaatcaaactagcgtgcagcaaacaattgatccactaatatgaattgttagtattgaaaatttagtagtataataccacgttgtttgtattctctttgtgatatgaacaatggaaaaaaaaactcgttgtatgcaaccttaaaccctatgattttgatgtactaccggatgaattagatttgaacaatggggaaaactcaccgtctatgcagttccaatatccaaaacggaagccaacatctaaaaccaagaaatattgtttgctgggttagggcggaggaagctgcgatggagaatgaacaaagttcgactctgacgacaacggcaagatggcaaactgccctagttttcttgactccccgtaatgatgcaactaaccaattttagaggtgggttgttgggttaacttaatcaattcagcagcccaatacggcccagtagtttgttgggctactggttagatggaaacatattgctgtatatgagcatcttgttgcctaaataattaaatgtgattgttgcgtgctcacatttgtaattagtggtttgcacgtgcttagataaaaaaaatcagtatctctctagtagactagtgctagtagcaaaacctaccgaatatggaacacaatcggagtcgatttccagggccgtgaaacacaaacgctactggactcctttccgcctaataaaaaagctcaaagctcaccgcgacaagaagaagcccagcccacgacaaaccacacccaccaccacgcacgcacgcacggtatacatacaccttcacattgggggcgatgggcagcagcaaggccaaccacccggcggcttcctcgtccaaggtctcctccgtctcctcctccaaacccaaacccaaacccaccccgattagaaaccctacgcctccgcctcctcctcctcgccgccgcacgcccccgcctccgccgccggggtcgggcccggggccgcagcgaccttcctacctctcggtagcgctccgccgccgcgggcctcccgcgggcagcgcggccgggaccccggcgccgccgcgcgccgccgccgcctttgatgtcgcccccccggtcgccgagcacacggaccccgttgtcttccccgcttcattagccgagatgagcggcggcggcggcagcagcagcagcgacgatcaggtatataccccacccccatctgctccccgcgcatcgacactggctggctcgtggctgctacggggtaattgcgtttttgggtgcgagtgaattaatgttgtgttttttttttttggggggggggcggtattgtgatgcttcaaagtttgtctggatcatggtacatgtggcactagattaacgcaataagtatgctactcacttgttttaggggcttttgtggccgattactgcataagctgttgttgctttgaagttatatggagtaagagtagttcgtttgagttttgaaggtgctacttcaaaattttaagtggaaccaagcattcccttaagccaatgcagctccttctgtgttagcttgatatttagggctacagatatcgacgatatttcgattaatagttgttttggacgctccacaagttattatggtcctgtggttatgattttctcatcatatagttgctcctgttgtgcagatccttctgtttgggagcttcacagaggctgaaaccaagttgtggcagcctaatgcaaataaaacacgggaactctctgagatccagtttgggtcactgaatttctcagctctaaatttatcgaaagaatcaaattctattactcaaggtgctgtctatcctgcaaaattaagtgacggccagaacaaaatcatcattacaaaggatattgcatgcagcaacaaaaaggaaacagtagctcctacattaccaaatggcaagccagtgctattcaatggatctcccactgccaatgccaatgtgtctcccaacaatggcgtcattgagaataatcagaaggctgtagctgcagttctcacgagtgttcctgctaaaaatgtcagcagcccagcaccactttcagttccagaggtggaccatgatgggatcgaacgcaatcaaaacagcagtttagtcccagaaataactgaaaatggagggccagctattgatacaccaactactgcagctccagtggatgagcttgtgacaagcttaaataaaaaggactttcggaacaagcccttgcttcctcatggtttgaagaatacaggaaatatatgcttcctgaattcatccttgcaggcattgctctcatgctggccttttgtccagcttttacagaacttgaggaaccagaatatacctaaggtgctgctatttaaacaattaagcttgatgttctaaccccgcttatttcaggctaatttttctgactacttgttgcattttaggctggttacccaacactgaatgcatttattgagttcatctctcaattcgacgtgctcgatgattcaaatgttaagaaagacgagaagtttgctacaatagcttcaaaatcagttattccctccatgtttgacacagttctgagaaattttactccagatgtgccagctggaacagcttctaggccaaggtaaaagactgttaatgcattttttttaactattagttttacttgtgtgaaagtaactcatctagttgttaatgctgataatctgatgtttggtttgtcggtgcaaattgtggatatcaatgactttttggcattttctttaacatctttagtccaacaagccatggatggcagtttatagtctggtgtttagctgatccttctagtactataatatattttgttcattctttcttaaagagctgtattgagtgtattaagttaaaaccaatggctcaatgcttacaagcatgattgcacgatgcttacgatgcttttgaacccctgactatatcctttttgttttttaaccctctgcttgaggctttgcttgtgtatcactatgatatttaggatatatgccatataaatatgaagttcattcaaacaaagtagtttgctgcatcacatatcgctgggacattgtgcatgctattctctatccatttctttgtgttgttgtagatgtccagttttaagggttcacctcaatttgcagtaagctatccttgtttcagtttatgatgctatgtacttatgcaggcaggaagatgctcaagaattcttaagttttgcgatggatagaatgcatgatgaactagtgaagcttaatggcaatggctcaaattcaaaggagggtatgattgtttcatcaaatgatgatgatgcttgggagactgttggaaagaagaacaagtcagccataatgaggagtcagagttttgttccctccgagttaactgctatttttggaggccagctgcaaagctgtgtgaaagctactggtaaaattttcttgtgcagagaaaaagcgcacactgttttggaaattttaatgtccttgctttccatgtcattactgttatggtatatctaaccaactcaacatttgcttgtgccatgtaactctataaatgatgttcctaagcatgcacgaaagttgtcagggaaatagtgtatatgcttatgcttgacaattgagattaacttaaaaaaagaaactgttatactatttatttctccctaagaagttatttgacattattaccagaatcatgggctattgtccttattttatacctggaaggtttacttcattgtcattcttctagttttactaacaagtcaaatcacacccattagtccttaaggtattactgaataccactcctacatgaatcatgtaactcaatatacctttcgcgaatatgttccccactgatcatgaactcatgactggcaaaccatttttcacagactcaaggtgaaaactgtgtttgagtgggtcaaattgtgcagtcatttgctcagctttgcttggtgagtgcagactgatggattattcttttatctgcaggtaacaaagcatcagtcaccgttcagccttttcgactgatccatcttgacatattccccgatgctgttcagaaacttgatgatgcccttcgtctgtttgctgctcctgaatctttggaaggatacagaacagctgctggaaaggtagcttgttgaaatttactctattatttgacctcttaattatgtcaccactcaaatggtttgttaattgcatgtatgtaaacttggtttttttacatgcaatggaaaatccattttgcatctactgcattttactcagtaaactatttatgaagccttccttttttaatgttaatattctgttaaagctgctatttaataagctatgttgttgaaacttctccttgtggtaccactatatttggtgctttcttcttcatatgaaagatgcaactgttatttcttgcaatgagttaaaattacaatatgtcaaactttgatcttgcaggctgggttggtgacggctagaaaatcagtgaagatacactcactttcaaagataatgatactgcacctgaagaggtttagttatggaagtcatggctgcacgaaactcttcaagccaattcacttccctcttgagctggttcttagtcgtgatctgctgagttcgccatcatcagaggtgatagtttgcccgatatggttttatacatttcctctcaaaattttgagctatctttcatttgtttcatccctccattttcctcttacagaggcaaccatgtcttggttatgcaattattgtgttattgcatatgcagtaggcttaagcttgcactccaagtttatgcacccattatggaatcacgatcatttcttagtttccaacatgctattgaatttgagacaaattgacgcttcttcaaatagttaaaatgggatctaacaacttgatttcagcacatgcagagtagaagatatgagcttgttgcaaccatcacgcatcttggggcaaacccgtccaggggccattacactgccgatgcaaagtctgccagtgggcagtggcttcgcttcgacgatgataacgtcacacctgtcagtctgaacaaggtcttgcatgaccaagcatatgtcctgttctacaaacaattataagtttgggggtattgctacggagttgattagcggttctcttattgcttgaacagctagatatatactaactatatcgcccagttaatgtagctgccgtgtaactgagaatcttgtgtcaagtgcctggtttcctgcgtttatttatatatgcttgatcacatagtgggggatttttgttcaggccattgttgaggttttgtaaaatgcaaatgtcatcttggtaatgaccattaaagtaaccatgagatgatatcactcgttagccctaagaaactatattgatcatgttattgcggtgttgcatttgattatattaaaacgtgattaaaacgtccagcttgtgagcttgacgattgctgaaatatggctctatggctgcctactgcgcttcaggtttcagtggctgtcaatcagtttggaaagctgaagctgtagagatcaacctgaaactgtgaatttgtgaagcagtttatgcctactatatacgagagatcgtggctgatctaaaatgacttctgcagatgccatttcctcgtaatgctggatcatgatccgcaagagatgatatcttgcactacaaaatgaattctgcagatgtcatttcttcacaatggtggatgatctatcaaatgaggtgtcatttcttcacaatggtggatgatctatcaaatgaggatttcaacactctttgtgcagatgtcatttcttcacaatggtggatgatctatcaaatgaggatttcaacaccctttttgcacagttgtacactgatttgtatttttctcctcttgctcttgtgccatccttcatctcctttcagagactcaattctcccgaggctttacactactatccggtacgtatacctaagatccccctccgtcccagaatataggtttttgtattttgggacggagggagtaacaatcactccactgttcgagcatgaattgatgtgcaaattattcgatttctctgtcaatacgtcctaatttgcagcttgtgacaaccatcaaatcgaggaagctgccgattgtgctttgctgatgttatctgttcaaggagccctgaaagtctgaaactgaaaaacaacatgaataacagtgaatgattagaacccagaaacctgctaaattgtttatcagtgaacatcttcataaaccgtagtggaacccttctgaaatcaatctgaactgaagctggcatctgcctgttaatacattatacataataaaattaccggatcatcattttgtgcagatcaacacactgtaactgtagtatgcagaaatcccgatctgcagttgttcctgtgatcctgtctagcattttgtaaagaagaaagcactggagcatgaaaaaaccaatctgaagctgttcctgtcaagcattttagttgtttgtttgcgttgatacgttctttgtttctctgtggtattgtcaaccagtcaaattgcaatataatatcattgagcgttatatttgaccaagttacttctgaattcatgcagaccactatcacttttgaccaattacttctgaattcatgttcctttctctattatcactttgaccaattacttcatttatgttcttcaccctacaatcacttttgagttttgaccaactacttctgaattcatgttcttctccctagcttgttttagagacttgactgctgaatcaacatggccttccataatttgctacctaactgaacctaaaccaagacattctcttgcacgatacattttgctttcatgcttatagtttagaaaccatgtcttatcttgcattgcatactaagttctcaaataatttaatgacagtttgacatggctgagctgtatgcctgtttatgcaaagctggcatgttcatcatacgaactcttcagttcaaagttgagagagccaaccagaaattgaaagccaacgtcaagaataaatcagctacctattgttagaatgtctatggatatctctgcaaccttaacagccagctgcagaaatcaatctgaacttaatgctgtttccgtctagcatttatctgtgacacctcacacgtagatattgctccttgaatggtacttatgttgctttcatttctaaagttactaaatcatgaccaattcgatggcgatttcggtcccagttcgtcacatttccacactgatgtctttcagaggctttaaacttccaccttcttttcagagctcccaattaaatcatctttcttgatcagtcacttccatttttgctactgatgatgccagtaataaaccaccatcatcggcatcgcacatgatgacaattgacaaaccaaccaccaactttcgagatccaacaaattcacagacaacaaaagagcaggtttctaccagattctgaagagagcaaaggaataatcagaagttgaaagattctaaacattagactgcttgccatcttaatatatccaacattaacaagggcggtagtagaatcattagtacacatgattctacatcactctctatttttgcttttttttttctaacacattttagatgatgcacctgaaactgaacagaagctgctttactactacaagggatgcagcaccagaaagctgcaatttttccccctttttttttcagtttttatacacagtgaagaaaagcagagagactaaactctgaaaactccaaggttatacactagacagcagcagcagcagcatcaccactcacccatggcgctctagcgaggctggtggatgacgtggcgggcggcgccgcccttggcggcgacgaactgggccggcttctcggcgtgcctcaccatcccggcgccgcccaacctcggcgagttgaggctgagcgccctgagcacgtcggcgtcgagggtgggagtcgtcgtcggcttgtggtggacgggggggtcgggggtgtagaagaggtcgtcggtgtcgaccatgtcgaggaggtcgagcgagtcgtcgggcaggagcgcggcgaggtcgtcgtcgaacacctggcggtggtggtcctcctccgccgcagcgtcctcgtacatctggtgctgcctgaaccagtggtcgcggaaccacgccgtggtcttgacgagctcccaccactccggcgagaagtcctccaccctcctgaacgccgccgggatgaacggcgccgcgttcgggttcagcgacgacatcgccatagcactcatccctcactccaactgcaacaaacaagaacaagaacaacaacgccatcaataacccaaaaaagaaacaacaagaaattcgctagctagctagctcatggcgatcgatcaagatcgtcgaagattactactaccttttcttgggggaaaatatctcgtggcgcgacgcgaacggcgattgattgattcccgcggttttgagagagaaacggtgggtttcttgtttggcttggctgcgcggtggtggagggggagcgcgtttaataggcgagaggggaggagtacgagcgggtggggtggtggggccgggttgtcagtgggagtggctgacgtgtggggccgggttggcgtgtgggtggggtgggttggggtgggggtggatggtgagttggtgactggtcggtttgggtccctttttcacatggggggtggggccaatggggagtgtggtgatgcttgggcgggattttctgtgggcgagggatataataattcgggtggaagtttcctggcgatagagatattgaagtgctcctatggagagagagagagagagagagagagggtgtgtttaatgtgtaaatcgtgtacggtttgcttgtagttatcggataagatggggctgtttggatgggacttttcagtccaaccagatgtttgacactaattaaaaatattaaacatagactattgataaaacctatttcataaccctgaactaatttgcgagacgaatctattgagactaattaaactataaataatttatgtgatgctacagtaaacatgtgctaattatgaattaattagacttaaaaaatttgtcacgcaaattagctctcatttatgtaattagttttgtaagtagtctatgtttaatactccaaattaatgtccaaacatctgatgtcacagagactaaagtttagtccctgatccaaacaccacctaagttctgttcttcattcattaactacttcaatccaaaaataataaaagaaagagattccaaatacatttttaaaaagaaattgattcattctctctctatcccaaaataataaaagaaagagattccaaatactttttaaaaaagaaattgcaagcgtgttgaggattgaacacgagaccgcaaggttgaaacgatacacccgttaccactactgcatttctattccaaaacataacaaactttgagtttaaaggttgctattacctagcccccgacaaatatataactaccccatccattaaaaaaaaaaaactcaattctagctacgaacctggacatggtttgtcttttttgacaaactagtaggtagcaacatttttaggccgtaagaagtaataaattctctttttattaaattaattaatgtggggattctatgttcattcatttcattatacttctcttggtcataaatatttcttcaaactctataaaatttcaacaactgattttatgttaaaagaagtttttaggatctaataaatttatgatattataatagtactttttgagataaatctatgtagtagtatatcatttgttttgtttcaagtcaaaacatttaaaaaatcatggattgtcggaattgtaagaagtttgatcagatattatcgtaagcatcaaatgtttttgacaagaggaagtacattatgccaagtccttttcggttgcanntaattattnngtacagttngtatattatagtatgacaaagtcaccattgtacagtgggatgactagaaggtacgcattctaaattatttatggacgaatggattatatgcgttattacactttttaaattatgatttctccaaaagtaggcaattcgtctatgctatttttatttttataaaatataatatctaatttcttcgtacttaattgcaaaataacaagtagtgacatcaagaaaagctttttaggattggttgagatttggacatgatctcaatagctttatatatatatatatatatatatatatatatatatatcaagaaaagcttaatttattcctacttagttgaatctgcccaaccataaaaataacaggccctaacattgagaaaaccaaagcaactttttttcagaggaaaaaaatagaagatgtaaaccaaaactaacccccgaattgatcagcaatgttagtatatagccttggcttacggcatcaggaactaaaccacagattaactaaatccaacatggagccctaattatttatcagatagatacaaacacgtcgccatcgaaaaccggcaccgtcttgtaatcatacttaattgcaaaaagaaaaagatttggtgaaacgtttcttttatgcctagttgggtggtgacatcaagaaaagcttattaggattgattgagaatttagacatgatctatcgacgcatgcactgcctttgctttccacgcaacacccatatgagctgaaaaattggattgcagaattatcaagaaagtgaaatgattttgattgctatgctgtggaactatagcaatcagtccgagttgtaaagtttcagttagaagaaaaataattgcagataaaaattcttgtctgttttactcggtcaaaatcgccggtcaactggccggtgtgctgctccactcaaagtctcctgtggtagactttggggttacacagagtcactgttctttgaacgcggtgatagctaggtttactgtatgtgtacatcctgtttggaatgagaaattccgtggaaatttcacagtattttcaagacagacaatgaacaaaaaacatttaatgattttttcaggcatatgaaaaattcctatgcttcaaacgagaattcacgatggatggtctgaatctagaattaagatctttttgacgtaaattcagagaaatatgttcgctgacatgttagacgacggggaaaagttatgtcagagattcttattaatccctaaatttgtagtggg

SEQ ID NO: 67231 - DNA, 20221 bp, Oryza sativa
  unsure (1)..(20221): unsure at all n locations
taagaaaggtaatttcctatctattgcttcgggcaccgacccctgctggtctgccagcctggttccggctatagctctatgatgtatccgaacgtggaggattactaggacggaattcagggctgtcaccacctgccgcctacctctgataaatccgtgggatacacaacaaacaaaggtaacgtctaacctagacaccacgtctaagttattaattactactctaatactcgcgcaggaacttccttctctatctggagtcctagtactagagcacttagtataaatactaaacaatgaacctgcaaagatggaaatatatcttactcagattaaataattaaataacataaaaaaggaatacaaatgcttactttatagaagaagttctccgaacccggagtagagtgtaccgatagctccggtactcctcccgaattccacctaggaaactacactcgtcgaggtagaagtcggatgagcaccatacttccgggcactcctccagagcttcatctcactctctaccttattctaatgtataaaagatacactagagcctcttgtaattcagctcaaagttgtgtgtgttggaatgagatgaagacctccttatataggctccaaatgatggttaggggcatgggaattgtccaaaacaccctgcaaccgcctctgggaaggaatccaagccatccacgtggaagcagatggcgaacggccgcagaacgggttcggccgaattggtgggttctgccgaacccaaaaatgtgtcatcccggcctctcctttggccggtaagttgcttaatgggcccccaataacctgcaccatgttttggcccaattctaaatggtttttattgacttatggggcctccaattcgtgtaaacgtgtcctgaatgtgcagaggtgcattttgtcgcatgacggatgtgttttctcctcaaaatacctgcatacacatatttcaccaacactagtggaaatgattagtaataatacctaccactaagttggataccatgttttatttcattatatgcaggtattgacggtcagatattatgatttaaggaccgtcaacaacacccccacacttaaccttttctcgtcccgagtgaaggctatgaactctacaacagagttatgacttccttactaataatcatgcaaacaaattattcaaagccatacctgtacttgtggatctttgtagtgtctaccatacaatcttggacaattgaggaatggaacaatctcgactcaagtcaccctaacttttcatgaagaacaacttggggtttttcatgtaacacaaaattataactttgctttactccctccattgattctctcgatcactcaaagtgtatgattcctaacaaaggcatatgattgtgccttttcttttcctaccatctaataaggcttatgtggagtttagggtatggaaaagagtagagcattgcttgcatcatatatattgcaaagtcaaataatggatccacggaaatacaagacatactttctggtcaagaatgtgcatgtgtatgtgtatggttaatttcgtgggtggaaaacggaaaaataaaaataactccttttgtatacctcctccttcatttatttttttttgaaatttgagagagtgcatggctatctttttttttcttttctttttttttcatcatcatgctccatacttgtattagcattttttttcttttgtttttgcatagccatgcttctctccctttttttttgaaagaactttggaggaagaggcataaatgacatggagtatttatttgatggatgaaatgaatgacaaatgggagatgctaacttctagtgtagaagtcaagcatatgtgcgtgtatgtgtgatgtgaccatggctaccacggatgcaaccattgctcacatcatagatgaacaagaagatatcaagatcaagtcctccaagtgctggactccgattcggcaacctgctacactgttgacttcaaacggccgtcaaatctccattcgagctccgtttcggcccgtgagtatttgatggaaagctctcggagtcctctttccaacggatctagcctcattgtgatattccatctcagtgagccgcaattgaagaaacaatgggctgcattgtctgtagtgggcctgtgggcttgtaacttcatttgggaccccggcccaggtggggcccatgtggggtgcgcaccaagctggtggagcacgaccctaggcacccctaggtcgtcctcccacccctatgtatagctagttaccccttcagggtttctcgggttttgatagattaaagtttagccattgctacttgcttgcagcgcgcgtgtcggctagaccgtccgtctgcttgttctttggaaccctaacttatcatttgtattaaattcctatttgcaatatcagattgcttttatcttgttcttgcttgtttcttcgatttgcttgcaggaataaggttgatctgcaccggcaagatcaacaacccacggagaggtgtatcgatcgctaaggcgcaacacaacgtctcatacggttgtagtcggatcgtcaacgtttctctcaaatcatagttatcacaactcaccgaaagatcgggccaacaacagccttgagtgtcgagaggaactcagggtccattaggtagtatcagagctttcgttgctcggtgagttttatctacccataaccagaaaattgccataaaaaaattgtcctgtacctagccatattgtgccattgcattgtttttatcagtttttgctttgttgagttttgtgttacatcgtcgagtcgagttgctggtgttagcgtctagttcgttttgagtttcgagttctggtcacgttttgtaccacagtcgtcgtcgcctccgtgtctctgttgtcgtcgggacctacaaaaacggaatcggcttgctgccacggttctatttttgtagttttcagaaatttttatcggtcagttttggagttgcatttaggatttgcttgagtttctggtttgcccgtgaatagatcggcctttgcttgttgccggtgtagagaggaggaagaagaatttccaaatctgtttttggaagtatgtgagtttaatctggaaagaaatagtagatcagattgattgaaatcagtttccttttttctctcaccatatccggactcctaggtagtgccgcatccttcctttcctcacccaccaccaccccgggtccgcgaccaggccgagtccgagtgtctcctctcggtcacggtttcaatctataccgtgatcttgcatactgcttggtgaaaatttttcgagtatcggattgaaaatccatttgcaaaaacagaacctacaggacgagaggattccatttttgtatagttctaattttgggtttgaacttttacatttgagtccctgtaatttttgtatttacgtttgagtccctgtaatcttacattgaggtccttgaatctatttttgtaaaataaaataaaaaaaaaggcagaaaggtgcaaaaaaaaaaagagaaaagaaaagccgcaccaaaaaaaaagaaaagaaaaggaaaggaaagaaaaaaaaagaaagaagaaaaagaaagaaaagagaaaatactgttatgtttgagctgaacttcatatatcagagttgtgcatgagttgttcctagtgctatcttgtggtatcatttgtgtctaggctcgcgtctctagtacgttctagcctaggaccagcacggtacttgactttgaaccattattcaactttctattctctgatttgagcatttgctatccctttgctacatatttaagcctacccagagctccacaggtctgattgcagccatacagcaagtgtttgccaagacatcgatacatccaacctccatttgggtgcttggttaagtcagtgtacatcaccattctgcttgcattggtaagatcttgtaagagcttggttaaaagcttgagtgtgtgtgatttttgagctgccactacctagtagttaataggaacgcacatatttttgtgtatgtttcttgtttgctactaaccatggcaggattgcgcacggggaaacgagatggtcatgctcaacgtcaacatcttcaccatcaacgagatatagcgacttcttcacgcatcacatatgaggtacatgataatgatcttgcaagggtagaatctaaattgcctggttttgatggtaagtatgattccgccgcttatgttaattgggagctagcagtagaaaaacaatttgatgagtatgatttttctaatgctcaaatgattaaggctgctagtaataagtgtaccggttctgcatctttttggtggcatactgtgggaaataagcttgaaacttgggatgaatgcaaaatactgatgagaaaaagatttgtgttttcatactatagacgtgctctccttgagaaatttgaacatctaaaacaaggtgacaaaatgtcactacgtcagaacctacattttgtaacacaattttgtaacacaaaaagacatgtgttacaagaacactctgtaggaacactttgctttgtgttacaagtacattgtaacatatattcagtgtgttacagttgtgttacatacagtaatgttatctatgtgttaccaacacctacagtaacacaatatatgaaaaaaataaaaataaatatattcaaccatagaacaaaaaaaggcacagggaacaactgaacatgcatgagaacactgatatggagcatttaggctatgaggtgagactttgttatttttcatttcagcaagacaactcattttttaacatggtttatatgaatgtatcatggaaattgcactaggtggatcataaccataaggaaataccaagccactacgactcatcatcactctctatgctcaggattttcgacaggaggtaattcttacccactaataaatttcctggataatcaatgtgttatgtctatatcaatgtgtgagatatgtgtaatgtacacatgctaagaaagatgatgctaacatttgtcaccactgaaaatctagtgctagtaatagttttagtatggatgtcatgctttcatgtaatgctgaaatctgattttagaccattgatatatcatttaatcctgactgacttttagtaaagaatattgtacattttagtaaagcaaggtatgtccatttttctcatgttttctgccgctttgttgctccaactttgtattttattgactattcaattgctcttagtgaatctgtgttcgaagttagaaactaaaagtgatgccaaaattaaagattttctaacctatatatttgattctacaaaaaacaatatagtttttatctagcaaaatcataggatgtaacaaaacttgtccatctgtaggtgaataaacaaaaacagcaaaaggtacaaaagactatgaagagtagagagaaaaaggatggtctgaacaggactacacatgttagggagtactttcatgattttaaaatttgtatcacttatagtgatttacaagaatctaatgagaacacaatgactagatttttcagagggcttaattccaatattcaagctgggcttgttaatgtgacatataatcatataggccaattgttcatgcttgcttgcaatgttgagcgcaaaattttggagaacccaacggagcaacaagctatgcttgtgcctcctatcattgatgttttgcaggaagttcagaacagtccccaaaatgagaagaacgatatgtttgagatgtcacttccatcactcatgaatgaggagaaggctgatgcacctaccttatctgaagagggcataaaaggtaaattaaatgttgcagaaattactcaaggtgagtatgcttctgatgaattacatttttccactttccatgctgacctagagcaaactttagtggaacctacttctgaattgcctttgtcacaagttgatttgcattatgttccttgtgataaagaagagttgtgcgatagtacttcatttatatccattccacaactagtgaatgaacatgctacttttaatcttgattctccatgtactgaatttaagtatgttattcacatgtccagcgagaatgatgaacttcaattgcaatcttctttaaatacattgggctatattatgtttgatgattcttgtgagctcaattgtttgaaggacaaaatatttgctcattctgatttgccatgttctcgtaatgttatatttcacatctttggcgaatataatgatcttggaatatattttgtgcatagagtttacatctgctcagatttaaaacttcctgtacatgtggataaaacatgcaagctagagaaaaatgttattgctaaccaaattgtctcgagtttgccttgttttgattggaagaaacagattgttgtaaatggactacgcaaagagcaccatatggaaaaaccgaggacggttttccatgcagaaggggacgatgatgtgaccatggctaccacggatgcaaccattgctcacatcatggatgaacaagaagatatcaagatcaagtcctccaagtgctggaatccgattcggccacctgctacattgctgacttcaaacggccgtcaaatctccattcgagctccgtttttggcccgtgagtacttgatggaaagctctcggagtcctctttccaacggatctagcctcattgtgatattccatctcagtgagccgcaattgaagaaccaatgggctgcattgtctgtaatgggcctatgggcttataacttcatttgggaccccggcccaggtggggcccatgtggggtgcgccccaagctggtggagcacgaccctaggcacccctaagtcgtcctctcacccctatatatagctagttaccccttcagggtttctcgggttttgatagattaaagtttagccattgctacttgcttgcagcgcgcgtgtcggctagaccgtccgtctgcttgttcttcggaaccccaacttatcatttgtattaaattcctatttgcaatatcaaattgcttttatcttgttcttgcttgtttcttcgatttgcttgcaggaataaggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggtccatcaatgtggaatgtgtgttcttgaccatgaaagtatgaaaagcgtttcactagtgtcacaaaacttgacaacgttcattgaaatgacaagcagcgtatgtagcgagctaatcatgaatgatcaaaccatggctctagtgggaataaaaatatcaatgaggagtttagcatcattaaatgttttttttctttttataaaattcccaagtgtgcaacatgaagagcaggatttctatcatcagaacatatctcattcatcaattacctagatagcatggggtccctattggatatatcaccacaagcaacaagtaatgagcaaagaataataggcatggatgtcattttcagggagaccatagactctaattgtaccatccctagcttgggttcaattatctttaatattttagaattgataatcaaattaaactcaagatagaatggatgtccaaaggaaaaattgtgcaaacctgcgctttgtataaaacagaggacgattcatggtagaggtggttcagccgaactggaggtttggctgactcctcattggttctgactgcatcagttttccttgtgtggttcgtcatggctcatcactactgggtgatcttgctttggttatggcgttgatgtgcaagatcacccccacacttgtctttgtatctgggaggctttattgaacacaaaaagaaaaacaaagacaaaagtgaagcgaaaaggactcacttggttggaagaccaaggagccaactttattttattttattttatttaatctttttccctttttattttaggcaccaatggaaatggtggatatcctggaaggatggagacatgagatgaggatgcacatggtgtatgatattcttaccagatagatcttaccaggcttagaactggatcaaatgtaacaaagttttgcatttgttctgcttggttccttgtgcatctctttcccatggaccaaggagcatgatataagtgtttgaagttattgtacattgctcattgatttgtctttttatttcctgcaaaaggttagtggacaacaaatactcgaagcactacaaagatttgaatgattttattgtagcctcaagattaattgttcacatccacgctaaaaaggaattggattcaaaacttaagaagcgtggatcccacaagtttgccaacattttattttatttttcgagagacagtccttttattctgaaacatttttttttcaaatttttattattcaccaaatttttgtttaagcacaattcatacagggctgaggtaaatttgcatgaacatgctaaaggagtgatcggtaatatacgcaccgtgcaccttgataggtgatatgtttctcctttgcatgttaccaattgatttgttcccggccctgacctacctccattatgaattgaacttgaggactcacccatgaatttgaacactttcctgtagggggttaatccacaaaagatatatatccaatgtctatgaacatattaactctgagattcattagtcaaactaaactccatgtccaatttgattaaagcagactattttaacctaagcgccatgcttaatttaaaaagcctatagatgtcttgcgcgaacacccaaaatagagcatatgcaaatagacacaagaaacataaccatgtaagatcaagtctcattcaaatgaagataagtatgagtaaaaggaatggtgaaccctgttttatttttcgcatacctgagtgtacttaccgccagcatgatgtatattttgaaatctctggggcagtggcatggtcacaaatgattgtcgatttctcctccacctccatgcagattgtaccggaggaagacgctttaaccatgccaactcaggcaagcaagttggtcatgcacacacatcaggtgcaagaaccttgtgccttgaaggcgtgatccattggcacaatgctgtagagacgtaggatacatttctttctgggcaaatgtgcaagtgccaactggagtggagcaggaaacacctagaaaagaagagggcatctcctcttgcttgtatgcgtgtaggtgttgcgggagcaagaagttacgcacagctaggagtggataaagtctaaaccaaggtggcacatgagctcgagagagggactaggtgtagccaggcagcatgattgctactagcgaggtgtatagccatatttcaaagacacgcacataatgcggtctttgatccaaatgtagctcgtcagctctcttgctcttttcttcttctcccattttttttcttttcttttgtctttcttttctcctctttttttttatcttcttttttttttcttttttttctagcaagctaggactaacaccaacttcaaaccaagatggccttggttgatggaactcgtcatgaaaagctcgtcgacctttcccccacacttggacttttgtgtcgcaagacatcaaaaaccaagtgtgtgatgtcggattctcctatcgagtgtgttccaatacccagggtcaccaaagtgtacaattgatgtagctacagtgttcttaggcatcgtatgaccctcgttcttaatctcaacctaaaatggttagtgaccaagaatacctgatggtgcatactatcctaaaaactggttcttgcttttattagaaagaaaacttaccatgataatccagggtatctcccggcagtgctttgtttatggtcacaagcttgaccaacgggacatcgctatgcaagattagtgccacaaacaaataggagatttgcagtatttatgataaatgtaagcatctacaaccatccttctaaacatgctagaaatgtggaccggaaggtggttgtggtcctcgcacagagacgcgacactaatcgaacaggactctagggattccttatgtgagcatgaatcctgggggattttgaaatagaaactttcatgctcatatgtggaatgttttctctcatcctccagagtcgatgtctcaagcttgtccgtggcctccttctcaagagatacatcgtgcaagaacctggttgtttcttgatgataaacaataacaacgctttgaggaccagagggacaaggcttaggcttgatcgagggtgatgagggtcgttccgtttcatgaagatggtcaataggttcagaagaaacgaacgaagatacaaacatcacctcctcgaacggctcatgcttgggatgagcctttgtattgctggaataattcagggtgtttccataatcttcataaagattaattactactactcgcgtaggaacttccttctctatccggagtcctagtactagagcacttagtataaatgctaaacaatgaacctgcaaagatggaaatatatcttactcagactaaataattaaataacataagaaaggaacatgaatgcttactttatagaagaagttctccgaacccggagcagagtataccgatagctccggtactcctcccgaattcctcctaggaagctacactcgtcgaggcagaagtcggatgagcgccaaacttctgggcactcctccagagcttcctctcactctctaccttattctaatgtataaaagatacaatagagcctcttgtaattcagctcaaagttgtgtgtgttggaatgagatgaagacctccttacataggctccaaatgacggttaggggcatgggaattgtccaaaacaccctgcaaccgcctctgggaaggaatccaagccgtccacgtggaagcagatggcgaacggccgcagaacgggttcggccgaattggtgggttctgccgaacccaaaaatgtgtcatcccggcctctcctttggccggtaagttgcttaatgggcccccaataacctgcaccatgttttggcccaattttaaatggtttttattgacttatggggcctccaattcgtgtaaacgtgtcctgaatgcgcagaggtgcattttgtcgcatgacggatgtgttttctcctcaaaatacctgcatacacatattcaccaaaactagtggaaatgattagtaataatacctaccactaagttggataccatgttttatttcattatatgtaggtattgacggtcagatattatgatttaaggaccgtcaacaagtatccgtttccacatcaacgggaaggaagagaagtttgagtttcaaccaaggacagaacaatgctccatggtcaggataaagtacgggccgaacccacagaatattcaagttgttgttggcggttgttaaatgccattctcataccgccaacatctgcataaagtcgagacaataaaacatccaacatagtaataggtgcttaatctcacatattccacaagtgttcgtgtatatttgtatgcagatgataaaccctgaagttgggaggaaaatcagactaaagtgaggagaattatgtatccatacaaggaggggttgtgaacttcattgaaacatcagtaaatcaacccaaaactccgagaaatggatagaggaaggcctaggaagtccaccaaccgaaggccagactaggagggcccagcccaggttcggccgaaccccctggttcggccaaacccttatgatcgccgttgatcccaggttttggcatggacgtcccagatcactccctgatggcggttgcggggcacttcaaacatttccccttcgccaaccgtcatacctacccctatataaagacatcatctcactcacttcaacacacacttccaagcttgagctgaattataagaggctctattgtactatattgtatactagaagaggaagagagtagagtagaagaagttggaagaattccggagttgtcggtaatattctcctatttcttttattatatttattactctgaattcaatataatattcttcttaagtaatttagatttatcttgtgagaattatctctttgttagttcctaaatagcatacgggattattgttcattataatcaactaaaatatagtgattgctttggtgagttataaacactaaagtagatattaattgcttagacgtggtgtttaggtaattattatccagtaattgctgcgtatcatacagtatgttgaggtaggtgtagaggtggtgatagccctcgagatcactgaagtccttcctgtccaggtacatagtagagcgacatctaggaacagcgggttgccaatgcctgaagaattgcgttaggattaaagttaagctttccctagacactgtttctcactagtaaatcctctctatcctggcctatcctttgcttggtgtccttggatgaaccggaggaagatctgaccacacacgttcccttggattcgatacccttggaatactacataggggaagtgctacatcggtatatccgtgcgcttgcggattttgtctgtaatcgtattaaataccaacaagcatttctggcgctgttgccgggggacggttgctgatcatttccgaacccagttcatcctcatatcctttttacttttttattctacctctacccctgctaacctggaaaagttgcgagacggattctgtcttgccttctttccagttactcgtattactgcccttcgagtagaaattctcagtttcaagcagatcgaaaacgaatcaatcggtgcagcttggtccagattcactaatttagtgcaatccggaccaaccctgcccttacccgagtatgtgcttctccaacatttccatacgggtttggataaggagtctgcattctatctggacataaccgctggaggatcgttcatgcacaaaacgtcgtcagaaggaagaacaattttgaatcgtattctagaaaatacttccttcatgacacaatccaatgaaccccagcaggaggcattcgtgtccaagatagaggaacctctaatgatcgagccacgcactgaaccatccacttcagctagctcgattgatgagaaagttcttgagcaaccgtccgtcgaggatgaagagattcagactccggattgtgccgcaattctgttcatggacggcttcgacgaagactacggcaataccctgaactattttagcaagaggaaaccactcgttcctttgccacctcccgatcctatggaactcgggttcctacgagaaactgtctgggtgttaacatccataatgagcgatgaatggctaagggaggcagagctttcatccgaagtaattcggataaataccgctccccgaatcattccttgctatatggaagggaacgacgtcggtattctctacagtccaattgtcggggccaacctcgtctctgagtcttttgcattcgcttatttaagcgataaggcagtgaccccaacaaacaaatttttcaaacatccgaacggaaatatcattggaggatttgggattgtacaagatgtacctgtctgctttgaagacagggaggcaatcttggatttccacatctttgaaatccaaggctttgacatcctaatcatattgcccattgagcaactcctaatcaacacaccccgattaggtagcctcaaaataacactgggagaaaatgtattctcaattccattctcacgggcaaggatcaccttgaccgaccctctcccagaaattgagtcagcggaagaggttaccgcagttccccttcatgagtctcccgaagcccttttggaagatgagttccccaattttatcaaagaagaagcagatcccggtgagactctcgacctgccaatcatggaaccgccacctcgacctccgcttgagcttaaacctctacctccaagcctacgatatgctttcctacataatggcagagaggcccctgtcataatcagtgacaagctctctgaagacgagactcaacgtcttctcgccgtattggaaaagtatcgttctattcttggctactcgcttcaagatcttagggggaacctcaacgatggctcaataatgcaatgcgagaagttgtaaagaaagaagtcttgaaactcctgcatgccgggattatttatcccgtaccatacagtgagtgggttagcccagtccaggtggtactaaagaagagaggaatgacggtcgttgcaaatgctcaaaataaactaattccgtaacgaaccgtaaccggatggaggatgtgtatcgattacaggaaacttaacaaggctacaaaaaaggatcatttcccgctacccttcattgatgaaatgttggaacggctggcaaatcattccttcttctatttcattgatgggtattccgggtatcatcaaattcctatccatccggaggaccaaagcaagactatgttcacatgttcgtatggcacctatgcataccgtaggatgtccttcggactatgtaacgctcctgcatctttccaaagatgtatgatgtatattttcttggacatgatcgaagacatcatggaagtcttcatggatgacttctcggtctatggaaagactttcggtcattgtctgcaaaatttagacaaagtcttacaacgatgccaagaaaaggacctggtgcttaattgggaaaagtgccacttcatagtccgtgaagggatagttcttgggcatcgagtgtccgaacgaggaattgaagttgatcgtgctaaaatagatgttatagatcagtttcctcctcctgtgaacatcaaaggaatctgcagcttcttgggacatgccggcttttatagaaggttcatcaaagacttctctacaatcgctaggctgctgagcaatttactagccaaggatgcgccctttgagttcgatgatgcgtgcctaaaatctttcgaaattctcaaaaaggtactcgtttttgctccaatcattcaacctcctgattggactctgcccttcgagattatgtgtgatgcaagtgatttcgccgttggtgcagtcttgggccaaaccaaggataaaaagcatcatgcaatctgttaggctagcaaaactctaaccggagctcagttgaattatgcaactactgaaaaagagctgctcgcggttgtttttgctatcggtaagtttagatcttacttagtgggagccaaggtgataatttatactgatcatgccgctttgaaatacctgctcactaagaaagatgctaaaccacgcctcttaagatggattttgctgctccaagaatttgacttagaaactaaagataaaaagggagtagaaaattctgtagcagatcatttgtctagactgcagatcactaacatgcaggaacaaccgataaatgatttcatgagagacgacatgctgatgacggttcgtgactctaacccgtggtatgctaacatagtaaactacatggtatccaagtacataccaccaggggaaaataaacgaaaactgaaatatgaaagtcgccgtcatatatgagatgagccatacctatatcgggtctgctctgatggcttactacgaagatgtgtgccaactgatgaaggacttaagatcatagaacgatgccacgcctcaccctacggtggccaatacggtgcattccgcacccaggccaagatttggcaaagtggtttcttctgaccaacaatgtacgaagactcaaaagaattcgtcagaagatgcacaagctaccagaggcaaggaggaatcactgctcgcgatgcaatgcccctcacatacaatttgcaaatcgagatatttgatgtgtgaggtatagacttcatgggacctttccctaagtctcgcaactgcgagtacattctggtggcagtcgactatgtctccaagtgggttgaggctataccgtgcaccgccacggatgcgaagcatgccaagaagatgttcacagaaattatcttcccaagatttggtaccccggaatggtcataagtgacggaggttctcacttcattgacaaaaccttcagagaccttctacgagaaatgggagccaaacacaacgtggccactccttaccatccacagaccagtggtcaagcagaaacatcgaacaaacaaatcaagaatattctgcaaaagacagtcaacaaaatgggaacaggatggaaggatagattgccggacgcactgtgggcttaccggacagcatacaagacacccattggaatgtccccatatcagatagtctacgggaagtcatgttgactacccgtagaacttgagcatagagcatactgggccatcaggaattggaacatggattttgagggagcaggagaatggagaaannnnnnnnnnnnnnnnnnnnaggaatggagagagaaggcttaccacaatgcgaagatatataaagaacggacgaagtgctggcatgacaaaagaattgaaatcaagaaattctagccaggagacaaagtgctaatgttcaactccagggtaaagctttttggccacggaaaattgcgcagcaaatgggaaggaccgttcaatgtcatcgacacctctttgcaaggggcaatcacactccgtgacgattcaggtaacatatttaaggtaaacagtcaacacttaaagattttccttgagccaaatgaaactttagaggaagaagtggatgttattgaattaattgtttatgaaccatggtgatctcatctaatgcatgcttaaaaccatgtatagttgttatttttgtgcttagcttagaaattagtggcaataggaagaaaggtggcggccagccgggcccaccagggcggccgaaccagggcagcacccgttcggccccatttttgaatgatagtctcccccgctagtcctgagtctattttgatgccagtttggaggtagaacgatcggatcacacccctgaagctagttcctctctttcttcctcccttgcaaaagcttctctattcaatctgccattcacccccaagaccttcgatccaaattctttgaacctctaatggctagcaaatccttgattccattcatcggctcttcatccaattccacatacaacctcaccggagagccgacactggcaaatcaattgattccggtggaagaatacacgatggaaggggcgaatgctgtatgggctcaacccctttagctgtgccaggctccccagcaattttggagccgattagcgagctccctggttcggccgaaccaggggttcggcccctcgttcagcagagcgatccctctcccctcgccatgtcacaaggacaaaaattcggggggattcgcctgcgcgatggccgacgacgggagagttcggcttgttaaaggcacgacgcctttccgaagatgacgggaaggccgcgccacgtcccgccgagcgttatgtgggcaccttgttcaccaaagcaggggatgaggtgctccacaagtataccacacccaccactactccatccactccgaaggaggagcgattccgtattcagggagtgcgaactcccggcggtgggtatggtaagggtttactccggccattgacggcgtcggaggagggggcagcggaatcccgtagccctccacctatgaaggtgaagcgtcatttgatgccccctccaattgtgagggctcccagccaatatcaagaagatgaggtgaagtcgctggagccctcgatccataagctcgccgcacatgtgaagaaactccgcaaggagaacatagagcttagggattgcaacgcggagctaggggtagagcttgctgaaattagaaacaatttcgacacccttagtctcggtttgtgcgcttaaatcaagcgtgcattcgtagagctgggaaaggaaaataagtattatgctaattagtcctttcccatgaataaaatggtagtaggtgcttggtttttattttccaatcatgtaagcacttgctatgaataatgtggcacattggtgttaaccccaatgtttgccaaggtttgtttttgttttatgtttaataaagattcaggttttgaataagtgtggggagatatcccagcttctgacgtgcatatgctctgaaaattgatgaaatctctgaacacctgaaagcactcaactctgcagaaaattgcaaagggattgggcaccagagtggttcggccgaaccaagactggccccaacctctcccaatttttacaggtaagcaggtgagcacgtcttttatctgtatatctccaccatggtatagtactagagctgaaaattcagaaaacaattggttcaagcataaatgaaagataaaacttccaactcatgaaattcttcatgtgattgatcttgtatattcattattcccagctgaacttgtgtttgtgaacaaccatccatgtttagggaaccttatgcatctaagtaattgctatatgagagatgattcgagatgaaaggaattcttgcaactcttgttatgactcttgggaatttgttttcaaaataaaattgttttaaaagctcaatcctctaattgacttcatcttatgcctaccaagaccatatgcaagtatatcattgatgaaccttatcatgcatatgactgcttgacattatattgagctttgtcaaattcgtgtgactcatgttagatatccttcatactctcatgatcaagtggtcaattccactttcatttccacatataaaattaagccaagcttctacactgaaagttggctttccacaaaaatatccattcaaataaactcctacattgaattatactttcttctccttgaaaagttcttggcaaaaagaaaatgataaaaggagggaaaggcatggctaaaaaaaagagaaggaaataaagcttgctctcaaaacattgagcaaagttggaaagaaaaatgtagccatgccccttccacaatcatgccaagagaaccaatttggagagaaagtataggaaaaagggataatcatttctttattccaccattccacaacatattttactttttcattttccaccataaataaagacccttgatctaggagtatgatgatcttcttgagtccatatttttggctttgcaatatatatgatgcaggtatgtcacagtttatccctaccaagctccacatattaaccttagaataggaatgaattatggcacattttgctttggtaaggatccaaaaagaaaatatacattcttgagagacaagagaggaagtcaataggagaagagcttatttgcgaaaatttataaaaaaatcccatgagtgtaacagagaagcaagaaggactagaatcaagatcgttccatttatcaattactcaagatggtaagatagccactgataaagttcacaggtgcaggtatggttgtgaatgatttatatgcttgattcatatcttgaagaaatttattctacactaacctttactcagggacgagcaaagggctaagtgtggggggttgtcacgaccggaaataacccaacgggcgttccttacgtgcgtgcattattccttgtcccaggaggcaaggtacaccaaaagttgatacaattcagagtttaacaagcggaagcgtaattaattaatttattacatgggcggcgaagacccagcacacaagaagacaaacgaaaaacagcggaagactagggcgacgaccataggcgtttgacggcaggcacgagctagacaccaaagccttcatcttccaggggctcctcttctgggtttgggaaaaattgagcaagactgagtacaaccaccgtactcaacaagacacacccacaagtgcagaataaatgcaagggagtacaagggggttataatataaagggttagggtttgcagtaaacagcattaaaagacacttagttgctcaacgctattttgtaaacacgattctagagctatacaatattattaaacaaggccgtgaacccacacgaacctgccttaacccaagg

SEQ ID NO: 67232 - DNA, 1298 bp, Oryza sativa
gacatagtttccaacccatcctagccatagacaagagtaccgacccaaccccacctacggcgggaacctctgggacaggtaggcaggactgagcccctagtagcaggacaccggccctgtgccatgacatctcgactaccgggccgcagctcatgtagccttcatttgccctagagatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccaagcccagcctaaaaccattttgagggttttgaatagagggggaggtgtgaatccaattccacaataatccaaccattccatattgtccaggtgatgagaatattcccaaagtctagagttgtaaaaccacctaatgttgcctaattaaccagcgaagcatctacctaaaatcatactagtggtaccatgagtagagtgtctactagttggggttttgtttattctagggtgaacaaggaaatattaacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaccgtcggcttcaacttccacgaagagcggatcttccgaagctgcagcgtctacaagaccaacggaaaagaaaaggcttttactctaataaactccatataacaagcaggaacaaagcacaaaaatgggttcttgacttcttaaggaaaaattagaggcttgaacggtccaattccgagttcaaatggccaagttatggctatttgaagtttatatgctctttaagtgaatatttgcgaatttcttcatttaaattttaatttaaaaaaaagtttattgcgtcagccgaggggagggggcgcgcggaccgggtccacgggagtggggcccacgcggcagcctcacggtccacggtggaccaggtgcacccgggctcacaccggccgacgccgtgggccccacgcgtcagccgcaccagagggcgcgggcggctgacggccgggccccacgcggcagccgctcggtgcgcccgaaggcggccacggcggcgcggccggcgggaggcggcgcgcccgcgcccctatgg

SEQ ID NO: 67233 - DNA, 2354 bp, Oryza sativa
ggtggaatcaatagaatgggtggtatcaattccttccatggtaagaatacatttattcaggcgacttacatgttttataagtcgatgagggttctgtaagttatgggtcaagttgaaaggacgacagcacatcttttttcgaagattcaaacacgggtatgattctcctagcaccaacaccagaaaatagtcacaggagaatatgagggttagttcagcataaacaagaagtcatgattaagatggagaaatgttaacggtgaagtgtcattcaagacatatacagaggtatatattgtatatttatgtctttgtacaacaagacaaacaattgctaaattgaattagtactacatgaatcaaaagggatataaagagaagtataaagctcaatccaattgtacaagtgatctcacatttcctcaaattcagaggctgtttggcaaaagaatggtacaccagctcttgcagaagtaacctaaagcagaagagaacctccagtaaggtgaaaggtacatgattacaaggaaacaaatgtagacgaaaagaatgtgcaaaaaagtgacatatgtatgtagttttaccttatatcccacagattcttcattcatctcttcttgatggtctggtgagccggagtactcatcacattcactgaatgtcatgtaagcattctcaatcagagtcggttgattttgttcgttgttgttagtgggtggaaattttggggatcgttctgtgagaaagccccaagaaggatcatccaaaccgtgttcacgactccttcttagctcattttcagtccatgcaacatctattgggccatctatggacagatgtacaggcatatcctttagaagaaataggttctctgccttatcaaaagtcctgtggataagccgtacctcttcaagaaactcctttgcttctgcttctgtcacatctttcttagaacttttttctgtggcatcatggtctcttctacctttttctgcaatttcactttgtgcaccatctccttggaaaattgacttaacatccccacaagttttactccatgatcttgccttttcaatttgtcgtttcccaaaaacatgtgctggtgatgccctgaagttcttgtgaattttatcaagaaagagattgtcggacttagcggcttctggaaagtgtaagatcataacttcaccagcttctcttacttcatcatctgagggcataggagcttgaccatcaacataccgatgaagaataagaaatgacttaagaagagcattatctccacattttgcttgatgggcagtcacatatgcaccatcccagggcagcttttttgcatgttcaatgaattctgattttgtgacccccaggtatccattctccctaatacgaagatcatcaatcttccctgtgcttctagtaatataaccattgaggtatccagaaataccttcaattagagcacaaagccacttccctttgtagtgcatgtacactaggaaatgaccttttggtgggagagcacaacatcttcgatacgggtgaccaaattcatatcgtgcgtcagatgtattgtagcaccatagacgataatctagcaccgactttcgccatctgtttcgcacttgtacttgagtacctttcagatccaccacggtgtagttctgttttagtaaaaaaaaaaatgtccacaaattaaaagaggcaataagggggaatcatgtctgaaaaaaggtcacgtagcttataaatagaacagcttgtgatcatgttacaccacaaaacatttgagaacaaatacgagtagttgatatattacacatttgataaataaggaaaagggtaaataaaatactacatccgttttttaatagatgacgccgctgttgacttttagaataatgcttgaccattcgtcttattcaaaaagttactgttaaaatatgctaacgtgtaagtcatactaaaaatttctttaatgataaagcatgtcacaacacaataaagcttttgaataggacaaatggtcaaacgtcgtgacaaaagtcaaaggcgtcatctattagaaaacggagagagtatatgtaactattatactttagataatcccatgaaacacatttttcataaaactatacagaagcattctgcattcacaagaataaacacaccacaaaatttgaactccatctaaaagaaagttcactcgcaaactgccatgaccaactgaccatgtggactaatattaggcaaaagatatgaaaaggtatgttttatttgtcaccaccctcacgctaccccatagaacgtatctcctcctcaggcccaccttcctacctcacatcaagggcctg

SEQ ID NO: 67234 - DNA, 4776 bp, Oryza sativa
tggtcaagcgaagtcatgaaatagtagaattgtagttggaaagacatgtcgtatgagctgtgctaatttatggacatggctttaatatgacaagttggtggtggtgttttagcattacattacaactaattagcacatgctgcagtcattgtactctctgttcttgttggattccaacattgggtataagaatttgaactagtcactatttgacagtaaaatgcactcgataggttgcattttggagacatgccacacgtgtacatcttgacgcctaaaaattactcttcatctgtctgcctagcatttgattttgaaggtatagataaatctaggatctgccacaggatgtctgcctaacatttgattttgaaggtataaataaatctacgttctatgccacaggaagggaaggaatgtcattgcttacagattcttccactgcatgtgtctcccatccatccttcaggcttctaaggaccacgtattccattcccatctgatgaggggctgatgcttcaatgccattctcgttctgaattcacctcaccatggaacattcaccgactactttttccttcaaatcatctctcttgttgctttttcattcaaatcaatctctcttgttcccttgttgtatcagcatgggactatttttttccttcaaatcaccttttccttattggatcagcatcgcgaatccaacctcaagttgtagctcgcgttaaccatgccctgcgaaagctgaactttctgatgaattcagagtttcagacgacccagctgcatcctggtaagtgttcagagctcttcccgcctccggcttccccacctcctccgccgccgccgccgctgccgccgcagcctcgcagcaatctctcgtagttccagccgccgccgtcgggctgcagcgctctgagctccctcgccgcgacgctcccgatagagcagttcttgtgagccaggcagcagtgcaggagcgtcgtccacgccagcgcgctgggcgcgaacggcatgccgaggagcaggccgtgcgcgtcccgcagccgccccgcgcggccgaggagatcgatggcgccgacgtagtgctcgaacgcgcgctccaccccgtactcgacctccatggcgtcgaagtaggccatcccctcggcgaccagctcggcgtggctgcacgacgccaggatggcgacgaaggtgctgccgttgtagagccccagcgccagcgcgcgctccgcgaacgccagcgctcgcctcccgcggccgttctggccgagcccctgtatcgcggtgttccacgacacgacgtcgcgcgccgccatctcgtcgaacaccttctccagatcggctgtcgagccggagcagctgtacatgttcatcagggagttgccgacgaagacatggctgcgcgagaggccgctcttgacggcgcgcgcgtggacttgcctccccagggtgagcagggacagcaccgagcagatgtgcaggaccgtcgtgtagattgatgcgtccggcttagcgccgccattgtcgcgatcacccaacctcagcagatcgatgaagaggcggagcgcgtcttctcctcggcggttctgccacaaacaggatatgatgacgttccatgtgaaggcgtccttgttcttcatcgatctgaagagatatagagccttgtcgatgagcttgtgccgcgagtatccatccatcatgatggtccaagaacttgcatccttgaagcgaatcccgtcgaacaccttctcggcgtcacacaacgcgccgaccttggcgtgcacgtcgatcaaaccgttccacacaaaggtgttatctgtattctcctcctccaggagcttgagtgccagggcatggagctgcgttgccatggcgagcgactggagagccacgcaggccttgagcaacgagctgagcgtgtgcgcgttgggcagcaccccgcgttcgtagagctcgccgtagagcgccgcgaacagctggaccgcctcgcggggctccccgttccggacatggcaggacaccatggccgtccaggtgaacacgttgtgctttcccagcggcaggtcgtcgaagaggcggcgcgccacggaggccgccccggcgcgggagaggcccccgatcatggtggcgtacgaggcggcgttcttcccgggcatctcgtggaaaaacgagagcgcccgctctatgcgccctgcgccgacgagcatgcccagcgccttattccaggcgacctggttcttcgggggcattccgtcgaacaggtcgagggcctcgttgtccgcctgcccggatttccccgcccccaccaagatctctggggttttcagggccaaacggtacagcgacggaagctcgtgggccgccttggcgatcggccgcgccgccatactccgccgccgccgccgccgacgaggcgctcctgcgtgttggccactcctgctggccgaggggatgaagatttgagaggtatcatcggcgatggggactggggaaacgacattgatatgtgttattttacatatgaacccttcgagttatcatattttacacatgcgagagtatcctgtttcatgggattattgttacagattacttgctggacgtttataaaatacgttatctcaaaagaaaaaaaaaaatcctctactcactccgtttcgtactaagtttttatttttgaccccgcccttttgttccgaaataagtccattttagagtaatcattatatcagagtttgtgaaagtaagaaataaatgtattgagagtagataaaataaaaaatgattgtattgaaatttgatagtgtggatattctagatttggttttgtattgttatgtgtgggatcggtgaaaaatgaatttgttttggaacgggggtagtacctaattgcttaaattacttgttctaggctatttattaaatttatttaacaaaatatttaattaattcataaattcacagcaataatgtatctatagatcctacatccatgtgtaaaccctaaattacaagactactgggctattaccactattccattgacatcgtgtcaaaaaaaagcatatcatattattggaatgatcagtaggagtatttagtactccctccgtcccaaaaaatagaattttagagttggacacggctatcaagaacgtaagtagaattaaatagaaatgtattggaatggtcagttacaagtatttagtactccctccgtcccaaaaaatagaattttagagttggacaattttagagtttcaccattcacaacataggtagaattaaatagaaatgagttgtgattggttaagaagtgtaggtaggtaggaaaagtgaatggtgaagggttgtgattggttgggaaggaaatgttagaggagaagttgttatattttaacacaaatcctaagtgctaaaagttattatattttgggacaaagtagctgttttatttggccacgaggatcttttggcaaggtgtatctccctccgtttcttaatatttgacaccgttatctttttaaaatatgtttgaccattcgtcttattaaaaaaataattattaattattttcctaccatttgattcattgttaaatatactttcatgtatacatatagttttacatatttcacaaaattttttgaataagacgaatgatcaaacatgtggtaaaaaatcaacagtgtcaaacatttagaaacggagggagtagaaaagtgtgacaattaaattttggcccttgtgatacggttagttaaataaaatgagttctttgtgaatccaatgtacaaaaaggtgagataaatttgtgtagcagtgaagcaaatgactatctaacaaactatgcgtgacagaataaggcaacaaacaaaaaacacctcatcgttttgcttacgctgatacggcttatcagtagaaaaaaaattacgataaaccttttatatgttcttaacaattttaaataaaatattggaaaacagaccacaataaagacctttaaaatcaacttaaaattaaaatttaaattttaaattttggttagggcttataagttaggcacaacaatcaatacccttattgatagacgttggttgaacttttttttttttttggtgctacggtagaatgacccttaccaaagttgggtggcattttcctttcttttttttccctacccttttcggctttgatggccaagcacagcttcctctctccaggtctccatgctttacagaatacttgcatcaaccggctatcagtatatcacaatgcaattttcatttacattcaaaatctttaacacgaagtcacgaacacagttggatataaagtattcctgatggaacccacgaacaacttgatttctctccaatcaggcttcaacaaaaatagaaaatacaaaagcttaaaagccttaaagagaaccatttcatctgtgactacaaggccgcacagatgataaggttttaggaaaatacataacatacagcaacaggagacaacactggtattgtgttgctgcctggttttgcatgcagcatctcaccacaatccagttcagtagtattcatctcaccacaatccacttcagtagtattccttctcaccacaatccacttcagtagtattcgttaccagcgctgtccgaaaccatgtccattgaggtgtcattggagcctccagagttggtctccctattctgtcctgcagagtttgtttctgcattccggcctccattaccagatccttgggttaaatgatagctct

SEQ ID NO: 67235 - DNA, 955 bp, Oryza sativa
taataataataataataataataataataataataataataataataataataataataataataataataatataataataataacatgacgcggaggcggaagccaaggaaccaatcgaattcccgacgaccgaaccgcgagaggtggagggggagatggggggaaagggagggagggagggaggtgtacggacgagggagtggcgctcgccggcctggaaggagagcttctgctgggccatggcctgggtgtagagctgggagagggagttggcggcgccgcagaaggtggagtagagcgtccggtcggcctcgtccagccgcggcgccgcgtccgtcttcctcttccgggccatcgccgccgccgccgccggagatcgtgggggaggagggaaggcggcggatggcggaggagcagggtttgctgctgcgatttttttttctcctcctctcttgtgatttttttccccctcgtcttctctcttctctctctaattttccacgggtgggtgtatacgaggggtgcgtgcccttttcaaatgaatcgtgtggcgtttttggctgttttttggtcaaattcgggaggagttttggggtttttttttttttggctttttgggattgggtttggtgtggaggaggtggtgagtcacgtgacacactgacgcgtgatgatggtgtggaggggggcagcagtagagatggtaccccatgacccaagacctgatgagcttttacactattatgagtcacatatagagatggtaatagggccctgtttaccttttcccgcggtgaattcacctattaggtgtgacgggaatggttaatatgtattcaccatggagaatgaaatggttacaaacctctcaccatcaaggatgacgggggctgggacggtgaactattccccgtcctcacccccacggtgactcgactttactgcatatagt

SEQ ID NO: 67236 - DNA, 5286 bp, Oryza sativa
cacagatccactagaacacaggagtagggtattacgcttgctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcatctggcgcgccaggtaggggactctgcgtgtgtttttctaagctctcgcattctttcgtgtgcgccaagcttttcctgttcagcccaatggctgaacaagcaaaggcgcacaacctctctccgagtgttagcggtgacgacggggagccgaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccagagtctccagcccaacgttggctggacgacgtggccaacttggtcatgacggcacggcagcgcctagatgctggtgggcggtcctccgccaccaagacctctggtactgctaccaccggctccgcgtcgtcaagacggagggcgcggcgagcggcggccgctgttcgccattcggccgccactccttcgtcagcgcctccgacccgggaagatctgcgtggggggccggatgcctgcatcagtatcgagcgccggcgtaatggccgacgtgctgcccacgcaacggagggcgcctcctcgtccggagtgtcacctcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtccgtccactcttgggaggacttgtgccaacagttcaccatgaactttcaaggcacatatccacgtccaggtgaggaagcggacttgcacgcagtacagcgaagggatgatgagtcacttcgctcatacattcagcggttctgtcaagtccgcaacaccataccatgcatccttgcacacgcggtgatctacgcgtttaggggggtgtgcggcacaaccgcatgctcgaaaagatcgcctccaaggagccccagactaccgcggagctttttcagctcgcggaccgagtggctcgtaaggaggagtcatggacctggaacccctccggttccggtgtggcagcttcggccgcccccggatccgctgctcggacagggcggcgtgacaggaggaggaagaaaaggtcagcccattccgacgacgagggtcatgtcctcgccgtcgagggtgcttcgcgggccacccgaaaggggaggcctgcgagcgacaaaaaggaggccagcgctcccagcagggagcgcccaaccggcaagtggtgcaccgtccacaacacctcccttcacgacctcgcggactgccgtgcagtcaaaagtttggctgagcggacgaggaagtgggaggaggagaggaggcaggagcgccgagagggcaagtccccggcggttccttccggcaatcggcgaagagaggccaaacagaaggcccccgccgaggacatcgatgacggcgatgatgacctgggtttccaagagcctggggccaccattgccactgtcgatgggggagcgtgtgctcacgtttctcgccggacctcaaggccatgaagcgagagcttctggccgcggcccctactcatgaggcgacgcgccgggcgcggtggtcggaggttgccctcaccttcgaccagaccgaccacccaccgtgcgttgcccggggaggacaggttgcaatggtggtttcccccactgtttgcaacgtgaagctggggcgtgtcctcattgatgggggagcagccctcaacatcctttcccccgcagcctttgacgccatcaaggccccggggatggtgctccggccgtcccaaccgattatcggtgtgacgccggggcacacttggccgctaggtcatatcgacctcccggtcaccttcggtggatccgccaacttccgcacggaacgggtaaactttgatgtggcggacctcagtctgccctacaacgcggtcctagggaggcccgcgttggtgaagttcatggcggcggtccattacgcctacctccagatgaagatgccgggccccggtggccccatctctgtccatggcgacctcaaagtcgcgctcgcttgtatggagcagcgcgcggaccacctcgccgctgcgtccaagcccgagggtggcgacgagaggcttggcacctccgtccccgccgccccgaggcagcggatagtcacgtgcgacgaggtcccggtcaaggaggttgccctgggcgacggcccgtccaagaccacacgaatcggtggtcttctggatggcaaataggaagacgcgctcgtctccttcctgcgggcaaacgctgacgtcttcgcatggagaccggcggatatgcccggggtccctagggaggtgattgagcaccgtctcgccgtgcggccgggcgcaaagccggtccggcagaaagtgcgccagcaggccccggaacgtcaagctttcatccgtgaggaggtggcgcgacttctggaggccggattcatccgcgaggtcatccatccggagtggctggcgaacctggtggtcgttcccaaggcgaacggcaagcttcggatgtgcatcgactacaccgaccttaacaaggcatgtcctaaggacccttacccccttcctcgcatagatcagattgtcgactccacagcggcgtgcgaccttttgtgttttctagatgcatactctggttaccatcagattcgcatggctagggaggatgaggaaaaaactgcgttcattacccccataggaacttattgttatacgacaatgtcattcgggttaaagaatgcaggtcctacttttcaacgtactactcgaatttctttgggtagccaaataggacgtaatgttgaggcttatgtcgatgacttggttgtgaagacccgcgaccgagaaactttactttcagatctggcggaaactttcgagagtctccgctctacctgcataaagctgaaccccgataagtgcgtgttcggtgtacctgcgggcaagcttctcgggttcttggtctctgcccgaggcattgaggccaaccccgagaagatacgagctatagaacggatgcgcccccccagcaagcttagggatgtgcaatgcgtcaccggttgcatggccgccctaagtcggttcatatcgaggctgggagagaaggcgctacccttatttaagctcctcaaacgctccgggccgtttacctggacggaggaagctgaacgtgccctcactcagttgaaggcgtatcttagctctcccccagttctggtcgccccggagccaggtgaacccttgctactctacttagcggtgaccccgcaggtagttagtgcggcgttagttgtggagcgcgatgaggacaaccctcattccgcgcatccccaccctgtgttggcttggcccgggagagagcagggaggagaggctcccgagccgaacggtggcccaaggcccccgacgaccggagctggccctctgcccgcttgtcagacggtgccaggtgcccccgacccccaggatggcccgggggccactgcgggaaagccgcacctatcgccctctgaccccgaggttaaccctgtgccgactcgacccgggagagagcagggagaagaggcccccgagccgaacggtggcctaaggctcccgatgaccggggttgaccctttgcccgcttgtccgacgacgccaggagcccccgacccccaggacggccctaaggccactgtgggaaggccgcacctgtcgtcctccgaccccgaggtcatcagcacagaagacaagtgcgccccgcgaggccgcttggacgaagagcgccccagggatgcggcccctggcgaagaggatcggccacaccgaaaggtgcagcggcccgtctactttgttagtgaggccctccgggacgccaagacccgataccctcaggcccagaagatgctttacactattctgatggcttcgaggaaactgcgccattatttccaggcgcatcgggtcacggtggttacgtcttaccccctcgcccaaatcttgcataatcgagagggtacaggacgggtggtgaaatggacaattgaactttctgagttcgatttgcactttgaaccacgtcacgctatcaagagccaggccctcgccgattttgtggcagagtggaccccggctcccgagcccgtctcagtccccgaggccagctcgggcccctcgcagctgccccacaccgcccactgggtgatgtagttcgacggctccctgtctcttcagggcgccggtgcgggggtcatattgacctcgccgagcggagacgtcctcagatacctggttcgccttgactttcgggcgaccaataatatggcagagtacgagggactccttgcgggacttagggtggcagctggactggggatccgccgcctcctggtgttaggcgactcccagctagtggttaaccaggtctgtaaggaataccggtgctctgacccgcagatggatgcttacgtacgccaagtacggcgtatggagcgccatttcgacgggatagagcttcggcacgtgcccagacgggataacacgattgccgatgaactctcacggctcgcttcctcgcgagcccagaccccaccgggcgcctttgaagaaaggcttgcccagccgtcggcgcgacctgaccccttaggggagacggacgcacctgaccggcccccgaggcccgtcggagtccaggcctcgggacccgaggggagcgctcccagctcccttagattgattgcttggatcgttgagatccaagcatacctcacagataagactctacccgaggaccgcgaaggaagtgaacgcgtccagcgcatctc

SEQ ID NO: 67237 - DNA, 12037 bp, Oryza sativa
cagatcagctaatcaaaccggtgatcattccagcgtcgtctcatcatcgaccccatgtggattgcaaccgtgcacgccaaccgacaatcaatcattgggtaacctctgcatcaacacgggtttagaattcagagaagatacgagttcgattagaattcaggcatgatcagcagcagtttaattataatttcagaagataagataccatgagctgtggatgttctgctgttcgtctgttactaaaagatcagttgtactagctatgctatgctcgaatgattgtgtttctccatcttttttaaggttggattaatttaagctgctaattacgtaacttgaggaagataatttagacttatattaaattatgtggctgacgtgattttgatcgatgggcgagatgcacatcggttgaatgttgaattggaccgcacctgctgacccattcgaatcatctaaagtcgcgcatcattttaaatactaataatctgggcacacatcgatcgctaatttgagcactgggtttggagagaataaattaaaagaaccaacacgacaaggaacagacatctcattgatcggtttcgccgtcgcaatcggcgaaactatgatgaacatgttaaaaataaataatttaagttaagccgacatcactccatttgaaaatgaagctagtgggatgggttatattatggttttggttagaattttgccatcgattaatatgacctatagctctaccgtaggttcttcagcttatcgtccgtaacaaaaaaatatatttaggagtaatttttattttagggttgattttaatttttttaattttattttcttgcaaatgatcgttaattaataagagcacatatataaaagtttcacttattatttattcttataagttatatgcgaaatgataggattatttaaggccatgttttttaacacttttccgacttatacgttcgtatttttcacacgcgttttttaaattgttaaacggcgtgccttttataaaaagtttctatagaaaaatctctttaaaaatcatattgattcgatttaaaagtcttttttaactaatatttagctaattatacgttaatctgctcgtcgggtgggaggggatctcaaccctaagtaaatgaacacagccttaatcatcttctcacacttaattgcatacagtatcacttctacttttcttttttttttctttgtggaaaagactatgctattagtagctattagtatttcttttgattccttgacaggtgatctgacgcaatttgtagctattaggccccgttcgaatccacttaaaataggggattaaattttggattaaaatagcacgactttcaaactgctaaacggtgcgtttcatgcaaaaattttctatatgatccatttttcaagtttataataattaaaactcaattaatcacgtatttattaccacatcgttttgcgtgaaatacttaatcttcatctttagaagattcaaacaccacctttttaggtatcagaaagtttgcatagcaccatggctagctaatgatggtatgtgttgaggtatcagaaaggtggcaaaggtgcggtcaataattcagtcgaaacagtccgtacatgtgacattctgttagcaatttcggtgatgtcgcctacacaataataagataaagaggatgccgaatatgactgaaatagaaatacgagtactaaagatcatttttttcgcttctgtgcactagttcgctgagatggagagcatcaagcatgccggccaagtgcccatagtacaggttatgtatagtacatgccctcttttttccctcgttatggaatgaatttctattatgtatatttttttcaaaaagtatattataatactctcaccgctctaaaatatattcagtccgtgccaaaataagtacattttgcatggtttatgtgaaacgtttgatcattcgctttatttgaattttttttatgattagtatttttgttattattagatgataaaacataaatagtactttgtgtgattttttttcataaattttttaaataagacggacatcaaacgctggacgcggattctcatggctacacttattttcggacggaggtaataataacttttagccttcaacatttgtcctaagatatgacaacttattctcttctctactaaccacaaccttgcacctcctaattttctcacctagctaccttatcctttcaatcaatcacaactttcacatactttctccgttttataatgtaaaactttatagcattgcccatattcatataaatgttaatgaatctacatatatatatatatatgaatgtggataataaaatacaataaaatatatgtctagatttattaacattcatatgaacgtgggtaatgctaaaaattcttacattatgaaacggagggagtatttaatttcatctattttattgttacttgtgattaacactaaaatattttgagacagaggtaatagttaagtcatttgttcgaaacattcctctttcgaaggtaatgagcgtccaaaaggacaagccaggtgaagtgaactggatgagctcatcgattggctcacctgccaagtacaccggattgggatcctctaacgtgacgtgaagtcagataaacgtgtcgactgatatgtgggcctcaccgtctacgggtccacttgttagtgaccgcgtcggaggatatgcttccaagtacaccgggtgctagctagcctactactgctagtctctagtgagagtctagtctcctctccacatgttacacgttctgagatgaacgcaaacgcgtgatgctcacaccaaacgacgaacagaaacgccaggcccgtttagtacccaaattttttttcccaaaaacatcacattaaatctttggacacatgtatgaaacattaaatatatattaaaaaaaactaattgcacagttagggggtaaatcgcgagacgaatcttttaaacctaattagtccatgattaaccataagtgctacagtaacccacatatactaatggtagattaattatgctaaaaaaattcgtctcgttttttcaggcaagttataaaattagttttttcattcgtttccaaaaacccctttcgacatccggtcaaacatccgatgtaacactcaaaaatgttcatttcgcaaactaaacaggccgagattgagcactgtacatacataaaatccggtgccggggacaagccccgtacgtctcgccgcgcgcatcgtggcgcctagtagctctctattagagcaagttcagtatagccaactattagctctaatttatctatagtcaatctaatagcttattcatacaatagttacatactacactattaatacctggtcccacgtgtcatacacatattatgtcttggagtccgtgctacagctggctataaatttgtagcccgctatttttctctcttcttatttatcttcttaaaatatgtttacagcgtctgctattgtacctgctctaacctctcgtgggttgcctgccggcgatggcgatggcgatggccgagagacgcgtcgtcctgctccgtgcggcgccccgtacgtccaaaagcgcatgcatgcgcatggttggttctggtcgccgtcgtcgctttcgcccgcgtgggggtgtcgtcgctgtcgcgcggcgagaggccagccagggccaccacagtccacagctgctgccagctgattgcgttgcaccgcgcgcgcgcccgaattattaccgccgcggcgtgcgtgcatggcatggcaacgatgagtacgacctctctccgatggcgtgtgagcgtggatagatcggtccaggttctccgcaaagggcaaacgcattcccggccgctggtcccaacccaactgcagttcgtgttaccaactactcccctctccaacactgtaataaggggcggatcctgaaaaaaaaaattagggtgcttaattacacagtgtttcaacccctgttaatttagaggcttttagtttattatttatagtgaaaaagtcgaagagaatgctgcgaagatatctatagatcttgtgaggtgcagggggacttgacgtgggatccgctcctctgcatgtatcatgcttgctgctgcctgctgccaccggcgattcatcatagccgttgcgtacgtgttgctttcctaacaacactgcatgcaactgatggtcgtggagctatatacaagagtactctatctgttaaaaaaaaactgattatgtaaccagtttttttttacgcagagtacggttgcattctttactcgtgttcttaacttcacccctactcgctttttacatgaacgcttcccaaactatttaaatgtatgtttcttaaaaaaaaagttatatagaaaagttgtactataaaatcacactaatctttttttagaaaataatacttaattaatcatacactaattgataagttattttccaactcagtttgtcaaactcagactacagctggtatgatactaaggctgcattcgttttggagaacaaaggatgtgcttagatggtggaaaagttgggaagttaggagaaagttggtagtttatatgtgtaggaaagttttcgatgtgatgtgatattgggaatttggggggaactaaacacggccaaagggagtttgtttgttccgttttccgcgcataggcttcccacactattaaacggtgtgttttttataaaaattttctatatgaaagttgctttaaaaaatcatattaatccatttttgaagtttaaaatagttaatacttaattaatcatgcgctaatgactcacctagttttacatatctttccaatcttctcgatcccctctcactcgagcattagggcacccataatggttatctataggctctctacaagagatctatgtcagtatatttttctacatggaagatattaaatgaagagagagagagcaaagctatctactaacttagagatagtctataaataaaaacgaggcaatgcatgagagagctatagatacccatgtagatactattgaggtggtttactattaatctagtctattgctgagatgtacatgttttatagagaacaccttactttactattacagatacttttagtgtacggatctagtagtcatcggcatgcagctagctgggatcatcgaacgaccaacgtactccgacatagtacgtacggtttcgaccattgattgatttgggtctcgtttgattgtaaaagcaaagctcatctgactgatcgagtttagctagctactgggcaattggggtctttcttttcatctagatctcccggctagcttgatttgcgaaagagtttcctactttcctttgtttataaagtacgtttagtgatcgatcgatttctttgtttataaaaagctctgaggatggatgcatcatcattcatatcctcgtcactgacgataacatgaggcgcccggtcgattggcacgccactaatattattgccgtgtcgctttcagcactgcgaagatagcggtagcaaaggtgcctttgattgattgattgatttttaagggtgattgatacttagtacattacattcctagctgtagcctgtgtttagttcacactgaagttgaatagcagttgggtactccatccatagctgaggatgaaacacaatatgatatctagattcattctattagattatgtcttatcccttatgttgatttttttttgacggatagagtacttcgtatagtctagctatacagtgtcttcaggtgttgcagaagtctgtgtgctgttgaacgaaccagataggagaaattggtgtaatctgcttgctggggtcatcagaaagcaccaggcccgatgatcaagacccacaagacaccaaattggtggcccctgtgagctaaagtaaggatacctttgatttgtagaaaaaatgtagaaattttggaggatttcaatcctatagaaaaaaaatcatatgaaggcctttgaaacgaagagttgaatcctatccaatcctttaaaatttctatggaatgggtaatcctatgcacatttggggaaaagttagcaagagctctaacctcttggaacatttcctctgagtctatctctctcatctgattcctgcgtttttcctgtggtccaatcaaatggtcattcctgtgtttttcctgtattttgcaattctctgttttacaattgtattcctgtcagaatcctatgtttttcctattcctctgtttgttcattcctatgattcaaaagggccctaagctttgcaacatcggcgatccacttccactccatctgaatgctgtcgtatagctgccgttcaggctcaaaattgcaagttgctgtttctgaaaccgatggaattcagtggagaagatgcacaagttcagtaaaacgcttgatcacttgttctgatagtcagatgattaggaagaacacagaagtacaaaacttggtcaccaaagattagttcccagctgactactctgatggtggtgccacatcataatcacaacagttgagaaacatttgttctgatttattaccttgttcaataatcacacgctcttttttcccctgatttattctaattattaagagttcccaacttctagtgagtgagtatcattcttgtttgcgcttttcagacttcactcgaaggcttgcgaacaagattgaatgatgagctatatatcatcttgcaggttgtgatctttgcagcgatgaacgcaagagtttcagtacaacacttcgaatggaatagcgatggcgtccgacgaggcttctggttgcaaagaatctgaccccacacgtcagagtaacaacaagtagcaacccgagttcatgggccacttgggccgctctactacttgggctctgggaggttattaggtccacgcggtgggaaatcacaaggattcgctcgcagcagccagcagcgaaggttgccgttgccggttgatttggtgcgagagtttagtaccacctcgcctgttcagctgggagaggcggtcgcgctagctataaaaggaggccgggggcctccgtttcaactcatacctttctcggccttttggctaagatcaagtgtagtatctgttcttatcagtttaatatctgatatgtgggccatgtgcccacttcgatattaaatttattttttgtgggggagggtccaccacagtggcttgccactggggccctcgcacgtcgcccaggcgttgcactgctgcccgggcctggcgcaccccaaccaaatcaaatttaaaacttttaactctttagaagttggtttaatcacaattttttctgaagagcatgcttttgtaaggggggactgtaatagaattgtttaaaatctaggttaaaatggttaatttggattagcagtggtccttgcgtttacattttccttcagatccatcttgatgctgtaaaacgcatgcagcaacaatagagcagtttgatgattcaggagctcttgtcttcctctccaccccctgcgccccgagcccccgagcatggcgatcctcgcatcccctgctccctctccagctccgtcccgcccgcagggacgcctagttgtcctgtcacgcaagagcttggcaccccactggtcatttgtttgttcttgcagtcagatatatatataggggatcgagatcacctgcggtaattaaatcaatctggagactggagttgcggcgccggcgctgtggacgaagacgacgtagggttgctgcatggtcgatctctctcaggcgtccagtccagtggcaatggacacggagaccggcaccagcaaggggcaacggcggcggcatcgcatgcgctgatgatggagacacggccgaaaatcgcaaccgcccgacggccggtgtatgtgctctggtgaagggcggtgccggtgcaattgggcgatagtttagcctgggctttaggtatgcgcgcggcaagcaagcgttccgccgccggtggcgagcagtggtggtaacccggcggtcttggatagcctgctcgttaatgttttcgaaaccgatggaattcagcaggagatagcagagggctagagaaaaatagagagcgaccacacatcaacctctcaatacgatgaaaacaagggccagagatgcaataagcagtaaaaccataatcaaatcggtacaaattgaacgagaattgttcaaaacaggcatcatcaccaaataatcaacaaatagatttcaacttcattgcttgaagacaacttcaaccttccatgctttcgaagagcagcaagtagcttccatcccgatagaaaaaggcagaacgttcatgtaggaattaagctaaaaccatccgcatagatagatgcaatggcatgcctgagctcagtaataactaagatgaagaacctaactccagccgcactcaacaatacggacaaatattgctaccctgtaaaaataaagttgcatatacaaaattacaaatattgttaccctgcataggacatcgcaaaccagagcagaacctgcaaattacaggaaaaacgccattgtatacatattcagaaaccggcttgacgacttcaaggcaaatgatgctcgtaacaatggtaagactagggtacaagaaccaaaacttctctcttgatctggaaactggagggtggtgagacagaagacgcacccaccaccaagacctgatcattgatgtacccctgtgacccgctgttaacctgcaaatattgttaccttgcatagaacatagcaaaccagatataagcaggtaaagtacacacccaggtaaagtacaaggtaaaggacaaccaggtaaagtacggtaaactgcattgtatacatctggtgcaactggtaaaactttgttcctataattttttaccctaatggaaccctatacaaaatccaagaaagatgaattccttttgcagcatatacaactaatgtttgcaacggactgttactagcaatcttaacgaataaatcatcagggatgcctgtaagcctacccaatctggtactctatctacgaatggcgaaggaaaaccatggtgaaagggatcgcctcctcaatgctccacatcaacagcgcctgcttcgtcatccatcatctacttcctgccaatgaggtgaatgaacatgcttagacaacacagctggatgccaactgaacagaaagtcaacttttgcacaagtgaaaaccatgcatggagttttgccttgccgatttgacatgatatgcaactactattgaacatgaaaaagggtaaataaaaagtacaaattggcagagtatcatgtttccaatgctaaaagctagtttatttttttggttgtaaaagaagatggcaagcaatatcacggaggttccacatgttttacctcgtaactgcactagtactactctcctagaataccttaagaagttgactgtaacaaaacctatttatgtgactctagtatgaaggacttctagcaaaattatttaattaattttggcctgttgagaaaacgacagctaacataacgagcttaaacgtgaaactgtacgacatcaaaaacagaaatgggaactggtatcatgtagtttttaccatatatgatcacacagtagaaaataaataaatatgtgcagtactcatcacgaaggaataggggattcatcaagcagaaatagcaactcaccttagaaatgttagtgcactgcaatggaaaaccagctggctcaattgtaagatatctcaattgacacaagaatctcagcaaagtacagatgaaatccaaattatgaccagaagagtggagcatggcaaggtatttgcaccccaaatgtttctctctgtcagccctaccgagaatgttataacttgaccatggtaaaagttgtaccagatatatgcttattgcatgtcattctcaataatttgaacgcttcacttgtcagatcagcataattccaaaaagaaaaccacaaaaaattgaataatccacaaaagtagccttctcccttttgtagattattattgggttgcacgactgatatatcatcctatagcacaagtaatatatgttgtgaggcagactggcaacccgcaccactagtcagcagaacttgtacgagagcagcagcaaaaagttgggtagcagacagaacatgccagatatataagttttcttttcaatgtccaccataccctataaagtcaccaccacctgaagatcaatgtcatgatcagcaggaacaggattctcctcaggtttattcttggtttgcaaaggaatagattcctttatcttaccattttctgatgctatgatcagtcctttgtcagatatcctaatgttgaaggggtcatcaagaaaaccatccgactgcgtcactgcagcagagtgttcattattttcagtacagtcaagctcttttggacttataatattatcaagctcttctggacttttatgactatcaagctcttgtgaacttcgatgattttcaagctcttttagactattttgattatgacactctttttggcagtcttgattatcgagttcacccaggttattgtcaagactatgacactccttaagaatttcatggttgttgagctcatgcagacagtgtgcttctccaccagcacatatgctttctccagtactatcaagctccttcgtattgttaagattgaagaacatttccatattgacatcaaactcttctatcttgttatgatcaccaagctctttctcagtgctagtactatcaagctcctttgtactgttaagattaaatagcactttcatattgccatcaaactcttccgtcttgttatgatcaccgagctctttctcagtgctatgactgtcgagctccttttcattatgatcttcctgcgcttgcaaacaaatatgatcaccaacttccttttcaaaactatgatcattaacctctttctcaatgatatgaccatgagacccttccagactgtcatgggcaaccagatctgttgggctcctgtcttccttgtcctctatagatctgcttgtgacgtcatccttatcagattgagccataaggatattatctgtttgtacatacggacaaacaggtacatctttcaaacggcatctatggcacttgaaacctatgagattattaacattctcaagagtaatagaatagatgtctccatggaaccaatctacaagaataaacaattctaattagaacaacaatttgtgaaatacaaaagtttgcagtggcaggaaaagcaacacaagtcactgcacaaccatcaaaaaattcaaaaatgataaaatatggttacataaagaagtgataagtaaatgatgctcctcagtatgtccaagacctaaaagtaataagtagaaagcacataatccacaggaaaaggatagtaaaatctgttaatttgtttcaagaggtccaagcaaatttcagattcatactgtccccatctcttagggccaaatatagtcattctatacagagaatgcaggtttaaaaaattacctccacaatcttcacaggcaatataaatagattctccactgtagcatttctggcatagacggcacactggaaaaacttcagacagatcagcatcttcgcagggaaagacaactctttctgtcctaaaagatattgcccgatcatcatttgggttttgtgtccaccgaaggccatctaaccagtatgaataatgagaagcagtcctcctcctctttgctgaacgctcagatatatttgaattgcctttcatgtactttgaatataatctttttgatatacgtttagctggctcattcttgggcacattggctggttctttcacacgcaactctggcaatttattctttgactcattcagcgggtacttcctaggtcggccacgcttgcccttattcttgcccatcttctgcttggatttggc

SEQ ID NO: 67238 - DNA, 3501 bp, Oryza sativa
ttggttatcatggatcttgagcggatttaaagacatatactttattcatatgtgcaattcgtcacgtttaggttatatatatacatatgtcgtatctagtttctgggatatggaaatgtttgttattcttgtgcgcctacttgtggtcttcaaatgataaggatgtgcttttttttgagtgccaaaagagtcaacattcataattgatggttctacattttcaacaaagttatcttctccaatttatacccgtgatagtttcaatctttttgtggcagatctgccagcagcatgaattttttacaaataagaagggtggtcgacatgtaaaattccatacattgataactacttatgaggtcatacttaaggacaaagctgccctttccaagatcaaatggaactatcttatggtcgatgaagctcatcgattaaagaattgtgaagcatcgctgtatacgactcttttggtatgaacagtatttcctgaactaaaaataagagtgagttgactacctggaaagatgactctaatttcactgcccccacacaggaattcagcactaagaataagcttctcatcaccgggaccccattgcaaaacagcgttgaagagctctggtatgcgattttatgtagatttatggttggaagttcatattcttattgtgaataggtgactagagactgcaacatgttcatagctgttgcattttgcctctatatatatttttgttttacctttattattctttgtcccatttttgctgagtgtattttaaaatctgcagggcgttacttcattccttgatccatctaaattcaacagcaaggatatatttgttgagagatacaaaaatttgagttccttcaatgaaactgaggtaaatatttttctctttcaaaatgtacttttctcttgacctagactattctgtcagcattggacatccataactttgcttgatttatttttatagcttgcaaatcttcacaaggaattgaggcctcatattctaagacgagttataaaagatgtggagaaatctttacctccgaaaattgagcggattcttcgtgttgatatgtctcctctacagaagcagtaaatactttgtactaatgtaagtttatgttccttttattcatcattgagataaaatcatttttcctaattaattattaggtattacaaatggattttggagcggaatttccagaatctcaacaaaggagttcgtgggaatcaggtgttgataaatcttgagcactattttattttagtaatgatttcttctattcttctgttcctacgtagtcgctatgacggtgtactacttttatatatgcaaacctttattgcctgatttactcgatgcattattattttttgacaaccaccacttatctttaacttcacaactatttataattaggctgttcacaatgcttgtgtaatgctgattgtccttcatggaatatcctgtatattgtatttgagaaatgagcagtgcatatgtagcagttctttttccaatcgagggctatttttcctgagctaatctgcagttcttcgtgttttcaattttttatgattccattttgttttttctaggtgattcttcataatatacacacaaagaaaatagcattaacaaaacacagattcttctgcaggcacatttaaatgtctggttatttaaattattctagctaacttgattattgcatatgcaggtctcgcttttaaatatcgttgttgagttgaaaaagtgctgcaaccacccatttttatttgaaagtgctgatcatggttatggtggagatagcattggtgatcgcaataaagttgaacgcattgttatgagtagtgggaaattagtgttattggacaagctgttggtaagactgcgggagactaatcatcgtgtgcttatcttctctcaggtttgtatgtttggtttacttgccatttgatgcccattgtgttgcagtctatattagtcgaactaatagtatccaatacattgtctaaacttattttctacaatccattagcaatatgttgcatacgtgcagaaatttgcttcaatttgagaaattagtatggtgagtcaagttaacaacgtggttagttggttgcatagttggttagtgttttgtttgcagaatgaaacttctcttcagggatgataggaagagctggctcagtgtatttgttttgatactttgcagtgttttttctgttcttttatctgacagaacaagcttattcaattggttgcttttgttagttggtaaatgtatttatattttttacaacacaattatggtttccctgcattttgaaagctattgtgttactagagccacatttgtattttacaccaacatcaatatatcggacaacgaatatattatatgtcgcttgaaagcatttgcaccttagataacttatataagtgctttctgaatcaaattgttgcagatggttaggatgttggacatccttgctgagtatctatccctccgaggattccagtttcagaggcttgatggcagtacgagagcagatcttcgtcaccaggccatggagcattttaatgctcctggaagtgatgacttctgttttcttctgtctacacgtgctggtgggcttggtattaatcttgcaacagcagataccgtgatcatttttgattcagactggaatccgcaaaatgatttacaggttcccctctctctctctctctctcatatatgggttttcaatttttgtcttgaaagagtttctcatatttcgggtttttgaatgtgtgatgtcatgctaggcaatgagtagggcacacaggattgggcaacaagaaactgttaacatatatcgtttcgtgacatgcaaaagtgttgaagaggatatattggaacgtgcaaagaaaaaaatggtgatgagcctgatttgtttcatatattgttttaataaatataaacgaataacctctgacttgttctttttctatatatgtcaggttcttgatcacctagtgattcagaagctaaatgctgagggcaggctcgagaagaaagaatcaaaaaaaggtggttccatgtttgacaaggtaagtttctgcaccagttatttagtttacttaggtatttgggttgatttggatgtcatattggtttggtacaacaatattacttaggtagttttaacaatcttttgtatataagatagatttgtatatttgaaatctatctattgtataattgtattacaaaagattgttaaaactaccagtaacttatcaactaagcgattgttagtgatacaggctgtaagtctagtgtggtatatatatgctcatgtgactagaccagccttctttcaagatacccaagctataattctctctacaacacaagagcatttactgataattaaaattctgagagaaatgcattaaatagaatctggcttgtcacctcacttgtattttctgt

SEQ ID NO: 67239 - DNA, 1372 bp, Oryza sativa
atagccgcgccctcggttatgggcaagccgagcaatgtacccaagtcagtgttttaattcttaaaatttgcttaacaactaaaatgtggaatggttggcctcggttggcttgggacgagctgtgacccagggtcgggttgccagttcggtctgaatcatcgtaggccttgggttaaggcaggttcgtgagggttcacgaccttgattaataatactgtgtagctctaggatcgtctttataaaatggctttgggcaactaagtgacttttaaatgctgtttactgcaaaacttaacccctattttattatccccttgtactcccttgcattaattatgcatctccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgaaattttcccggtcgcgacaagctggtatcagagccatctcgactgtaggttaagccaagtggataaaacctaaggacatattttataaataaaactatttgcgaaagttcctctttttctccttcccctaatgctatttgcaaaaggtttactcttttcttccttcttcaaatttcaactagtactagatggccagctttgcgaagaagaagatgtcgccaattgtttgccgaagctccggaagactggaggatccgcttcagaagtgcaggaagcagtgaagccagctgtgaaggagtgaagatcttggagaacccgtcgcagaacctaagccaccctctagtgtttcgtctgtcgtgtgttcctttgcttgtgtgtgtagcgcgtggattgcatcggtgggtggtgatgtaaccatgctaggttgtttgcttaatcaacctgcagaataagcaaaacaaacaacacatcaacaaaaagagttagttcctttaaggtcttatccctagttctggtctattctttccttgtatgcttcccctctcaatctctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaact

SEQ ID NO: 67240 - DNA, 4142 bp, Oryza sativa
agtcgatggttatacagctttttgccaattatggataaagactcacaaatagacttcaataatatgttctccatatgttttgttggttatttttatcttgatacgctagttgctattatttttggactacacttgttttgagtgctagattgtaataatgggctgtagctcttttgagcaaagaccgggatattatattccattatctaaaaaaaatgcgagcattatttaagcgttttgattctacctcttacaaacggatgatagttggtgcctcatggtatatggtactagatatcttttcaagaatggtaaaaactctttttaagtttaagttgatatgaaaagccgcccaactgcaatagtaaaaaaaaggttgtcaggacgacatggaataggcctgatcggctgacgatcgacacaggtagttaggtcgttgatttgggcgatcgtgcaacgggcatactcccaccaattaacgaatccatgcacgctcacgcacacgcttttcgatcggccacccccactatacacatatgcgtcgtcgtctgtctgtgcactttatacgcactacggtgcgttgcgattggacgcgccactgatgcacttccactgcagctaccgctctacacacgtactagcaactagggcataggcaacttttgctcttttgttcttttaggtgttggccggccaccatcactattcagctcagcatcttaattggcacgtaggagatgagctagctaagccccctcgctagctttttggggatataaaacaggatggcgacgcttctgtgaagaaaagagcccgagagagaagagagaatcatgcttgcacggtgagaggtgagtcatcattcttcatcggaaggtacgtggaaactagacattgcaatttgcagctttagaccttttcttactcttgtatgcagagctagctgcaaataacacaatgaacatgttgcctcagctggtcggctatctcgtctaatggattagacttttctggctcatgcttttccattgctgtgtctttgcatcactttgagcttgatggaaaggcgatacaaaggataaatcatggcaaagaatacacacaagggtattcagtgttatgaaacatatcttattatggacgaattaaattataagtgggaagcttactgtagaagaaagcttacaccagaagtcagcttacagaggaaggcagcttatggcgcaagccagcttacagaggaagcaagcttataagagaagccagcttacgacgcaagccagaaggtccaaggcatacgacgtaagcctccaccctcctccgcctataaatagggcccagaaggtccaaggcgagaacaacggatctccggtctcctgcttctcctcttgtagcatgtacttaaatccagaagaaataaagcttccactcgttcatactttctgtgttccacaactctgtgtttggtttgcttgtgtgctgatcaatagaatagactggtttctcaacacgttatcagcacgagactctatcgagctaaaaaggtaaacatgtgagaaatcagtttctactgatcatcttgatctttatatgcaaatcattcttctgctatagttgaaataagcataagaacatggtacctaaagtaccatcccccgatatcctctcagcaatacacgataacatgatggcggctctgccgctattatcgttcaattgctagagttgatacatcctctcagcaacgcccggtaacatgatggcggctctgccgccgttaccgtccaaaggcttgagatggtacatccccttagcactatttgataacacaatggcggctctgccgccgttatcatctaaatgctagaggcgatgtaggtgcctgaagcaccggcatggcaacttaatggacggccctgaagtgtcgttatggatgtcctttgttttatggacatcacccatatgggcccttgatgccgctaaggtcggctctgtcgccatgaagcgtgggctcttagtggggaagtactatatggtttatcttacttttatacagtctgcacaatatgcatgaagtgcccatgtatgctcttcattttttttacatgcttactttgctatttgcatgactttcataacattaattttattgttatgaaattgatttcctagcatgattgataatagttaatcaagcaatctgtaatcctgaagattacttaagttaatttgctaggaaagattctatgggaaactgtgtgataatcctgaagattacgcatgaccaattcatgtcgaccctgcacatcgtatttacctgtcgtaaatactaaatgatgttgcagaacatgtcggacatagcaaagaaggaattcgccgagcttgccttggatggtagtaactacctcacttgggcattggacgttgagattaaactcgactccatgggtctcggtcatactattgtgctgcccgaagttggcactgtggagtctacgaaggccgagaaagcaaaggcattgcatttcttgcgccaccatctccacccagacctgaagtttgagtatatgaccgagaaagatccactggtattttggcaattcctgaaggatcgctttgaccagcaagggtcaattgtgctcccaaaggcacaacatgactggatcaccctacgcttccaagactacatgtctgtggcggcgtataattctgccctccataggatcatttctcagttgcgtttatgtggcctgaagatccctgacgctgagatgatcgagaaaaccttatctacctttcatcacaacaatatagtgctacaacagcaatacaggaactcaaagtacccgaagtactctgatcttatcttagtcctgttagttgcagaaaggcagaatgaggttcttctaaagaatcattctgctagacccactgggtctatggcagtgcctgaagcacacgccaatgttgttggaaactcgcgtggccataaaagaggccatggtgagaagaaagggaaacgtaagggaagtatcatattcaagggcaagagtaagggtaaacccagaggtaaaggcgaactcaagaaggttacaggtgaatcatctggggaaaagcaggataactgctatagatgtggaggcagagggcattggtcccgtaactgccatgtccccaagcacctggttgagctctaccaacaaagcatgaatgagaaaaagagccaacatgagtcccacttcaccattgagcctgaagctcagattgaaaagcatgatgacatgcttatcaatgttaaggatggtggggacgtccgtatggacgatgattgggacaaccttcttgaaaaagatgatgacatatttggaggcttgaagtaatctcctatatgtcagtcatatgcagtagaactttggtcatgaataatgctcctgaagagcacgcttagtcttttactgggcctgaagtccttgtaatgtttcccttaatagaatcaacttactccatgtttaatttcatttatgtttatgttccataaacagacttgggtgggaatcccatggcagaagaggatatatgtctagtagacagtgccaccactaatacaatcttaagggaaactagatattccacaccttaactaagaaaactggaaatattattaccattgccggaagtaatactcatatagtaggcaccagaagtgctactctagttctccctatgggtacctatatctttgtaaaggatgctctattgtatcctgattcaaagcgtaccctcttaagctttaaagatatccgtgcaaacggtttccatatagaaaccgagattgagcaagatgctgaatatctgctcataacaaaaatagatggatatcaaaagcatgtggtggaaaggctcctttcatcgccatcgggtttgtactacacgtacataaaacccactgaggaatatgttccgatgaagaccatatttagaaacccagagtcatttatagtttggcatgacaggctgggtcatcctgggttgggtataatgaggagaatcatcaacaattctcctggccacaatgttgaaactaaaaacttccctaatcctgaagattttatttgccctgcttgttcaattgggaagttgat

SEQ ID NO: 67241 - DNA, 12554 bp, Oryza sativa
agtgacattttagtaccatatgcttctcaccttgtaagttttatgttattgttatttgagtaaatttcgcaaaactatatgttttatggtcaagttacagaaagtcacgcatattttgacacttggcatttaactacatatattttggcagtgtcgtttcataaaccacactatcaataaatggattcacctgtgagatgatgtgactgttccaccaaagatgagggtcaagattcaccaaatcgcttttagtcgagttaccgtcaccacatggtaagacggttatcccgtaaccgtgcggttaccatgacatacggttatcacgagaattaccgtggtttcaaacctaagaaggttgccacgtgttataacagtggttctgtaaaccctggtgagggcattatcaaggcaagcaactcatattgtgagtggcctcaagtgctatataagctggacacacatattccagtacgatgcatgttagctgtaggttagtatctttgattttgtatattagccccttaaatattttttatttaaacataagcccaaaaattcaaactttatacactcaaaaccagaaactattaaaatgtcaccgttctcccccttcctccttttggcaggctagagttcatcagccggccgttggagagttgagacctcaaccctatttgttgtctcctctctccttccttttatcgtcgggtgttgtattcgagcaagaggcgaacgatgagcattttgtctccatgcagttgaaacctcacctctaccatcgatccacatcttttggctcatgcaaaaggagctgcgcgacctcgtcttcctctcggaggtactgccaagaagaatcgcgagacctcgtcttccttgcctctcccctccattctccaacaacgagatcggagcaacacaatcgtaatctagttgctcctccccttttccccaacaccaccatttctttcttcaatccggtgctgatgcatatcaatctagcattgccggtcaacgttctcgagcaaaataatggttagagttgggggacaagcagatccaaccagatgtttcatcttcttcttgttgttggttcttgacgacagtagatgcatcgtcctcgtaccacttcctcatgtcggttattttcttccttctttctcctgcttcacgggcccgacctatgtggcttggtttttctttacgagactatccttgcatgtagaagctttgtgaagtcacttcaccagctaatgatgttactcatccgtaggtgtattgtaaatgaaagaactactctcacatgggtcgctgtcttgctgaaatatgggctaacaagctgtgggggttcatatgtcaaccaccggtaagttatatgatccgtttccattgtgaatgtcgtaaagtacaatcatgctaaatgtcaatcttttgaaaactgaatcccctagcactaaagactactaaaggaaggggcgtacataaatcaagtctaaaaatacagcaatctatagtttctatattgggaatgccatggctaacagtacaaatacggtacgaattggctgtccgctgcaaattggagtctcgtacataaaatctgtcaacagatttataattagtccctaaaataagtccaaaactctccgaaaaagtcatcggatcctaatccattatttagtacagtggaaccaaattgtcacatgccatttcaccatttttttctataaaaggagaactcgtacttttggtaacaaaaaaaaaatcaaggacaaatcattctctcccatctctagccgccgcgacgcgagcgagcaaagcaatggaggactccgccgccgccgctgccgtcgccgtcgtgacggtgccgttcccgacgcagggtcacctgaaccagctcctccacctgtccatgctgctcgcgtcgcgcggcctcgccgtgcactacgccgcgccggagccgcacctccgggaggcccgcgcgcgggtgcacggctgggacgccgcgggcgcgctccgcctcgccgccgtccgcttccgcgcactcgacatccccggcgggtacgcatcccctccccccgacccctcgtccccgttcccgggccacatgatgcccctcctcgaggccttctgcgacggcgcccgcacgccgctcgccgcgctcctccgcgagctctcggcgtgccaccgccgcgtcgtcgtgctgcacgaccggatggcggcgttcgcggcggtggaggccgcgcgaatccccaacggcgaggcactcggggtgcactgcctcgccgcgtcgtacaatgtcgggtgggtgtaccccgcccaccgcctgctggtggagcacggcctcgtcttccacccgcccgacgcctgtacgaccaaggagttcgtggcgctcgccaagcggatgggccaggagcgcaggcgcgcggccgtcgccggcatggtcgtcaacacctgccgcgcgctggagggggagttcctcgacgtgctcgcgcagatcccgtcctccgatggcgacaagctgttcgccgttgggcctctgagcccggtgctccccgacacgcgcgcgcggggctcgccggaggagagcgcgcgcccgcggcacgagtgcctgagctggctcgacaagcagccgccgtcgtcggtgctgtacatatcgttcggcacgacgtcgacgctccgtggcgagcagatcagggagctcgccgcggcggtgcgcggcagcggccagcggttcatctgggcgctgcgggacgccgaccgcgcggacatggacacgcgcgaggccgaggcggccgtgcacggcgcgcgcctcgcggaggcggcgggcgggctccgggaggagatcgcccggggcgtgggcgtggtggtcaccgggtgggcgccgcagctggagatcctggcgcacggcgcgacggcggcgttcatgagccactgcgggtggaactccgtcgtggagagcatgagccacgggaagcccgtgctggcgtggccgatgcacagcgaccagccgtgggatgccgagctcgtgtgcaagtacctcggcgccggcgtcctcgtgcggccgtgggaggagcgccacgacgtcacgccggcggccgcgatacgcgaggcgatcgagagggcgatggcgtcgggggacggcgcggcgctgcgcgcgagggcggcggcgatcggggaggccgtccgcgccgccgtggccgagggcgggtcgttgcgccaggacatggacgacctcgtcgcctacctgacgaggtgatcgtctcgtcgccggcgcggcggctgagctgcactccatgccgctgttcgcgccaaaagatcactgcttgcttagaaccactcttttgaatcttataattgggataatttcgtccaggatttaagctactactgtaataagtttgggactgtgctggttgtcctcgatcctgggcacctggctctctattggacaatttagtactgcgtatatctcattttcttttggctcccagcacacaataagcagattttgctggagacaatgataatttgctcctgtaataataagacaacaagtctataaacatatgcaattttaattcaacaattttagaatatagacttttccatttaaaaacacgtaagggcttgtttgaaagggtccatggatgatagacaaaactgagtttatgacaattattcgagagcacaaacaacttaattaaatattactagctgataaattgattttaaaaaattataagaaatgcaaatgaagattgttttaaaaaagttatacggtttagtagttcagaaagtgtgcccgcaataattccgtgactataattagaaaataatgggccttaagcatcaggaagtcactgaattgacagatttgcataaactcagtaattatatcacattgcttttagattcaaacagcaacactcacacggtcccccttgattccttgttcaatgttcattggaggactgatgtatacagtctattgccctttttacagtaggcagatatggttaaattttgcactaaaaatattagcatatggtcatgctctaacaattaacattgacatatatgcttttttttaaaaaaaaattgaagtataattgatgaatttcccccaatttcatcgcgttatcttctgaacccgccaaaccagcaacagcgcggcagaagaaaaaccccacccaaaaccgccgaacccaatcccgactcctccctccgccgccgccgccgccgccgcgatgccgaaggcggcggcctccctcgcgtccctcctcccgcagctatggcaccgccccgtccagccccctcccttcctccaccgcgccctctcctcctcctctcccctcctccgacgccaccgcgccgccctccactcgccggcggcgcccctctccgccgctgcggtgtccacctccgccgcaaccgtcgaagccccagcgaccgcagcgtaagctgccctcttaccctcagaccaagctgctcttctccgagcgatgaactgactggtggtggtatatatgggttcttgcaggtatccagtttatggcaggctcttgccttgccctctgcaagatgaccctccaaggatcgagcacctcgtcgcgcgggaagacgaggtcgccgtcgatttcatctccaggtcactcaccctccctccactgtaagcaagcacccctatgctctcttttgtttattgcatcgttcatgtgaaattagtagtggtataagagtaaatgagtaacattgtgggtgtgaaggtacgttgcagatctcatcaagtttggggctgtttactatgcgcttgtcgcgccgcagccgcctcctcacgcggctccggagcatgttaggatttttagagaggtgaccgagccttcggtcctgtgccgtaggaaatccattaaagggaagacggtgagggaggcgcagaagacatttagggtgacagaccccaaccagcgcctcgaggccggcacgtatctgcgggttcatgtgcatcccaaacgttttcctaggtaaagatttgaactttgtaatgtagaaaccttctatatattgtgatggtctatgtttgagctttgtttttaacttcccaccgtgaaatctttccggcggtcagtcagttatcaaatcatctcagatgcttatgtgtctgtgttttatctgatactgtcaggtgttatgaaattgactggaaatccagggtaatagcagtaactgataactatgtcgtacttgacaaaccagctgcaacatcagtatgtttctcttctctttcccttttctagttggcatctacaacaacctcatagatttggatttccaaggccacatatatgagaatattggatatgttttttgcaagtaattatctggtttattagtttcacttagtgtgtgttgcaagaatgttggatatgactttcagattgtcgtcgagtaggttacccatttggattttactgattattggttcacacatttaatgtgcaaatatgccactaatgtaagataaaacatgaacacaaataccaagagtgttacttaagagattataattggaagttcttggagttgatgatttaagaaacagcccaattgatgcatctaggcttatgattaaacttttttgaggctcacgtatttttttttcatgatttttttacatgtaggtgggaggagcaactgataacattgaggaatcctgtgtggtttttacttcacgcgcactaggattagaaacacctttaatgacaactcatcaaattgataactgttctgaaggctggtttgtctcttaccattttacttctacaaactaggtatacataagtgtacaatgtaattaagtaatgtcatgattgtttgcagtgtggtattatctaaaactaaggagttttgctcagttttccatggaatgataagggtaagctactttatcgattactatgatatataacatggtattgagcctctagtaatgttgttaaacttttaattttgtgacaggaaaaacaggtcaataaacgttaccttgcacttactacagcacctgtgtctacaggaataatcacacattacatgcgtcctattaatcgtgctcctagattagtttcagaaggtaatccttgaattgcagtttattattgcttctaaaagttttggcgacagttcattcgtggctaggtgctaaaacattgttggctcttagtgtgcaaggtcaaaaacattgttggctcttagtactttaacagctcctagattagtttctactatgcatatgttttggttacaatttacacacatattagagtttgggtgagattcttgtgtactgttatttaaatatatatgcagtcacacagcattgtaaattgtaaccgttcatcaaaggtattgaattaactgtttacgcattttatactcacctattttacgttgtgtcatttgtcatttggcttgcgccattacttactggattttaaacaatggtaaagataccttgatatgattagatttagaactaggatcctacatactacgtacacgtgggcctgactggtaccactaagaattctgaattagtccgtggtcggctcgttgtattctgacctcggatgttttaccatgcatgcatatatcataaatttcctgtctctgttagtagattaatattcttgtcacacttaacagatcatattaaaggatggcatgtttgtcaaatggagatattggactgtaagaaggtcccatggccaagctctctgatcagaaaagtccataaagtagacaactgtggttggccccaacacgaagctgcctatgaatgtaaaatcaatctcttgacaggaaaaactcatcaggtatcagtactattgtattttttgagatgtcaggcttaaatgctaattatctttttgtggagaaggctttttttggggggctcagagaaaagatccatgactaacaaactctcacttagaataggaaactctgatttaaagtttgctttattctagttcaatttgatcataaacatggaccatgtgggtcagtgggccgtagtttcctgggttaggtaggctagcacacacacatttctgatgcttcttttgatagtttatactccaaagtccaaactagtatttgaagctccaccattgatgtactgaaaaaaggaaaatgagggggcaacaacaccattacataagctaaacctgcaactatttccttgggttgaatcatagcccagcgctaattatgttgttgcattgaatgagttgtcaatatgtttttgtttcgttgagtggtatggtcattgccaacattgtgtttatatagagtaacgggtagatgatatggtatgcagatacgagcacaacttgctgctataggcactccaattgtaggggattctgcctacatgacggcagcaatggcagcaatagttaatccaagcataaatccatttggtcgatggggacagaactatgatagtgaagatgaaaaggcagctgctgttgaagcttggatttcttgtcatggcaaagaaccaaaatcagtaattggcctacaagcatctgagatctcatgggattatgaaggtgaacaccattcttataaggcaggagttccatggtggcggcaagatgcagttgaatctgacttgatctgaagaagaacaggagtatatgagaattttagccctgaacctcagcctggggtggctcattttgtgtgttctggcagaggtcggatctccaaggttatttggccgccaaagagaaacataaaaaaaaatgccaaatatgaaaaccacagaatgcgtggtgccaccgatgaaaagcttacacgccaaaaatcttcccacatccttccaaaatatcttgctacagattattctacatctcagatgaaacttactgacagagttgagttgtacacttctagctgttatatctggggtggagtagctcatttgcattgccacacatgcaacattttacttctagagtgtaattttgtcagagttttgcccaaggtgctgtacatcttcgaaatttacatcttttgtcagtaacttgttctggtattttgtactgtcccgagatttgctttcctgcttcacatggcactgtttataaattgaattgaatttgaggtttcaccttttgttctgagctgtggtacacgggccaggcccaagctgaatgtcgacccagacttgaaagctatcctggtgtttttgtgggcctgtgctgaacagcggatgggttcgcgaatgctggcggcttctgctgccactttgtgacgagttgcgattcgtgcagggggcaatgacgtgattgctataggccaacgacacgagttatgacgtatctgaccagacaaatctaggctcccctggggccagtattggttgaggtaaggtttgtactgaacagttaggcgaggagataaagtgaagatgaaaagacgccacaaatccatccctaaaagggagatgattactatacttccgtttgttttgtttgatccgaatatgatacagccatacaggcatggtggggaacagggacagagctagaacgaaatggagggtggtaccactaatttactctattttagatcgagtttaagctcatacgggtgcctaagtttgtattaagggggtatatatatggtgaaaatagatgaggtatagctaaaaaattttcttaaccagtttctgggcacccccttaatatatactagcttcgcccctggagagaaagaacaatgaattacattcaacgtagacatgtaaaccttaaatatcaataagcaattattcacaccaaagttatcacataatttcgataatcctttctacattttcatacacttttcgtcaaaatttaatgattactaatagtaactatatcgaccctatttgtttatgattataagttgcctcgaatttaaaattctaggttggagaatttcttttttatgtgaagtccaccgttaaatttgaagcggaggaagtgtctatttatggattaaatcaaatatacaatatataaacctataaataaaaaatcggcttaaaagcttaaaccaataaagttaagcacaaacaaaaagggccataggctcgcccacacaaaacaccagatgaatggacaacgaaaagcatgcagctacaatagcctaacccagtgaaaaacgaactaccacaagaaccataaagccaagccaaccctctccgggaagaaagccaaacccaaagcgtaaatagagcgtagatacagcactacacaccgacacacggaccccacccccatcccgggccccacttgtcatccactgacccccacccccgtggcgcctcctcacgcgaagaaaaaaaaaattaggggttgtccagagacgaggcgagcctcccgaataccgcaaggcccagcaatacccgcatacaaaaacgcgaccaaaaaggagaagaaaaaaacttatctctgcccccctaatctccccttacccttctctctctctctctctcatagataaccacccccctccccgccgccgccgccgccgccgcgggaggcatcgcgtcgccgtccaccgggtcccctctcccccgcctgtctccggcgatcgccgctttcctccgccacccccgatccgaattttcgaaaaaaaacccccgcggaaatacggagaaaaatcgcggaaattcgttttttagagtgaatcgcacctcctccccacccctgagcccgcctccaccccccgccctcgtgctcgtcggcgacggcgatcgcatcggggaatagtcatcgccccccttgacgggcaatccccccccgcgccttctcttcgcggtccaaacctgagggagacagaggtggggggagcgagcgagcggcgtcatccttcctcctcgccggcggccgcaagaggtgcgtctcctcgccgcctcgcgggtttgtttcttcgcgggaatttgtgggtgaggggcgtggttgctgggtctagggagttgggggaagcctccgccgcgccgatttggaccgccgcgcgcccgatccgcgccccgggaggctcgatctggccgccgcgcgcgctgatctgcgcggcgtcgcgcgaatcggtcgggatttagggtttcggaatcctattcgaattcctcgcgcccgaggctgcgcggcgccatggttgccctcctcctcccactcgtcgattttgaatagagttggggtagagttatttcttcccttgggagagttcaatccatgtagcaccgaaatgatcaagccataacaaaaagcatgacaaaacaataggattagactttgatcgccccatttgaggcgctaaatgttgtcctaagagctactcgagtgggcttctaaactagcttcgtttgatgaactgcagggagtgatagactgctgaggccgtgagagtttttcatgtgtcgtcatggcattcttcagcaactctggaagcagggctgattcaggagggtacaacctgaatgagaaggctgaggatgaagctgcctatgagtcagttggggacagggatgtcgacttgaactctaggcaatggaacttaaatgagaaggctgaggatgcctatcatagtgatgaggagcaatatgatggtggccggtcaggtccgaactcctcggagaataaatctgtgcagaatgcccggaaaataaatgggccttctggcccatggggtacaaactttttgaaggattgtggacccacacagacggctaaggaagagcaattgaccagtaacaggggaatggaatatgggtcggcggctagttcacatgacgacatggatgctagtggagaggatgatgagctgaaccgagggcatggggaggtgcctgctgaggaaatgctctctgatgactactatgagcaggatggagaggagcagagtgattcattgcttcgtggtgggatgcgccgcccaagctgttctacttctggggctgcagcagaatctgtctcctctagacaaaagaagaagccgacaaaatacaatgcttatgaggatgaagatgatgacgagtacaatgatgagaatgatgatgaagacgatgatgacgcagacggtatacttatatctggaaacttgagttagcaaagcagatcagttactgttttaacccgctgctttcttggcagctgcaaagaatacagctcatcattgatcaacaactttctttcttccctattttgcagaagatgatccagacgatgtggattttgagccagaaagtgatactgaaaaggctgccgataaggttatttattgactcaagttcatgccaccccatgccataatattgtcctatgtattaagttacatcgtcatcttattatttaagctaggtggtttagtagtaattctagttataaaagattctggttggtatcttctttcttgaaataaagatagaaaactgccttagtcattgaaaagaatccactctaattgaactctatgttgcttaatactgaatgtttcttaaaagaataacacgctaaatatcactaactgccccttgaagcatctgaaaagcaatcaatgagaaatctgtagataggatgagacacacagaaacaagcaaggagtgaggctcgaagcttggaagattgatgaacctgtgttctttggtgtcttgaagaaggtcatttaatgcattaaatagttcccctgtgaactacctctgtcaactactgtaatgcagctataaactcttaatccgtgagctgtaggattttgtttattttcttaattgaacgatttgatcgcatttgcatgtatactgcattttattgggtgatattatggagaactgcacaccattagcacctgcattgcttattttataaattacgccagacatctaataacaagtgatatgcattcttttgctccttttctaatctataagtttcaatcagtttattatcataacttttattgagttattttcttctgaaatgctgatgatattgagttattttgttattgaattttaggtatttcagcactcttgatcatcaaatattaattaagttcactttcttttgtaacattaaaattttaggataagtttgtggatagtgagaactccgacgaagaagaagatgatgagcttgagctctcagatgatgatgaagatgattttgttgagaataagaggcaatgtaagcgacttaaggttggtggaactaaaacctccaagggaagaaagcttcctgtacaggttcaacgcaaacgaggggtgtcttttacagatgaagattcttcaggaaaagactctgatgctcccagtgatactgatatcagtcaccgagcaaaaaaacccgacaagttgcatcagaaaactgtaggccgcaaggatgttttctcaaatgttgattctcatgaggttcgaacttctggaaggaggaggacagctagaaatatttcatatgctgaaagtgaagaaagtgatgatagtgaggaaaagttagctaagcaacaaaagg

SEQ ID NO: 67242 - DNA, 1705 bp, Oryza sativa
caagcaacaagctgtaggaacccttcccattgatgacaaagaacgttgtagggatggttttgttgccgactgtcagctccacattcaaaactcctttggtctctgatggattgccaccaaaatccttaagcaccatatttgtcttgatgagatcctgagcgtttctgcccaactttctgaatatagcataaggcatcaaattcactgtagccccaccatcgaccattattttggacatcaacttcccattgacataaccatttatatacaatggcttgagatgccgattctctgtaccctctggcttctcgaagactgcttgttctggtgacaaaatcaatttagccgattcttcttcaacatcatcgacatcggcttgcttgaccccaaactcggtaggcaacatgaaaaccatgttaaccgatgcagttacaacactttttcctttggccaatctctttgcttcatcggtcgtggcttcatcggctgcaggaacctgatttttaacacgccactcctgccttggctttgttttctttaaccgatgactgatttcctgttcaacctcctgaaaacgttcccggttccttaatctctgaacccttctcttctgattttttgtaaaaaataccagaaggacactgtcatgcccagaaattcccgaatagaattccaagcagaatgtgcattaaaatccccatccaggaccggccggggtacacaaacgacaatgttgacattcagatccacgtcttacaaacatcataaaagtcttacataaatgcagcgggaaaacggaagacaacaggagctaagccttgactagaactgcagcgggaacaccactccacaggcatcctcgactacacggacgaagcctactcctcggagaaaccttcatctgacacatactcgtgctctggggttgggaaaaatagagcaagactgagtactacccactgtactcagcaagtcataccggaataggggtatgatgcagggaattatcaaagaagagctagagtggttcatttgcataaagcgagcatttataaacagaagttgaaagatttaaacagttataataattaattaatattaatcatccactgtccaacgctataccacgttgcgacaggcccaaccatccacctaaactatccaaattcaaaagattacactagggtgagactaatcacggtgaatctggttgaccgcccataaccgcgggctcggctattcgaatagttttactctgatcagaggtgtacaactgtacccacaagacacagccccacgacacgtttccgtgcgccgacatgccaccacgacataccggaaagaggccgtgacaggacccttcgtataaccccctctaaccaagcacaccacacctcaggtttcacccccactcctcgcaaggtagcgggcagtcccctctcatgcctaggtgaatccagaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtg

SEQ ID NO: 67243 - DNA, 8634 bp, Oryza sativa
taaaaaaaaaaagcaaacagaagacaatccttcaaataaaagcagctattctcaccttcccttctccagtgctggtgacaatatcaattgcatacacttcattttcctcaaattcagcatcatccaccttcgtatcagcattggacacactaagtacaactttgttaccgtcaatgacaaactgtttcagctgatggctgagaactccttccacaattttgcagtcataagcagcagcaactttctgaatcgcttcggtgacatccttgttctgcaaaagaaaaattgttactggcaagatcagcattctaatacaaaccaaaggcatgcaactgaattaattcattgcagagaagacatacaggttagctcactaccaaacagtttttgtgtgtctagcaaaacataatagcatagtaagagaaacaagcacaacatttgtgtgcacagttgacctagacactaaatgtgaacagcataaattgcaaaaagagagcaagtaaataaagcaacgcttttcaatgcaccttcttcccaggtctaacaagcctcagagcaacttctgccgctgtgttggcagcagcaagaacatctgctgctttcccagtgactgctccatcatggataacatgtgtatgagccaccacggcaataaaaccatcaatatgacatcccatatcactgtcaaatgaaaatagaatcattaaggctcaaagtagactaagaacaagttgaaaaggtcagaacagcacaatacattttgaccatatcattttcctccaggactgcctcatcagtggctagcggagagaaatggcagactgtgttgttcacagatacacatgttggaaaagcaacacctctttcaatcttcctcttcacattcttgtagatgttgccagtttgcctgatatcaataaagaaaaaaaataagtaatcagtaaaacgagagagagagagagagagagagagagagagagagagagagagagcattaagacaaagttagatgcattactctcttatgtaagaatcgcccttctcacagatgtcaacaatcttggctttcggcttgcacaaagacactaccaacttaagagcatctgttcaccaataaaaatcaatttagcactacaattctagtatcaccatagaagacaacatatttggcattcaggcacaatcgcagaacaaaatgatattggcactgtgccagcataattgaatggacaaaggaaagaagggaactatcttaacacatattactcacaactcctctctacttgtgatatctgaaacttatattgagttgatactacctaactacgaacatcacatatcagacttgcaaactgggcaaaaacaaatatcttagcaaaaaacaacctttttggctcaactaaatagctaaagacggctacgctaacaaaacaaaacaaagcctgtggcaaatctaccctggataacagagcaccattttcccctcaacaaaacatagaataatcacctcatacatgtaagagcaacaatagcggagtgagggacgggagaacgtagaggaggaactagtgattctgacaacaccagacatcagaacacaaggctaaacacaaatgcacatccctgtgcaatccagtgagtggctctgtggctatgcacatgatttctcgacaggcagagactcagacataatattgcactcattgaatagaaagccagtgacaatacagaagaagagcatgctactaacctagaaagaaagcatattactcttcaacgaagctgctaaaactaacactagaatccaaaccgtgtaaatcgtctacatcacagaaattcttcccttaccaaaacatagtccataaataaaacagctaaactcccgtagctaatctttcccaagctaatctttcccaagtaagacaaggtaacgctaacaacacagagcataaacttccctagcgtgcttacggataacaaaaccaccgccattacccagcaaaaagcagacaataatgaactcgagcacgacagtaatagcaaaggtaaaatcgagaggcgtttattactgttgatgatatcggcggcgtccttgtacttggtgacgacgtcggaggaggagaggtcgagctccttctcctctctgacctcatcgtccgacgacatctgcaaaacgagagcgccaaaaaccggaaaaaaatcagagaacgcgaagggaaacgcacgagacggcccgaatcgaaggcgagaacgcgaggaggaggagacgcgcgaatcctcaccgcttcgatccgaacaggcgaccggaggctggacgtggcggtggcggtggcggtggcggcggcggcggaggaaggggaggtcgtagtagggttagggtttggagggggtttgggggggattagaattgaagcgagggggagtgaggttgtgaggcggcggcgggggtggcttctgtacttggctagggcttcgaagtgcgcgggggatcacgtgacactgacaggtgggtccatgctgagacgcttggatgacgagcggggccctcctcttgcccggcaaccgtgggtgggccacgggagaaaagctttggcgcggcccgggcgagccacgtgaacgggtattgcggaagctgccggagttcgctgtgatccgtccgatgagacgattggtagatccaacggcgtgcgttggttttaatcgtttgtgcctgaactggtgggctgcatttcggcctgttttgggtgttggcgtgatcaaaccgcggcccatcaagacgggtgcttctctgcttccgtatcaccggcccagctagtaggattgcagtgttcatactgggaataagtccattttgactccctcacaatatagctccaacctcattcatatccctaaaccacaaaaccggatatcttgacacccttaactataaaaaccggtgtaatttaactcctctaacggtttttaatagtggtttcactgacgtggtgctttgacatgatctatcctaataagacatcatgtgggacccacatgtcattctctcactcatttttttctttctcttcctctctctctccttcctcttcccgtagaaagcacggtccggcacagcccgtaaattggccgggctggcacagcctgtatgtgggccgtgcctggtcctagacaacgggcacgacgagcggcatagcacggcacagcacgactagtgggccgtgcttgggccgacacgacacgcgaacggcccgtaggcacgacgaccgatggcccatggcaacgataatggcctatcaggcctagccactagggcgcaagcacattggcgtcaaaggcttagcggcgtcccttcgtcttcgttgcacccgtgacccgtgcctccgtcgtcgcgcatgctcggtgcctcctcccgcttcgcatctcgttccaggccccggcaacaagctcggcaccgcagtttgcaggtctaggacgcatctgagcatctctggccgcccgtcacacgcgcgtatgagtctacatctctatgagatgctcagagcttctcctgcaagaatgcgatggtgtccggcgattcccttccgcattggcgcaatgaatcgaggcgtcgctaccactagtccattactgtcatggtgaggtcgactggtcgagtaccggggatggggatggctgatggccgaacggacgcagccatagcgtcgcgcggcgtcggacaccacctgcgatgtaccgctggacaaacagagagctcggactagtacttgtgattcccttgctcggttgtccttgccctgccccgctgctgtccgttcgtatcctggcatcaccgtttgccgcctcgccacgagcccacaaccgcaagacgccgtggcagggtagcgcccgccttggattgagatggagatgggacgcctggtggcagagaagcatgggcatggcgcatggccattggttgtgcgtctatgtctccatggagccagcaggcagcaagtgtgttttgtggtgtgtctatgtgcaagtgtaactagaaacaactagctcatgaaggcaatttgttctataaattcctcctcctcctcttcttcccagcaaataaaaaatgcagcacaaataaacagaacaaaagcaatatagttatttccctcccacaacaaaaatgtggggtgatactcgtcggaggtcgacctcatcgagacccccgcaaaggctcgcctgatccttcccgtaggtcggtcgatcatcgccaactatccccgggtatggacgattaagggatggatgaccgccatatggatggtctggagggacatggggatgatcctacggaatagcccattcccgaggccaacgacgacacggtcttgcccatgccgggaggcgaggccaagctatccacaccatctgcacggagagtggagtgttggcggcacttcgaaaaaatgaaggtaatggtggacgatcaacttgtaacacgtgctacttgtaaacattatgggaaaactttgtctgcatcttctagttcaggaacaggacatctcaaccgacaatatttggcgcaccttaaggataaagcaatggtgggagcaaggtagacgcaactgagcttctgacccgacggttctataagtacatggacctatgagccatgagtagctcaagatgaaaattgctcgttacatagttttggaggacctaccaattaggatgggtgaaagcaaaaatttgagaggatggtctggaatgctttttgtccaccgtacacccaagtttcaaggaaaaccaccaaaaacgatattgttgtgttatatcgttctaggttggatgagttgaaacactcgttcagtactcttcgtttttcttttgttgtgacatctgacatttgaacatccaagcaccaaagaacctcttatgttactattgtcatgcattatcttgacaataatcgcacactaaataagaaggttatagggtttaaaatgatgttgtcacatactagacaagccactgctaccatactactagatgtactgcaagaattcaatttaaaatctagggttatttctattactcttgacaatgcatcagcaaatacaacggccatgacgattttggagccaaatctacaaagtacattggaggttatgttatccattagagatgcatctaccatatcatcaacctgattgtgcaagcaggtattaggagtcgttgagaatttatagattttttagtgcaaataatttatcaattttaatgcatccgtgacaaggaatttattgtctatgcaggatttagtattattactaatttactcaaaaagattcgtcaagttgtttctatcattgagggtcaatcagtgatgaaggagagattccgggactattcttgagcaaagaataaacttgtgaggatgcttggcattgacgtgaaacataggtggaacacaacatacctcatgttgcgtcaaccgaaagggtatgaggaaataatttctgttttcatcaattcattgcactttagaaacaatgatattgataaggatggtgatggtgagattttgcttcttactgaggaagaatggaacatagcaacacgtctgcgtatattcctaaagcctttttataaagctacagtcctactatctagaatttactatcgtacttcttgtaaggtgcttgaatgtctttggaaattgtcccttgtgtttcaaaaaaaccgacatgatagagttttagcttctgttgttcaacccatggaagaaaaatttctcaaattcttcactgctattccacacctttattattttgctttgatacttgatcaccgtaaaaagttggaggttgtggagactgctttctatcaataggtgatgcaatgagtcttgattattttgaagcttatcaacatgctaaagatgagttgttcaaggttttccgtctgtaccaaactaagctaagtgttgctcgtcaggtgcctgaggaaaccccacaaaaaaagcaaagcaaatcaagtgcaatgaatatgtggaagaagatcaggggcaagaaacaagcctcctcatcaggtagtaggtcaaattggaatccagatgcagagcttaaccattacctcaacaccaatcacacaaaacatgatcgaacattggatggtgaaaatttcgatctccttgagcggtggaaagagaaagaacgaactcttcatgtgctagctcactttgcacagggcgttctattggttccggtttcctctatctcttcggagcatgcatttagcgaggttggaagaattattgaagaacagaggtcatgccttgcacctgacacagttgaggcaatattttgccttaaagactggattaaagcatattaagcaaggacacaataccggttagaggatccaaagattactgatgcagcggcagacgcattgatggaatttggcatcaccacttatggcagcggtgccaatcgaaattaataatgcaatttctgtaatagtgtaagaaagttgtactcttttccttacagggggaaccctactctagggtgtaaggtttttaatgaggcaacaactttgtatccttattataaataaatttgtttcctgcccccaatttttacgtctcaagttatttgtagtcggtttgagaacaaaaaaagtagtgcatatttttatacgagataaatcaattattacagagccggctgggcaaaaaagagtgtggccatatcgttttccatactctatccactgcacggctacagcacgaggtcatcacccacccacacacacgaggtcgcaatttcccatatgcaggtatctagcaagtagcagcaggtgaacgcctccagcgtcatcggcctctcatctggtcgctcctcgctcgtcttaatccacatgaggcagcgacgggcgacctacatggcacgggctatggcagtgtcgtgcggccagcaccagcagcatcggcgctaccacgccggtggaccacgtcgtcagatgagccaacgaggaggagcgggatgggcgtggccgtcattgccacatcgccgtgacgagacgacgaagccacacaacaccattgccacctacccgcctccatcgccatcactgctgccgacggagtgtcttctcgggcccttggcactgcaaagatgcacttcaccgtgagtgcttttttattgtgataagctgacgaagcttacttcattgtgagtgtttttttatcttgataaatccattgaattgttatgctaactttgtgctgcaaattaaataagaaatttcacctgtgcagcaatgtttgcatgaatttcctgataggaacaataccatctgatggttcacttgtgaattttaatgaaacttcgtgagttatgttctctatgtttttcattcctgtctaattcaatatatatatatatttcagcaagcagagtgggggatgtcgtgtgatagagtgcttttgtttacctctccatgatgccctatactacttcatacttgtaatatatcatactaggacttcatgcacgcttcacggtgccctaccgttcattaagaggtatatactttacgaaccattattcaataatcttacagagcaaaaaataggaggtttatagtaggaacatatagtaaatttagagcacaatgttcggttaaatataggtaatgaacgtgctagcacaaccgcatttagcttgctttaagttaacggatcgtacaatagataagataggcatgtatgttctagtttgtttttgtccacagtacatataactatgtattttcttacttagagggatgcaactatcgtcgacgcctacgaagttcgagaggaagacggcgtggtggcaccgatgatgatccgccttcaacaaccccaaacatcagagttgagctggccttgcgcccattggaatgtttttatgattggcagtcgagggtggttcttctcatattcacttagcgcctctctattgttttcacttccactgtcttcatcgcagtagtcaaacaacttctcgatgtgaatcagtactgtagatgaatatgtgttttgcttccaatcgagattagtgtttgttggttctcttcaattatgtcgatgttccagtctatcagcttagggataagatcacagtttgttgtccatgcagctagcctgaaaaacgaaagatcttctatatgatgctctacatacaatccttcaatcttgcagcaattatccagcaattctgctatgccttccttgttccacgcttctagagcaagtatcaccctttgacgcaatgggttcacagtactatggaaattcattttgaaaggctcaaattcaagcttcgttgtttgatatgtgaaggattcttgtttaagcgccttctcagatttttcttcttgtttgtctggacccatgaatataacaatgtacattctacgccagaagggaagcaaggtaaaatcatcaacctcacagttgcatacagtgttatcattgttgatattttggttgtagttggattgccagctccaaacactttgacaacaactagatcacggtatattatatctgcaagtagctgtgaaacttcctttcctttggaaaactttgatgctgttgttggccgg

SEQ ID NO: 67244 - DNA, 3790 bp, Oryza sativa
agtagtcaagctagttaaaattgaacttaattaagacacatgctcatcatatatctttgtggtcagactaattaccatttcatccactcaactagccttttgcttgccatcatagtaccctagctagatccaagagataaagatttttgcggtaccaaattttatattgatgtacatcgctctgatctcaactttcaaattaaccctcctatatatcggtaaactactacaaatctagccatccatgcccccacatctatgacgagtgaaagatccccatctcgaatgactacatctttaacgggtgataaagtggctatagcattctgacaccacccctcgcagatgaccgttaccacactgtgagttcttcactcgatcgacacatataatgcattatgaccaatgacatggcattcgatagagatgagagttacgatccatcacaaatgaattgttctattgcagtagtatcggcaaaaactgcttatttttttacaccccttaatcttcaacaaaggaggaggttatatccttcccaactaactgggacgatccttgaatattgttgcaacattcatggcttctctctcgactggccaacagacggtcaggtctactacttgctgcacaatatgacaagctgcgtgtcggtcttgccatgtacagtagcacagtacaacaacagtacagtaccttctagagactggactactgcgactacctgatagcatgcatgcatgtcataaaattaatctccatgatacgaacttaattagctcatcatggagcctcagttcttagctagagtgtgcatgccgcccgaacgcagtacgtacgtctgtgtagcacatcacaacaatacattagtgacctagataggctagctagcaatgcaatgctggtattgtcgttgcagcatcatatcatctcctaattgaagacgtacgtacgtacgggattgtgttggtttcattcgtcatctgctaccagctgcagatttcatcaagacaatgcagttcagagagatcacaggggccagtcaaggcttgggtaaggccaccaccaggctggtctaagctgaatgttgatggctccttcagtaatagcagcggccaagcaggcatagggatgatcctcaggaattcagaaggataatccatatttacagctcgtcaggttatagcaaattgtgttgatgcgttggaatcggaactaatggcctgtaaagctggactggctttggctttacattggtctatacttccaatcgtccttgagtctgacagcatcttggctgtatccgtgattaatggagaaactgaggacaaatcaaggtttgcttacttgatacgagagctgcgtttcgctccagagaggagaaagggaagttaaaattcagaaagtgcatcgagatcacaataaaattagccttgaacttgcaaatagtgctcgattagcaaataggtcagatttctggtttggccatgagagcaactgtttctctgcacttattctggaggagtgtaatcactctcatattgattaatgaattcccttttccccgccaaaaaaaaaaacgatcacagctcgatctccctcccttctccgtccaatgctccgtaatacttcctctgttttaaaagaaaagtctaatattaagaaattcagaattgtatttttttttttacagagggagtacatatgttcccacctcttatgattttactatttgaaattatgtatcatgctctcattactgcgctaatgcatgagtggtgccgatcagctcctccgttgatagcacgttttgaatgagacaacagctatataaggattttatctagaggagtttctgacagttgcagtattttttaatcaaaagttctttaaaatagttagtttttcgttcagatcttaggaaactatagtcatataatttaaaaattaaactttaaattactttctcattagctatttcttataatataaaaccaataaataagccctaattatatgttgtctaactagcgccgccagctggaccacggatgaatcatcattcatcagtggactggacgatggatgaggcggcatcctatcgcccacacatgttttcaatatgtttgccccaagacaagctgcaaccccagcaaggaattgaattgcgtcttgatgccgtgttaattaattgttaatgcagatggggatgtggcgtcgccgctgctccctccattccataatttttgggtgttttaaataaagttaaagtattttttataactttaattattaataattttaaaaataataaaagtaaaggcaatagcacacatagatatgtcttagaaagttttataataaaaatatatttaattattatatatattataatagaaaaacatagtcaaacatggatatatttcagagactatgtcattgtgcaaaatatcaaaaattatgaaattgaatgaagtatttattactatcgtgttctatcataagtgcgtgagagatagactcaaagagacacgcatccatctgtatgccataaagatgttcgtatgcatgcagccaccggtgtacagggttacctaataaaaaagaggctcacgaggcgctatcttcggtttctatggaatgtctattaacttattaaaggaatagaaaaagaagcctccgcgttcgctttcatagtctagaaattctcacattaatcggagaaaaaaaatgagtccatatagaaatacaattttaaaatagctaaaatttggaattgaaaataaggaatataggaagagaagactagaatccatatcaatatacaatagaactaatggaaattcgaaattaaaaaaataataaaattaaaagtatatgttagagtccatacagaaatacaatttagaaataaagaaaattcgaaattaaaaaaaaggagtattgaaagaagaatacagagtccatatagaaatacaatttaaaaataactgaaattcagaattataaaaaaataaatattgaaagataagtttagagtcgatatagaaatacaatttagaaataatagaaattaggaattacaataaggaatattggaagaagagtacagagtcaatataggaatttagaagtaattaaaatttggaaaaaaataataagtagagtttagagaacacattgaaataccatttacaaataactaaaattagaaatttaaaaaggaacattggaacaatagtctgtataggaattcaatttagaagtaattgaaattccaaatttaaataacactgaaagatgagtttagagtccatatagaaacacaattagaaatatcaaaattcaaaattttaaaaaaagcaacattagaagaagagtttagagtccatataaaatacaatttataaataacagaaatttggaattgaaaaataagaaatattggtaaaggagtctagagatcatataggagtataatttagaaattttgaatttcaaataagaaatatagggataaaatttataaattatagaaattcataattaaaaaaataaaaaatgttggaagagaagtcaaaagtccatatagaaatgtaaattagaaataacaaaaaattgatattaaaaataattaataactatcatgtatatacaacacaatatgaagtttggttaagttagtgaaaaatttaaattatgttgctattttaagatattttaataataaaataagaaaaaatatatcgtattatatgagagaaaacatcaggatgctagccgtgcaatt

SEQ ID NO: 67245 - DNA, 21929 bp, Oryza sativa
aaaaaagttgaaagttcaaagaaaaagtttggaactaaactctccatagaaactagaataaattgattgaaaaaaaaacagtaaccgaacatatatatagcctattaaaatagaaactagaatgtggtcaagttaagacatggcatattttagaaaaataaaaattctagcaatgttgtaacccattgtcataaaaatttggataagagtaaaaaaacttattacaaatacaatgaacaagtaaaatgagggaaaaaaaagaaatgccattacaaaataaaaacatagcaaaatacttagacataatggtgaggacattgggacaggatcctaatatcctatgggacaggatcctaatatcctataccttcaacgttagagacatatgggttttgaaggtaggatcctaatcactatgggcacttttggaacataggatttataaaaaattaggaatagtatagaaacgcatatgaaaaaaaaagagggtttaaaaatatggggaggtgggatgtgatgtttgtagcttcgagcattggtttattttagatttggcaaaggaaaataataaatactccctctgttcagattgaattctttttgggacagagagagtaggttgcaagagcatctccaaccgattgactattttgagctctcaaaatgctcatttggccagtcatctaaaaaattagtgagccaaatttgcctttcactccaacattctctccattctagcaatgggatacacacatcagccctatctcctttttttctcccttctttgcacaacctctcccctcacctatcaccgacgctccaagacagcatgggagagcaggcgacagttggcggttgacgagctcgatggcggcaagcggatccaggcggcagccggcgacatgggtgggaagcggcgacgtgaacgtccctcatcgattcccccgtgccgtcggtgggcgggcaggtaggcaaatctgacgaaggtgttggcggcgacggaaatcggcggcaacggtgacaacgttgctgctgctcgcactaatgagaggcggaggcgatgccgtgggctgcggctactcacgccgacaagggaggcagcgggtgggcgggcgggtggatctgacggcggcggaggtggcagtggaaattggcaactacggcagaaatcggcgatgacaacgacgttgttactactgctgctcacaccatcgagatgtagtggcgacgccaatgccaacggtggatcctcagctccatccctgtccgccgccgctgctccaaaccgatgcctttgctgtgctcggatgaggaggcggagacacaaagtggtgtggggcccgccatttggccagtgagtttgcctctccacatttggccaggcagtggggacgtttggccagtcgaatggcttagccatccggttagcaactctattggagtattcctttttgcttgacttgctaaaatttagcttggagaggcatttggagagaccgctggagatgctctaatagatgttgaaatttaaacttttttctagtaatggattctattctcttgaggacatgtcttcttgtgtaccattttcttttaaattcaatgcaaatagttatttttttaaaaaaattgacaatgtagagtgtagtaacgtctagcactccgcgaaaaaaccaagttcaaattcaatctaaacaatgataaaaaaaagacaaattcgaatataaatagtactactattcatttgctgaatttgtttttcttttcgtgtatcaatgtgtaagtttggacctataagattttgtggagcactatcaccttgtttagttccaaactttttcttcaaactttcaacttttccatcacatcaaaactttcctacacacataaccttaaaactttttcgtcacatcgttccaatttcaaccaaactttcaattttggcgtgaactaaacacacccataataatataagggattattctcttttgggaaagattaaggatgagaagaaaagactacaatacccatattaaatgtgattctggttgtggtgactgggtagttgagggttaaaataggtagaaatttaaattagaattgatggatgtgacaagcagtgaagcaaaatctcttatattatgagactagtagaagggataaaatctcttatattatgggacggaaggagtatatatatacattgtatgactattgtcagtcttttttttagatttttttcataactacttgaatgattttcagacaagtactcaagggtttaaaacaattttcctgtttttcaattggaatctatggcaaaggagaattttctccagttctccctaaacgaatagtgtgaatttctataggaatctgatcgtctatttctccaacaaaatccttcaaaccaaacgaaacgacccttaaagcggtactcctacatattattgccgggaaaaaaaaagaatgtgatgaacgaaacgaaatgataacggcgagtgctgcgcgcgcgacgaggtttcggttcagttgggaaacgccgctgccactgaatgcacgcacgcacaacgcctttgttcaaggaagggatgatacacaggagtactatccacccaaccaaacctgaaccgcccaactgaaaaaccaaacggctcaatacccacatcaaaccggctctaactaatttaatcacacgagaaaaaaaaaaccgagccttacaaaattctcaagtaattacatgagattaataagctaactaagctaataaactatatattattatttgagtaacaaaaggatggaaatggagtaattgatgaactaaccaacagcaacaagtttgttttgagttggaaatggaaaaggctttgcaatgtaaatgcaatgcaacaactacaagaagatgaatcaagattagagatctatgatcggttgatcaatcaatcctgaccgttggatgggcggccgtcgggccctttccggccgacgccgccggcgttgcccgtctgtgccgccatcgccgcggaggatgccaccagcgagtacaccacgctcacctgccgctgcacctcctcggtgatcatctgccgcatcatcgccatcagccacgggtcctgctccatcctcgccttctccctcgccacggcctcctcctccgcgcgcgccgccgacgacccgccgaccacggtggaggctgagatggcggcggcggcggcgcccggcgggctgagcgacagcgacgtaggcgggtcgggcggcggagcccggtgctccacgccggtgggcggcgccacgcacagcctcttggccgggggcggcggcggcggaagcacagggacaccagcgacgaccgccgccggcgacgactgcgcagggatcgccaccgagtcgtcgctggtgccctcgtcgtcgttgtcggcctcctcggtgagatccatggactggtacgacacggatgcagccgccgcggcggccgcggcggcggccctgcggttgcggcggagcgaggagttccagtggttcttgacggagttgtcggtgcggccgtcgaggaggcgcgcgatggtggcccacttgttgccgtacttggcgtgggcggcgacgatgagcgcgttctcgtcgggggtgaaggggcggcggtgcaccccggggctgagctggttgcaccaccgcagccggcacgacttccccgacctcccgggcacctcctcgctgatcgtcgtccagttcctcggcccgtgcctcgccaccgcccctctcagctgctcgtcctcctccgggctccacgaccccttgatcttcccccccgcgcgccgccgacgacgacgagccctccccgtgaatcagcatctcgtcgatcggcgacggccgcgcgatggggactcgcgctcgcgggaggatataaagcccgcggcgcgtgcgtcgtctgttcgcgttaggtggacggggcgggggcgggggcgcgcgagaggcgtttccggcgcgaggttttcttgggcgttttcgcggtggtttttccattcccccgcatgcgttgcgttggacgacacgggacgatcgaggtcgtggtccaccaaccgccaggcgcgcgcgcgggcggcacgcacgcacggttggatggggacgagctccaactcctcgctctctctctctctctttcctcgtcggagtccggtgttggagcatgcggttctcatccccgccgttacgggcgcacgctcgcgcatgtacggggggtgatgtgggtgtgtgtgtgtgcggggggaggggatttgctgggccttttcgggacgtgtcgttggaagtggaactggagcgcgcgcggctgcgctgctggctgttacgtcttctttctctcaaagaaacggaagtcgtggtgtgcgtgtgttgtgggatctttttatcgtgttgatctgtttaggtgtgtcgtgtgtgaggaccggcagtgatacataggtttataggtttatagtgagagtagatttcttttccttttacttatatatacatatatttttattattaaatgtgtacatgttgtaattgtaattttttaatatatatatttttttatctatgtgtccacaaaatatgtaataatagattggtcgattttggtttggctgtagtgtatgaaggtgatatattttgacttacacgaaaacccatatcttgtatttaatatacatttaatatagtaacaagtatttggtcgtgtcatataacctatgaaacttcatttctagatcccaaaagtaaaccattctagagacgggggctgaatcgtcttgtatagtaaaagggatgtaaaactttttgatggttaccgggggaaaatatgttacttgcgaaatgctggagcggtttaaccgtcatttaagtacgggcaggagcatcgtgtgtcttgccatgtttgggctggtagtgttgatggggactacaagtcaagtgatcagcacttccccggccagcgttggcacatgcagttctcgctgttacagccgcacgcatgcctatgcatgggatgatgtgggggtggaggatttgctggcctttttcaggacgagcgtgtcgctggcgtgagacgtgtcatgggagatggaactgcggagcgcggctatctgttacgtcttccttctgttaaaagggtttggcaccttgcgttgggtgtgtgatgtcgtaatgtatgtgattgttgtggggaccaatagcaaaaaaaagtgagtttataattatagatagcttgtttttaattttacatttttatattatatatcttttattgttgaatatgtacttcgtgtaattgtagttttttctgaaatatgttttgttatcggtgtgtcaacatgtatgcaatagtgaattggtccattatttagcttgttttagctcgagtctatgatggcgataggttttaacttaaatgaaacttcatttgatcttgtaaaattaaggtggtttattgtgtcatatagcttcatgaaacttcatttctaacttttcaaaagtaaactattccggagatgggttaaactgttgtgtatggtcaaaagggtgtataacttttgatggttatttggagaagatgttactacttgtgaaatactagagttatttactgttatttaagggcggacaaggacgttgtatgtatggatggacctggactttggacgggtcccgcccagcccatagtgattttagcccaaacatctaatacatgatgaaactagatgggtttaaatgagaccttcacgcctcggatggcagcctgggtggtccggggcctaggtccactcctaaggacttgtataacccgtttacatcgtcttattgtactcgctcttatgttttgattgaacgaaacctgaactttctattcgatctggtggcaagtgatttatcgtgtcgatcgtatagtttaatggaattctatttctatcttacaattaaagtaaatgagtttagatattcctttaaaacacgaatagttaaaaaaattcaactgcattatataattttgaacataggcaataacttgtatcattaacgtaaaaaagggggaaatatactgctataaatcttaagcatgactaatagttgtatttcatgctagcttactgaggttgcattgtatgaacaactacttggggcggctattgcatcattctccactaatacagaatggatttttgtggatgaggctccctccaggctccaggcggtccgtaatggcattcgcatgggccaaggaggatttggagagattataaatatgataagtcattcttaccgtggcaccttttagaggaactaccatgatagatgaggacgctacatgaattttatatgaaggcatttagaaagggcctcggttttattagtgtcaaggtcccgcttgatgctttcatgtgtggactcaataggatattcataatcgatttgtgtcacctacatgcattgttcaaactagagaaaatggatgtcaatctcgctaccacattttgtttgtaagtgtttactcttgtatgttccacataaatgtaggaaacaaatgtccgttgatttaagttgtattctataggacgaggcaaccggttggctatgtcaacccaactaattaagatttgcaagacgcaacatactatagagctgcatgtgaattgcatggaactaaaggtaagatagccaaggaaaaggaatcatatatcaaaaaaatgcacaagcgaaagaagtacgaggtagtggtatacttggaacgagcaatgcgctcacaccaagacaaaagatgtcataattttcccatacaactttaagtaagcagcaactcttctatttcattacgtggttagtgttcaatactacataattactagcaaatatcgcctctaattcatctatcttatttgcagtgaccactacattttatttctagtatatctggtggtgtttttacttggtcatagtgctcgacccatcaaactataacaagaatagctacatagagttccttactattttgactttggaagtaaataccccctgagtaccttaatgttattctgaaaattttgaagtaactcaacaagaaataattttatcggcacgatgcacataggatatacgttaaagaaggaatggcaataaaggagcaaaagccaaagctatacatcaaaacgggttggctggtacttacacatgacatgtacaagaaattttcaaatgattacttatttgtaccgagcaatgttattattatgttcgcagtgtttcaaacaacccccaagcaccctactatgtactatgtatatattatgtgtgcaagatgcttagggtcaatgagaagtacaaatcaaaccctgataatgtaagtcccgagattattctctatacagagtatttcatccgtagttcatttcctaacatgtattgttagtttttagcaaattcatcaaatcccttatgttgcaaacaagttcaacatggcaacggtttggaacattcgcattggcttgtgttacttcatctgccatgactgttgcaatgcactaggtcttttttttacaacaatgagagccaactgaatgcagaagacaaaatgaatcaccttcgagagcggggaatagaatatgtgaactgaaaatatactatttcataaacgagatcgatcatttgtaatatagttcacaaacatatgtttatatgtacaaatatataaatattttctgttttatatattgaaacatatttatttgtgcatgcaggattttaattactatgcattactatttgctaagaacgacctcttggataggtcctatgtgtagtgcaaaatattaccactataaaacagaaattttaaaaaacattttaaaatttgattaaaaattacagaaaatatttaattaggtagtgggcactattttccaaatggccaatgtattgtaggccatatgggaaaatgattatcacaggcggggctcttaacgtgactgactacgataatgtatattcgcaagtggacaccttaagagggtagcttgcgatattttgttttcgcacgtggttagaccatccgtatgtgaaaaatccgtgtatccgcagacacatagaagacatgttttgacggcatgaaaaaaagattctgtagtagtgctcggtgagcacattttccgaacggtttaaggtttactcctattttgtataaaatttttttctacccaataaaccgattaatcatataatatgacttgtatcgttttacgtgccaacgaaaatcccagcccaatagctagcgcaccatccattcggaacgaagccttaatcctcttgtcatgacaaggttcgaagaaaccacgcatgagaatgccatgagaggaatcactcgcgcgcatatttctggcgataggcatcgatcgatcgatccttttgctgtagacggacaggcacagatatatcgagatggagacgtacgccatgtatgtgacctgtgaactgtcagggttagtttagcagcatgcatggacgagatggcccaaagcatgagcttcactgtcacatctatatcggttcggtttggctcagtatgtaccgccggccggtggttcatggaaagcgcatcaaacaaaagtgtaacaaaccttctgctagctagcttggttacttggacaactggcaaactctactgcttctgcccatgcatgccatgtcacttcttgtcatgtaccggcaaggaaagtgattgtcattagtagttgttgcttaattaactggaaattggaatatgcattattcttcttttagcaaacatgcataaacctttagcgtgtgcttaatttgattgtagggataatgttggttggatggctagaaattatgaggcaatatcgattgatccctatgtttgatataattactcggaatgtaggtaggagtatacagttaattaattccgttctcgtaactaaaattagctagctaggagtagttatcttgggtaatcctacatagaaatttcatatatcgcaaacttcctgtgataaatatacgctagagattaatgatgcgttcatatctctagtccccacggttaattaggattatgcggtgatattaatattaactttaatcctctttattacctatatagtaacaaaacaaacacaccatacgttagcttttcgtagaaaagaaaattaaactaacaagatagataatacaagcaaaacagagaaacacaagagacgaaaaaaggggccgggtttcacatttttcgatcgggtcgggaccgggaataatcgtgtgcggcagcagcagcaaccggtatacgacgacgcgccgcgcgcggcagacggacgggtgcgtgcgtgcgtgcgtgggcgggcaggcgggcggtggcgcgcgcggccggtgagacatcagctggctgcgcgggggagggtggacgcgacggctgatcagccgacgggcgggcgacgacgcgcgcggcgcgcggcggttgggctcgctgtgctgcctgcctgcctgggacggacggggcaccaaaccgttggcgtttggcgttttggtcgcgtacaactcctacgtgtgttacgtcgtacgaggcgactaggcgtgcaggtgtttgcaggcgacgcgcgtggtgtcaacggctgcatcggccgttacggcaggggcagtcaattcgtcagtcagtcagtcagatcaggtggggtcggtttaattggtggtggtgatggtggagtcggagaaaagaaagaagaatttcatcgttggttacagccggatcggaactgagatccatagctgccagccttggcccacaccgactcttgttagatttcaggtcagccgctcgctgctcacaagtcagagctgcgtcggctcaaggaggacgtcctaccttacgcacggtgcgctatggctaactacctctacttttgcgaaacacagccgcactcatctcatatttgtcatataaaggtagagatacatcgtatccctatgcactgtcgcactgacgcccttgagctttaacgcctaataacgttgtcaagtgggcgaccacttcttagagcatctccaagactccaacattctattcaaaatatatagactctccaaacatccatataatcagctatccaattaatttggcaagtcgaactcattgcctcctccaataacctctccatctatattatctattctaagcctattacattgggacccatatatcagtctctacgaccccttcttctttctcctcctctttctccccctcttcctcttctaatcttcagcaatgacagcgcagacgacggcggctggccatggcacagacaacggcggcgacgactgatgtcggtgaccaaggcgacgacggcagctgcagcggatggttagcaatcggagccgcggttgtggcagatggcaacgacgacggcaaccgcagccccgcgcagaggcgatggaggctgtggaggtcgtgccctccctgaatccatgccgcgccggccaaatccggcgagcacggaggggcagaggtcgcgtgtgcccccctggatccatgctgctcaggtcgaatccaacgcggatgaaggtggcggaggctggcgatagtggatggcgacggcgtagatggcggcggctgtggctagcaacgaagacctcggcagcatcgacggatgacggatggtggatggtgatggcgacctcgacgacgaccggtgattgcgatgctcctctgtgtgggtgcgggaagagagaggggaagaagggtgtctgacggcttggggcccatggttggaaatctgatttggccagtcgtgcaggatggctaagtttggctagctagggaaccaatttgctcagctggatggctcggccatccagttggcaaagctgttggagtgcactttttcatcaaactggctaaattttatattggagagtctgttagaaatgcccttacgatatcttgtgactgaatgacataatgttttctattggactaccgttctttaagtggtgaaccatgttttacatgcatcgacaatagttagcatagtagttagtagtggagacgcatagaaggaatcttgatgacttgttcgggagttgggttatatcgaccattactatcactatgagcaactctgtgagactaaatcgatatattttgagatagacaaagtcaccgcatgcgtcttactgtccatcgttgtttgtaattaccaatttttacatgcagatgattaaaccgcctgctaatgaagatgacatcattttcatgggtggcttaagcttccacatgtgaaaatttattcttttatgtgggcggcctaagccactcttgtgtgaaaatcaatgaaaaaacacatatctacacctattattttcatataaagttggacgaagacaaagtttatatctggacaagatctataacattatacttgacaaccttttcatttgaaattatttataggctcaaatacttcttacaagatcatagatctatttttacaaaatctcatatctatgtttcaaataaccttagataaatattgtagaaggagatttggatcaaccgtaactttcattgatcaatggagcttatatttatacatgtacaacaaggcttgggagttgcctgggcctaactaatcccctgatctaagggacgtgcagcggtgcgagcggtgcgagaggagcgcggcgtcgtgcgcggggtgcgcgtcgtgcgcgtggagcgcgccgcgagagtctgacgaagccgttcgccaacacccccccgcagtcgcagccgtcgtatcaccgacgcagagactggctcggaactcgttgaacatgcttgaaggaagcccttttgtgaacacatccgcgaactgatgggcactcggtatcggtaggacgcggagttcaccgagcgcgaccttctccctgacgaagtggatgtcgagctcgatgtgtttggtccgcttgtggtgcaccggattcttggacatgtagacgctggagatgttgtcacagtaagcgatcgtcgcctgtggaacgcggcagtggagttcaccgagcagctggcgcaaccaagtgcactccgccaccgcgttcgccacacctctgtactcggcttccgcacttgacctcgagacggtcgtctgccgcttggacgaccaggagatgagggagtcgccgaggaagatgcaaaagccggacgtggaacgccgggtgtcggggcagccggcccaatctgcgtcgctgaaggcggtgagcgtcggcgacgtcgaggcgcgaaggtgtaagccaaacgcggccgttcccttgatgtagcgcaggatccgcttcagcagggtgacgtgagcttcgcgcggagcatgcatgtgcaagcacacctgctggacggcgtaggcgatgtcgggccgcgtcaaggtcaggtactggagagcgccggcaatgctgcggtaccaggaggagtcctggaagagaggcccctcgtcgcttgacagcttgggtttagcgtccgccggagtggccacggccttgcagttcgccatgcctgcacgttcgaggacatcggtggcgtacttggactggctgaggacgaacccgtcggcagtgcgctgaacttcgatgccgaggaagtacttcaggggccccatgtccttgaccttgaactccgcttgaaggcgatcgatgatgcgctgcagcaagctcgacgaggacgcggagaggatcatgtcgtcgacgtagaggaggaggtaggccgtgtcggagccacggcgcagcacgaacagggaggggtcggcgcgggactggacgaagccgaggctggttgcatgatcggcgaagcgcttgaaccaagcgcgcggggcttgacgaagaccttacagcgaacgggagaggaggcacacgtccgccgggcgagcagcatcctcaaagcctgtgggctgctggcacaggacacgttcctgaagatggccgtgcaggaacgcgtttgaaacgtccagttgatgcgccggccattgcttggaggaaatcagcgtcagcacggtgcgaatggtcgctggtttgacgacgggcgagaatgtctcgccaaagtcgacgcccgggcgctggttaaacccgcgaaccacccaacgtgccttgtacttgtcgagtgagccgtcagcatgaagcttggtcttgaagacccacttgccggtgatgatccgagcaccgggaggccggggaaccagagtccacgtcctgttcgcgagcagggcgtcaaactcagcctgcatcgccgcgcgccagttgggatcccggagcgccgcgcgaacagacgaaggtgtcggcgacagggtcgacgtggcagtcatggcgtaccgcgggttgggtttgctgtgtgtgtgcataagcaaagaaggaacgaacagtatgaaacacctcagatgccggaggaagagccggaagcaggtgctgcgcggtcatggcctgttgggcctggaacggcgggcgagggcccaacacacccgcgccgggagcccggaacgggaaaggccaggcctggacaaagcctgtccaggggttgtagccccaaggcgcaggagggcgaggctggccgtcgtgcccggcaccagcgccgccgccaggagtcgaaggagcgccgccaggtggggcgccgccgccccggccacgacgcttgccccgtcccttgggacgaggctggccggtggtgtcggaggtgccggaggaagacccggtgccggcgtagagggcctccccggcttcagccttggcgtcgtgctgcatctggagctccgccagcagcaggtaggagcgcgcggtcatgaaagtgtgtggcggattccggtcggcgatgctggcgcggagggagcggaacttggtgttgaggccgcgcaggaggttgagcacctggctgggctcagacacgggcatgttgatgtcgcggaggccgtcggcgagttgcttcagcttggcggtgtactgcgtgatggtcatgtcaccttgattgatcgagcggaactcggtctcaaggtagacagaccgttggacggcgttgtcacggaagacgccttcgatgtcgctccacacggtgaaggcagaggcgcggggcttgtagacgacgtcgaagacgttcttggcgatgaagttgtgcagccaattgaccacgcagtgatccgcacggcgccactcggcagtgcggaggtcgagagcgggcggctcctgaacatgggcctcaaggccgaacttgccgaggaccgattcgaagctgcagcgccactggctgtagttggagacgtcgagatcgaggacgaccgggacgtgggagcggatgttgacggtttgaagaacagaggtggaaggcgccggcacaggctcttcgtcagaggtggacgaggcgtcggaagcgccggagctgtgcgacatggctagcaagggagaggtagcggaagactaagatcagagggtcactgataccatgtagaaggagatttggatcaaccgtaactttcattgatcaatggagcttatatttatacatgtacaacaaggcttgggagttgcctgggcctaactaatcccctgatctaagggacgtgcagcggtgcgagtggtgcgagaggagcgcggcgtcgtgcgcggggtgcgcgtcgtgcgcgtggagcgcgccgcgagagtctgacgaagccgttcgccaacaaatatgtatcacaatcaattgtagagcttaactaaataagaagtacaattaatgacctttttatttaagaacatttggaggatcaaataagaagtacaatttttggagaggtgaaattaaaacaatggcatgttaattccaaacaacaacgagcaaacctacctgtattaaaaaaaatgttaattctaagaatttatctggacaagcacttgtctatttttagaattggactttttctacaaaagaggggagtatgtgtatctcggcccaattccagagttattttatcgttctcgttgaaaatggtagaactccttcttgtaactttatttacaagtacgcgaattacaaagatataaaaattatcaattctctaccttaatccgtctcaagataaaaagaacaaacagaactttttgataagatgtggacaggagcggtcctatagagctagggctggggcccgataattgggactacatgctcatgggccgaaatgaattttttgggaataagttcactctaggtcccttaatttgtcaccgagtctgaatttaatctataatccgcaatagcagatatgacgcgtccctcagctcccaaaacgtgcaagcactgttgcctcagccttctcatccatcaccgtcatgtctccctcgcaggcactgccgtcgtacttgttggcgctttttctgaccaacacagactcacttaaagatttgcggtgttaacggagtcgccaatcatctcgatctagaaaactctaaaccaagatggattttgaagatttaaccagctagtagagctgatcgatttgaagataaccacccgtctcgtaggcgaaacagaaggtttacaagacaaagctacaaaggggtatcgcactcatgtagtgaaggcgaaaaatttatggcacaaatcaacaaagatggactaaactaggatagtgtagaagatatgctgcaaagtaaaggtaaaaaaaacgattcgattaattttagaggttgtggttgggagtttagaatccaacttgccatagcccttataaaaaggttattcttgcctcacagggtttttcccacgtcctattatgatgagagatcatttttaggattaaaacaaacctcaggcccaaacaaggaaacccgagacccgacaaaatttggattcagagtcatcagccgatctgatcattgccattgggccaatcagatcggcggtgtgtggccggtcagaccggccttccataggaaacctgatcttctcccaaatttggcaatgtttttctatttcgtgtctagatgtcaaatttaggcgttaacacatacccctgcctttttggcgaacttgtgagccgaaaagcataggacatgtggtcttagggcaataatttttatcggccatatgaggttctaagtgtttagtaaatcaatctctttgtaatatcctaacaaatcaataatttcttacgaacgattcacacaacttggtatagatatttccaactagataattactcaccgagcaccttgcacttagacccaacaaatggcgacttcaagatgtgaggtcgtacctatcatcgttcgtgtctcctaatttccttagaagcatattaacattttgcccccgagcaaaatcggctttgttgaatgcacgatttcgaaggtaagataaacattgtgttaacccctatagaatcatgtggaagagattcatctctaatgaccgatggttcttttctcaacgaattggtttcatcactactcttggaaatcaccggtcactcaacttttccttctttgggtctcctcactcgcctaggtattttttgaggctttaattgttgtacgtttcgttcctcacgtcttcggcttttgtcttcatttaatctttggctcgaatacattgtagcctccttttttgaaagcgagataagccaaaagatatccatttcggctctagttgtgttccaggagataaatgatgattcttgattttctttttttcaaattagaagctcctgtgttgccctcaagtttcctgattgtctttggtgcatcacaaaaccagagaggggttgtcgttgggggtttagaaacgaaccagccatagcccttataaatgggttggtcttgcctcctctggaccttttccacgttctattaggcttgtccttggtgcatcacaaaactagagaggggttgtcgtcggtggtttagaatcgaaccagccatagcccttataaatgggttggtcttgcctccactggaccttttccatgtcctattaggcttagagatcaattaggactaaaaaagcctcagtcctaaacatggaagcctgagacctgacgaaattggactcagagtcgaactcaaccgatctaaccgaccatatgctgctggtcaaaccaactccaaccgccagtctgaccgtctcgatggtggcagtcagaccggccttccataagaaacccagtcctctcgcaaatttggctatgtttccctatttcgtgcctaggtgccaaattaggtgttaacaacactgtaacaaccctccctctataagcgtgtagccagcccatccgataggcgggcccactttacacataccaccccatttacactttcgttattacttcgtgtaaaaggattaacctgggagtggcatggttggagggaatagaccttgtaagttggttccacccttgttaaactagcaagttggtactaaacatgtccgtaaagccctcatgggccacacatgccaaatactaattgggccaggatgttacatccccttttggtgccatccaagaagcccaagaagcgctggagagtgtcctgccgaccacccaactttgtgctcatcaccaacacctccaacatccgtgtcaaggtgtaggagttcaccggcttcctagtctcgccctttatcactgcgcccttcgacgactacgaggcggaaagtgataaggtgcatgacaccgccaccgccaaccatggcggcttcttctcccccttgggtgctcatggacgaggaaagggagagagaggaggatgggagagaagagggaaaaaagagggaatgttgatgtgggtcccattgcaattttttttttatttttaaccaacacttacatacatgtgggttatactgtttttggtactttaagtgccacgtcaatgccatatcatgttagccgaaatcaccgttctaaccatcttgagattttatttgcactagttttaagaattgagggacgcgtcatgtctcgtattacgattcatggatgaatttcaggctcactgataaattaagagacctttccttttttcgcagtgttgagatatatgtgggccagaagggcggccggtgcctcgtaccatcggatactctaactggcaagcaatatatgcaaatattaattgccaagtggcggtgtttttatgattcactataaaaaaaccattttaataggtggctaaaatggtttctgacagatgtttagccaaccgcttctgatcggcgatcgcttgtgttgaaaacttgaaatgttaatttttcatatctgggagagcaaccgcgtatggaaatgcctttcaaacagtcagaaagatgtagaagatgaagctcgggttggatttgaatgagtgaaacgtgaggattgagcagattggcgtggcaacgcacgtcggattcacttgaccgatcgacaaccgccagcatgtcatcccccaccacgtcatatcagggattgcaattccggaacagaattatgaaatttcagttatttcgccctccccccacccaccagaaagcacgtatttccacccaaaaaaattccctttttaaaatattttttatgaatttgatcaaaatttatttaaattcattcaatttattaatttttcaaataattttggctaaaaataccaaaattcttgaaactttggtggcaaccgaaattccaattttttgctgaaaaatggaggtgtaaaccatgccctacattacatacaccactgtagtgtggaggagttgtttctacaagcgggtttggatggttagggaaaaaggtacggtcttgaaaataaaatatattactaagatttatttttgagtttttatttaatactagaaaaaaaatatccgtgcgttgcatcgggtgacagctattttaatcttgttattattatatggtttagctaagttgaaattcactgtgagaattcatttgaatatatacgtttttagaaaatcatgagctttaattaggaatttaggaatccaatcatctcaagttagtacgcgagtttttttgaaagagatttcttatacaactccttctgtatttcaaaaaacgaacgaatctaaaaactgactaaaatacggatatgtattttcaaaagcaaacaaatttaaagactgattcatacacgaatgacataccaatgaactggcaaaaacatctttaatttttataatagtagagataaagatgatttgagtaatatataaaattctgagatttatttcgttttgctattgaaaacggtttttcccctcaagaaaacggtttttctcagtactgatgattgattgaaaataggaaaacccaagcacttttgctcagatctttgcattgaagattcagaacatccaacccctagctaaccagtcacgcacttaagaaactttcattcccgagattaaattaatgtccattaagtacacaagtcaacaccactcaccatctacaaaaatcagtactccctccattccaaaatacacttatcccaaaaaccaaaagataattatttcgcctactcgtctgaattattttataacaaatacaatacgtgcaaccaattaaattagagatcttgagatgaggattaaaaaaaacaaatttagaagagatgtgctaattacttacatgcatatatacacatcttctattatatatgaaacatctatgatacttaatattcaattaattgctcattccatttcaaaatatggcgcgtaatcagtttttcaatatctcatagcaccatgtatgcaattaacgagcactcccgccctcccttaaattcggcttttaaatcaagatctctaatttaattatatgcatatgtattatatttattaggataatccgaatgagaagctcctaatatataattcttactttaagttagtggttttataatgaaaggagtctacactaatgactcgtcttgttcaacgccactgaaatctagctatacctaggtaggtaaggaaactgaagaggttgatcatctcttccatgcaagttaacggtactgttggcctggattgtggccagatgagacaagtaaattttatgcaacaattaattttattccttttgtgtactatattattgaagaaaaccaaatctttcaaggaaaacaccaaaaaaatgttcaatacgcatgtaacgggtacattcacacaatatcgcgcgcacaccaatttaggagattttgaaactcgatcaggagttcgaagattgcaaagattaccgtcatgacttttaataatgtaaaggcacaactcaaaactgatggtttatcatctcattgggaaatgcaatcagtaatttacagatatatatgatgcttgcttgattaatgagacaaaattagttatgtgtggagaaataaaataggaatcatgtatctgttgaaattcttatagaattagaattatacaagtccttcaaaatcagcagaaataaaagcaataatgtgattcttttttttactttacaaaaaattcgtcaatatttattttaaataaatttctccaacgaactagtatgtatatgagtatatgattatgctcaattgttaaggcagaacatccatttggataaaattgtaaaaacatcaggaaaaccatatgttttaagaagccataagttaaatgtttttatcatatatattagatggaggtcgggaatgtacccgagaactgcgaatggtgaaagagcaaaatagacaatatgttcgtttttttaagatacagggcacacttgttaatggaaggaaactaccccaacattttagagtaatagagaatataacttgtagggcacacatggcttcaattgtcataataaaattaacacaaactagattggagataattattttttcatgcatgagatcatatgctgctgaaatcaaatcatcaattgttctttaaaacatcaacaatttaacaataaaagacagctctttatcatgtaaatcaaattaaagatcgaaaaaaacaaagtggggggtttagtatagcttgtgttaattaaacatcgcatgtgtaaattagaacacaaagttctagcctatacataaagactacgtactgcaccaaaaagataacagtacaatattgttcaggattagaagtaacctcagattttttttttgaaacattgctactcatttatatacaaagatcaataaaaaatacatatcatattcttgtcataattaagcatgcatccattgatgttgcatgcaaatggattttcaattactaaaatcgaatcttaaatcaattgtaaaccctaaatcttcccaataccacctcattaccccaagcgaaccccaccaaacaaactacgaagaagaaagcaaaaaataataaggaaaaaagaaagatgaattagtagaatctcaaatcgaaaccctagttagctagtgaactgatcaagctaggttgcatgcagatgcattcgccatggacgcccccctcagctggaacgccaagctaagctaagctagctcgccaagaactcccatgcatgcatggaatcggtcacttgaggaagagatcgaaccaggggtccggctcgctccacagtagcgccgccgcgtagtcctcctcgtcgccgccgtggaagccccacgcggcctcctcctccgccgccgccgccgccgccgctgacgcggcgtcctctggcgccgtcgccaccacggcctgtgtttcagccgtggaagacacagcagctgcaacaagaacagcacccggcgcggcggcagcgagctgtggtaccggcgccgtggtcgtcgtggtgaccgtggacgtggaggccgtcgccgcgtagtagaacgtcgtcggcggcggcggcggttgcggctgcaggaggtggtggtggaacggttggtgatggaaggcg

SEQ ID NO: 67246 - DNA, 1393 bp, Oryza sativa
  unsure (1)..(1393): unsure at all n locations
tgaaatgaaagaaagggctccggtgtatagagagggcctcgccgtttaaaagggacccatagaaccgatggaacccactattttttagtattgtgcgaaataactaaaggaagtagaagagaaaattgtggttgggaaggttatagtagcaaaagccattggaactaatattttatatatgggaataattcgttttgttattaatgggaaaaaggatggctaaaagaagagaaatcattagttattcattaaggttaatttgattcaatgaccagagttccgtgaggatatatagctcggagacgacgggcaaaaatgcgttcatttgcctcaaactttagaggggctcatttaagacttaatcgaatgattactcaacaggtaagaagagcgtttgtttcctctcatcgagatagagtcaggcaaaagagggattttcggcgtttgtggatcagtcagataaacgcagcaacgcggatacataaagtattcgataattatagtaaattaatacgcaatctttacaagaaagaattgattcttaatcgtaaaatccttgcacaagtagctgtattaaatccaaataatctttacncgatttccaataaaataaagattatcaattaaagggataaaaaagtaatatacaggaataattaaaaaagaattcccggagaggtaactccgggaagatacaataaattaagatttattggtaggaatcaacgagcatgttgcaataaataaaaaaactattttttcttccccattgttctttcttataacaaacccaagaatctaaattggattactttctttatatatagtctggccctttcgaataaaacatcaacaatcggaacttaagttccgattggtgtttcttaaagtctggttggagtttcttaagtttcgattggaattgaacttttgtgttaatggaggaatatgtctattttttctgggtctaggacctgtaattattgaaattgactgggcttgaaattgtttctcattctcatagttacgaaatggtaagaaagataaaatacgagcctgttttatagcaagagtaattaatcgttgttgtttcaaggttaatctatttattcgtctcgataatatttttccttgttcactaataaatcgattaattaaactcatgtttctataatcaattcgatcccccgggccaatccgaggatgcctacgaaaaggttgtttgggtttgcgaaaaggttgtttgaatttacgaaaagtttgcttggatttacgaaaagtttgcttggatttatgaaaagtttgtttggatttatgaaagggttgtttagatgtatacatgatttattccttattttaaaattgaaaaaaaaatgatttgtttattttatta

SEQ ID NO: 67247 - DNA, 910 bp, Oryza sativa
ttttccagttagtccataaggatcagacacccatatcccagggccatacaaacccgttacatgaaatgcgccaaagccaaagcaagccacccctgcaagaaataaatgaattccaaagatcttgggcaaatccaaagaaggttttcccgtccgctcatcacagaatatttcgaggtcccaatatacccaatgccagatagctgccaagaaacacaagccagaaaacacaatatgcgcccctgccacgccttcataactccaaatacccggattcgttacagttcctcctgaaatactccaaccaccccacgaattggttattcctaaacgagtcatgaaaggaatgacgaacataccttgtctccacattggatccagaacaggatcagagggatcaaaaactgctaattcgtataaagccatcgagccagcccaaccagaaactagagctgtgtgcattatatgcaccgaaagcaatcgacccggatcattcaatacgacagtatgaacacgataccaaggcaaacccatggaaatactcctttagcaaagaaaaatagacacgatgtcactttattttatcgcattggcaaagactatccatatcctatgtacctaacccttctaggggattctgtgtcagaaagcgtgaatatttatttcattccattaaaaataagaagccaattctgttcgtaagaagaaagagaagcagatctattctatactcgataagtgccaatatgcaatgggcagcttggcttatttggaaaaaacgaagaatagatccctatctctttttgattagtattcgaatcacccattcttttttctttattcaatctgtcttatactacttatatgaataatctttcaatctatgtattatttcaatctacgtattaataga

SEQ ID NO: 67248 - DNA, 28742 bp, Oryza sativa
ctttttcagttgaaatcatttagtatttgaaaatattgtttgaagttttgaaattcaaatttttaattgataaaacaaattcacaagaaaaaatggccaaaataatagcagtaagaacataagaacatcatagagcatgattttagaaattttttggaaaaataatcgtccaatttggagttcatatgagtgagatacactagtttcaaaattttcaaaagtttcaaaattatttttgcatacggctgcttaagatgtccgtatgggaaaatggccctcgatttttgcagacgccactagttacggtccgcatggaaaaatgatggggcctcgtacagaaaaatcacttttgcagtagtgagtgaaaacggtccgaaacaatcagaaagcagcctcaaccatttccataaccatattttcttggaaacaaaatcgaaaacagtaaaatcagaaatgaaaatgatatcggaaatatcggaaaaccaaatacggaataatacggatgaaaagatatcggtacgtatcagaaaccagtaacaaaataaaaaacactaaactataaaacatatatttaactttgcataagtatgtaatacctataaataaattcaagcttagactatataaattataaattaactcattttagccatgcactcaagttagaaatttgattaaaaaagagtcgatcaatctttaaaccgtggttcaaatagagaacactataaatatcgacatatttaaaagaaaaacatatgaattatcctcctgaactatcgtggtcgaccgaattaccccatgaaccacaaaacctaacattttacaccctacactatttataccggacgaataaccccttgtcactgctttgagaggttttgatcaaaagcttacacacgtgatgtcaacgtggcaatccagccagcaaaaacaacaataatgaatttgtagggcccacttgtcatatcttttctccactctctctctctccctcttccctctctctccctctctcttcaacggttggatggaggcaacgacaacgacgactggctggaggaggcggggttcaagatgagggcggtggctggccggggacaaggctgggaatggagaaggtggccggtggtagagacgttctgggtggtggcggaggatttccggagtggtagctcgttcggtgttctgcagcaggaccacgagcgacagtgtgggtgcctggcggcggcaggaccctggggcggtggtggtgggacagtggggcgacgacgcgggtgcttgggggaggatgagctcgtgatgtccatcttcccgctaacattctccacctacgcgtatgccgtgggcgccgagcttgccgcgctcttcccaacaaatccggctacatcatagcgcctcgagcggaaagaggtggcggcggcagaagagggattgatccaacttgctcggcgacaaggagggagaggagagggagggagtggccgagcgtcctccagcggtggcgttgttgtggcggtcgagcgtctggtttgcagaggcgacaccgttgcaacagccgagcatctctagctacagcctgtagacaaaggaaaaaggagagagcagcttatatgtgggcccactagctacataagagagggaggatgaggtggaggctgacatgtggggccggtgccatgtgtgcggtcacgtaggactaaaaccgctccagattgagccagggggttattcttccggtataaatagttcagggtgtaaaatgtctggttttacggtttaaggggataattcggtcgaccgtgatagttcaggggtaatttgtatcttttccatttaaaaatacggtaattaccatattataagaaggtaatttccataaaaatacgataaatacggaaatgattggtataaagcaaaatcacttccgtttcaatttctatacttttactatcttcattttcatttttagttgattaccattttcacatagctcaacggaaaacgagcaccggctggtcgggaatttctaatactgttctcattcgttccctagggttcccaactcccaaccctcgttttccgcgcgcgcgttttttaaactactaaacggtgtgtttttttaaaaaagtttatacacgaaagttgctttaaaaaattatattaatccatctttttaaaaaatagctaattcttaattaatcacgcgtaatgcgaacatagttttacgtgccaggctcccgaacacagccaagtcgtcacaggcgggactccatcgaatcctcggtccggcagcggcaggtcggtctgctcccccctctcgctctcgcacctctcgcatttgcgtatcgcacgacggcaacgagatatttgcgtggacgtcatccgcgaacccggtggtggccggtggttgcgtccgcgacggatggatggggaaggcttgattccgcgagaaggacgggcagcggacgcggccggcgcggggcttaaaaacgggggcgacccaaccagccaaccaaccaacaaaccaaccaaccggccatcgccccaactagacggaacgaatgaaccgcctctcttcgtcatctcttcatcttcatgtcatacgcctcgatcgatcgcgaccgcgtccccgcgctaattccacgtgtggtcgccgctatatcatcgtcatctctctagcttaatttgtcatcgcaaatgccgtacccgaacaggacgttgctcatgatcataatgatgatgatgaccaattaatagtaatacaaaaccaatggctgcatgtatagctgatttgtacctaaacaaacaccgtgccttatcgagatctcgtttttatatcttctaatcattagatgcatgtctgcgtaaatccttgtgattgttgcatggctatagatagtactcctatttggcattgccagggtaattacgggtagtataagtatactccctcgggtacaaaaattattgacgtttaaaccttgtaagcagtaattgctaattattaaaccttgtaaggagtatattggaccgctttaccctgcatgcatgcaattaaaaatcgagtaaaacagctaaggaattggacctttagctcgcaccgatacaggtgattggttcaaaccaacgaggtagcagcaggtgtagtgattatcgttagcacaagatcatatttaatatggacaaaatagtaagttgacaccctaaatcaccttttggtatgtgagatcaggtcagaaacgttaacaattttggaaccggagggagtaactacctatttatacggatttaacagaaaaactatctaacggcatcccgtagagatgggatagtagtgctgccttatctcatcttcccctctctctgtgtcgctttccctccactcgctctctctctctctctcttccccttcactcgatctctctctctctctgtgactgccacccatgagcacggaggcggcgacagcgacgacggcggtggcaacgacagcgacgacgacgacgatgccgtcaccaccaacccccgcggacgacctggacgacagccggcggggctcccgaccaccacgggcgacggcagccgagaagcctccccatcaagctcctcaagcggctcctcctcttcgtcgttcttgtcgttggcttcctcgccgctgccgccctcctcctcctcggcggcactggcgcctcctacggtcggggagcgggggacgcggccaccggggacgagcgcttggcacaacataagcgacgaggagctgctctaggcggcgtcgatggagccacgggttcggcggtttggagcgaggcacgatgacaagtgacagaatggcacaaggtaggcaccagatctatcgcctcctcttcctcttcctccgtcgccgccccgctgctcgacctccccgacccgcgactcctcctcctcctcctctctcttgggatatcacgctgatacccaggtaccaaggcctgatacctaggtaccaaggcctgatacctaggtatcagctcgatacctaggtaccaaggcctgatacctaggtatcagctcgatacctaggtatcagctcgatacccagggtaccaggtatcagtcgatatccaggtaccaaggcctgatacctaggtatcagctcgatacccagtgtaccaggtatcagtcgatacccaggtaccaggtattagtcgataccggggtaccagctgataccagtatactaggtaccacctcagtaccttacccaaggtaccagggaggattggataaggtggaatcgcaggatagcgtgggcttccccacgaaattgacggtgcgtattaaatctctcgggatttttagttatcccgtgactgctaggagcaacggaatcccgtggggtagcagccctctggatttaaagggattgtttggatggtgaccatactttgccacaactttggcaagctactttgactaatttagcctagtgtttgcttgattgccacatctttgtcatgccacactttttgattttgtgaccccacttgtcataggcacatacctttgccaacatttgcctaacttgtggccaaaaatttcttagccacataaattgtggcatgccacatcttagctatagaactttgataaactgaagcaagtatccaaacagccccttacacagagccgcaagtacacaggaaaggcagcatcaacccgcaacacagagccggcagatttaacaagctagaaacggggtcgacgagctgtcgagggcgtgacttaaattgggcgccggtgcgcgtgcttttcagcgttaactgctgctcttctcgcctgaaccagctgccgctccttcgctgtcgcaccttcatcaccttgctctgctagcacttaataccactatactagtatcaaatagatatcgtgctatatactcgctccattctcgtaaaggatattattttggacagcgacacagtctttaaaatacaactttaatttcttgtttctataaaaatatttattgaaaagtgatatatgtatacttttatgaaagtatttttaagataaatctattcatataatttttacatttgcaaactcaacaacttgagagttattcataatttatattcctaagatttgacttaaacattgttctaaacaatttactttacgagtatggagagagtattatatatgcgtgcaatcaagtcttaaaagccttaaatgattaattagttaaaagaagatattgcagtctgaactgagaaaatgatactagtagatttgtcgtgaaaagcacatttatatggttgtattttaatatcttttataaagatatagttagaaaaggtagcagttattgacactatgtcaatgttttaagtgacgagtaaaaactaaaaagtaaccaagttagttatagctatggctatggctatgtttagatctaggggtgaaaagttttggcgtgtcacatcggatatacggacacacatttgaagtattaaacatatactaatagcaaaacaaattatagaatccgcatgtacactgtgagacgaattaattaagcctaattagtccgtcattagcaaatgtttactatagcaccacgttgtcaaatcatggagcaattaggtttaaaagattcgtctcgcaaattagtcgcaatctatgcaatcagttattttttagcctatatttaatactttatgcagatgttcaaacgttcaatgtgacagggtgaaaaattttgggtgggatctaaacaggccctatgtcaagttaggccctgtttagttctcacacaaaaatttaccccctatcacatcgaacgtttgaacacaaaaaaaactaattgcacagattgtgactaatttgcgagacgaattttttaagtctaattgctccatgatgtgacaacgtggtgttacagtaaacatttactagtgacaaattaattaggcttaataaattcgtctcgcggtttactggcgaattatgtaattagttttttttattagtatccgaacacaccatacgataccctatgtaataattgatgtgacacatcaaaactttacaccctgacccaagatcccctatactttctgcttgtcatctaggctggttgccactcacacacacacagccactgaggagcactttagaaggttcgttgtgaatcccttttgattattccgtacataacgcatggaaaagaattggagtaggggcagtctttagttcacttcaaactttaaaaaaattcatcatattaaatgtttgaacacatgtatgaaacattaaatggacaaaaaaaaccaattacatagcttatatgtaaattgcaagactaatttttgagcctaattacaccatgatttaataatgtaattctacaataaatatttgctatgacggattaattaggcttaataaatttgtctcgcagtttacatgtgaaatctataatttgttttgctattaatctatgtttaatacttcaaatatgtgtccgtatacttaaaaaagttttggcacccgaactaaacccgccctagtactagaagaatagtgttatggttctagtgcattcaacccttctcttttcttgacatgttagctgaaatgatgtatcagtgctagctaccaatacatatatttggtcaatacatactacgcccttattagttcctaacatttttttcaaaatttcaattttttcattacatctaaacttttctacacatataaacttttaattttaatcaaacttttaattttagcgtggaagtaaacacactcgtagtaacactcgtagtatttggagagtcagaaagttggagacgctttgcatagtttgacagctgctctcttttgaccagctcaacgggtcatcagaactaggcaaattcttttgttttttcggttgtaatggcatgcacaatgtatcttacctaactagtaaataagatgggccccatgactaggaggtagtaagctgcaactcttctcacaatgcttatatgagtgtagtggtaaacaaggtggggtccacctgaaaaaatctatccatcccaaccctccattacctgaatcctatcagaatcttcatattttatttggttgttgccggcaatagcgcaaataccaggtagtaactactatctcttcccacaatgcttactactggatactggatagtaggcttaaaataaatgcttgttacctgattttttgttacattgtggttgctcttaagtcgtaggaagattctaaacgaatgttgcattctagaacaagagagaattctctctgaaaagtagtagagaaaagtggtactactatggaatttctcccaagaaaagcccatgttggaattcccaatctgaagctccgtttcttcctggaagcacagttgtctacacagttctccgaatagagcggttgttccggttttgccaaaaaaaaacgttgtttaaaccgttgactagcagtgtaatcggacgaaaatctattaacttattaaagaaatagaaaaataagcctccacgttcgctctcaaagcctagaaattctcacattaatcggagaaaaagaaaagcagagtccatatagaaatacaatttagaaatagttaaaattcagaaataaaaaataaggaatattggaagaggagactagagtatatgccgggatataatttagagcttatggaaattcggaattaaaaaaatattgaaagaagattatagagtcataatttagaaataactaaatttcagaattagaaaaataaaaaattaactgaagttcagaactagaaaaataattaatattgagaagaatagtatagagtccatatagaaattcattaggatataatataaattcggaattaaaaaataaagaatattagaagaagagactagagtccctataggaatgtagaattaagctaaaattcgaaataaaaataataaaattaaaagtagagtttagagtccatatagaaatacaatttacaaataactaaaatttgaaattaaaaaaataatattggaagaagaaccaagagtctatataaaaatacaatttacagaaaatgaaaattcgaaattaaaaaataagaaatattgaaagatgaatctagagcccatataggaatacaatttagaaataactaaaatttaatattaaaaataattaataactataacgtatatacaatacagtatgaatattacacattggtatttgctaaagtaaatacaaaatttagaattatgttgtcattttaatatattttaataataaattaagaaaatatatatgctattatatgagaaaatataatgatgctagccgtacaatatgcgatgaccaccatgctagtttatataataatttgattttttttaaataaaattgattagaaaccgtgcgaaccgaggagtttgtgttttcaagcttggttcacgaaaaccagctggtttctatctgttttgtaaaccataactacaaaaaggcaacgtgtgaaagagttaactaggtagcataattttgagtcgatgtgaaacgagtgagtgccttctggctggctcacagctgcataagggcacgaccaatgcaagctacaccatctgagttttcttgaaaaaaaagaggactctacgtcgaagaaatcattaaaaagtcatatatttcacagtgcatgatacacttgatttcttactaggactggtatggatttttttttgacaactatctgacagtgaggttctgtcaaccacgtcggtctaaactgagcaccgagcaaccatgtagagacacgacagagtgcgacgtggacaaaatcttttacgcggcacctcgaatgcacacgccatgtcactgctctgtgaaaggcctaacagtatagcataattctgaacagtagtagtactgcatttgggcaactgtcaacagggtagtagtatcactcgcagcaacaggagagtgagtgagagtgcaactgggacgaaagggatgtccaacgagaccacttcaattcccccaaccagatcaccgtcgtcagagactcagagcttaccaaagtcttcggagaaacgaaaatcaaagagctttccgggcttctgcttcacaactttgccgtctacttaaatgggtacttggcatccacttaccagttaaccacttcctactttgcagtacgtgtacgtcatcgccgacgccttcaagttttgccgtttggtacatcatagcacagaacgatcgagatggtgcgcggtgcttaattgggctcttgggttctgtaatactgtgattagattgtaactgttccttccattttataaatcgctttgtatcttatattaaattaaatttattttaaatttaattgagtttataaaagaatataataatatctgccgtatcaaattaattagttttattaaatttaacattaaatacattatggtcgctgtttgttctatcttaaaaatattgctatattatttaaaatttgatcaaacttagaaaaaaaattttagaagagaagatctagaaaatatcattgataagcgcctagttccaagaaatattatcgataagtgcgagtttcataaaatatcattgtacatgtgactttgtcccaaaagaccattcctgataggatttcgttaacaaccctccgttaagtgctacatgatgaatagtatatttaacgtgacggtatagatgaactctgacaacgacgatatttttatgacaaaattgcttgtacgatggtatttaatgggattcacgctagtcgatgatatttttcggacttgatcgtttgtcaatgtcattctttagattttctctcaaaaaattaaagccttataatataaaataaagaaaatagtactaaatgcggttgaatttggtaacgtttcctggaatcgcactttctttcattttgaaaggtttgtagacttttctttcgactttgacgggtttaaaagaacagtagtgtactttagagtgctggagaagttgatagaaattattgcatatttaaattacgttatcacataaaattcacgatgatgaaaaaaaaagaaagaaaaaacaatttgattcatggattcttggaattaaaatatagttttacgaagtgaattagctcaactgtttaggttgtttgtgttaaaatatagtttgaattacgaagtgaattagctcaactggtgagtacgcacgtgttataagcatctacgtttctatattgtgtttctctaagaaaagtcaaaaccgctactaagagtctattatgtaaattgcaccttccattcatatcgaaacctacaaccacgcttagcttctgaagatctcatactccaagagcagatagcgagatcttttttttaaaaaagttcacataagacctgaatatccaaatcaaaacatcacaggtattcaaacaactgaaaaaaaaaagctacgggctcagttcaaccctccagatgttttatgaaaaaaagtgtgtttcatcaactttcaaaggaggaaaataaattcataggtgatagaggtttactaaacaagctgtcactttttttatagtactggctgaagataaaagattaagtaccgacaaagctattaacgtgtgattagtgattttttttattttttttggacttttttaattttttaataggccttttcaaaaaatatagaaccttttggccacaccagccgagtaacttgtgtagcagctttgttttgtcacgccaaccatgatgacgtgacaatagactggtgtggcatgacaacactgatatgccagctgcacatggcgtgataaagtgaattggtcagacggatggcgtggccaaaaggttcagatttagaaatacttttcggaaagttatattaataaaactaaaaaatatctaaaagtataaaattaaaaaaaatcatgattagttaggtgtaaattattctatacttaaaaatagttttatctaatattttaaatcaacttatagaaaattttcttacgaaatatactacttaacaattaaaaaacatgctcacgaaaatcgagataaaatctactatatcttaaaatgaattgactagtaaaagttgagatatcacttaacactatgaatctggacactaaacacaatctaaactcgaccttaggttcataggctgtatttagttcacgctaaaattgaaaatttggttgaaattgaaatgatgtgacggaaaagttggaagtttatgtgtgtaagaaagttttaatgtgatggaaaagtaggaagtttgaagaaaaactttggaacaaaacacggctatagttttaggtgatctcttatcttttattgttactatctctgttctataatatagatttaggactataaaatattactctgatttcaaattagaactactatatatcatgggacgaaagaaatacattttaagacggggatattatttagaactggcctatttccacgtttctcctcgtgccccgcactacagacctacagtatagtttattctttctatatgtctcatcaaagatgtcctttttcacggtccatcccagccgtcggatccccaggcggtggcaggggcaggacggtcattgcacaccccccggcgccacgcagagaagaaaaagcctcggtttttaaggtcgccgtggccagcagcggctgcgatgcgatgcgagcctgtgttgacagcggagaaagcagtgtaatccggtcccgccaccgcagccgcctccacctctcttcccggcgccaatggccgcgtcgtgaagcgcagcagcagcagcagcagcggagacagcggcagaagctttgcctaaggtcggtttgcctccccgcctccgccgcattccggttggagttttgtccgtgttcgtcggcggtttcttggctggccggatgaattgttgtggggagggggagggggaggggctctctcacgcactcgctgctggatttcggttaggtttcgcggctgggggaatcgcgggggaattcaggatctttgttttgttagttcttctttcgggcggggttggatctcgagtaatctgcgtcgtgttatttgccgcgagatttgggtgttttttttcttctctccgcatcttctctctcgttccttcgtctgtacggtctagtggtggtctacgggctacggccgtggtaaaagtttctctagatttttggtctcgtttttttctttattttaggcggcttgctttgcttcgcctgctttgacgtttgaccagcggtttatcctcgattattcttcctcgtgagtcgtgagcaagctatgatttgcagctaatgatttttgtgcttggattagataaaagatgcttctcactcttcgtttgtttccattttctggaatttgtgatttcctggtgatgataatgttgtgctcgtgttgattcaggttgggatcctccctattcgcgcgcgtctttgatttggcgcgtaaagttgtaatccgtactccggatggccggctcaatcgccgcctcggcgttcttgccggggtcgccggcggccgcgccgcccaagagcgtcctgggcgagcgcccggacagcctggacgtccgcggcatcgccgcgaagccgggctcctcgtcgtcggccgccgccctgagggccggcaagacgcgcacccacgccgccatccccaaggtgaacggcggcagttcggcgctggcggatccggagcacgacacgatgtcctcctcctcctcctccgcggcgccgaggacgttctacaaccagctccccgactggagcatgctcctcgcagccatcacgaccatcttcttggccgcggagaagcagtggacgctgctggactggaagccgaagcggcccgacatgctcaccgacacgttcggtttcggcaggatgatacatgaggggctcatgttcaggcagaacttctcgattaggtcctatgagatcggggccgataggacggcgtctatagaaacgctgatgaaccatttgcaggtgaaatattgtgaattttcaggcgtcggattgctcgggctgggcatcagaacattgaaatgtttttggttttgatgcaggaaaccgcactgaatcatgtgaagagcgctgggctgctaggagatggttttggctcaacgccagagatgagtaaacgagacttgttctgggttgtcagccaaatgcaggcaatcgttgagcgttatccgtgctggtataatactataatttcacatatcagcatgttcttggttttgttttcttacatagtttgagctccaaatagggtgttgcttttctgctttcgtgttacatgacaattaggaggcacatagatgtatggttggctgtcacagtacgttactgtagttatagtagctatcatcttgcttcacagcagtcatggaataacaggtttaggtaaatggagttttcaagttgtttggcaatgaatatgaaaaagattttcccaagtgtttgtatcaattttaaatggatgagcaactcccatctcttaactgtttttgctatcggcattaaatatttgtgcaactggtagactttcagtaaacgatgatgatgcagaagcctcctgtgctcttaatattattgatcatgtatcatattttctgtgagatgttataattgttcgtgtttgttacctgaaagtgccatgttgccaataattaacttcttatctgtgtgcaggggtgatactgtcgaagtagatacatgggttggtgctcatggtaaaaatggaatgcgcagagactggcatatacgtgattctgtaacaggccatacaatattgaaggctacaaggtttgaattattgtcactctcataaatactgatgatcatgaaaactgtattagcatctgctattcaacttcctacccatcttattaccactgtttgcatatgaagtctagaagttctgtttcttctgaacatattataagctgccttacagcaacatgaagctacctatttgtcctaattgtttgctcaatgtgcagtaaatgggttatgatgcacaagcttacaaggaggctagcaagaattcctgatgaagtacgtactgaaatagagccatacttttttgagcatgcttctattgtagatgaagacaaccagaaacttccaaaactgccagatattgaaggtgctaatgtagccaaatatgtccggacaggcctgactgtaagttttgtggaattatacaagattacagtttacaagtatacaaaatgtgcatgtttttctttcattttttacatcttcttctgtctcataatgcagccacgatgggccgaccttgatatcaatcagcatgttaataacgttaaatacatagggtggatcctagaggtaaaaaaagttcccctattatgttcatctttattgcccttgctaacacctcttgcctagatgattcttgagggaaaaaaatgcttcttgaagttcagtatgttactttcagaaaaaatatccatttgtttttatttactgtaaacactccatggagttgctgttaggcatctttgtcgcggtattcattattaagttgtcacatggtggagcataactttgtgttgctttacttgcctttttctctttgggcatacatttagtactattgatggtgctacataattcaaagagattcatttatctcgctatatttcccatatgttatgttccaagaatttgggaataaacagtaatcagaagagtactggatttgtaggtactttattttttgtgtgtgtgtgtgggggggggggggggctcagatcatgcctatgattaggcattactgtaggagtttagataaacttggtcaaggtcccaaaagggtgtgcctatggttctacaagtgtccacctaactttatcctcaagcacgcaaccacttatctggcagctttgtactctttcaagctatacgaaaaatatctgttgcactagttggagaagtaatgtatcctagcagattttactacattaggttggtcacctacgtacctaaccctgtacgcttgttgcttccgataaagagcttggctggaatacttatatgcaatttgatcacaagtcattcacttaattcaattttttttagagtgatcaacacctgcatataatgcatatttgcctggttgacaatctgccgtgtgtatgtgtgttttggaagaaggggaggggtagtcatgtatgtatttatccagtggaccacataatgaggaaaaagaaattgttcaggtgacctgcaacctagatgggcccaaaacaacccaaaatattagggaaattaacacttcaggcatttcctaacatacagaaatatttattaccaacatgcgcacatgttgcttaaccctacctttttgtccttttttcccctcagagcgcaccaatctccattctggagaaacatgagctggcaagtattgtcctggattacaagagggagtgtggccgagacagcgtgctgcaatcacacactaccgtgtacactgactgcaacaagcactctggacaaaccactttgcactgtgagcatttgctgagcctggaatcaggacctaccatcgtcaaggccaggaccatgtggaggccaaaaggaaccaggccccaagagagtatcattccgtcttcgtcgtgaagcgcgtaaaatctttcatgtgttgattttggtagcaacaacttggttaaaccaaggacaagtggacaacaacttgtgttctctatggaaaggcaaaacctggatgaacataacgacggggacgtaagttatttacagacaaaatgtatggatttggaggagttcaaaagaggggggggggggggggggcaagatggaggtaaaatgcagaaaagacagaaggcgtattgtgcatgatttgttgtttcagcttttccttctatttttcctttccttagcaaagatattcaattacacagatgggtgttgtaagtattgaaattgtagctactgctgtacaatgggaagtgaaatgcttctcatgcatgtttctgtctgggctatgtctatattatgagccctcgaaagcagattgcctggtccgaattgtttgaaattttaagtttatatattgtattgattgatatttattttgatttttgtaagtttcttctcttctcaattctcatgattgccaaaccgtgttgaaattttggatctgggtctggccttgtccaatcttgaaacaaactatattttgtcagcaactttgacttgcttaactgaagtagacagattgacgtaagcaatgacagattcacagatccagtttgtattttaaataacttcatcctgagatcttcccacatggtcatgttactgctttttttaaatcctgctttaaaaaaataattgggcaactgaaaccacactggaaaaatggaagcctcggatgcttggcatgttaggaaactaaagcgaaaaaatgattccgtcaattaggttattattacgattcaacatactcctactcaggggtattaaaactactgaatatactaccaacgtcagagatttagaggcaaattcagaagagtagcagaagaattcacgtctctgctaatggtccatgatatattactactttggaagaaatgaacagctaatagaaaaatgtcaacccatgagtgattagtttcttgcttacaactacatggaacggtgttctttgtttggaatttagaggaatcatgcatgtcgttttcttccaagttcgtgcagaactcctggacaccggacagaagtataaaaactcaagttgattgcggaattcgcatgcgagtgtatggcattgagattgactcaaacataaggtgttacgttgatcaaatgctgaacttgtttattgtcaatgtgttgttgttggtcacttggttgttcgagttgggttacctaagttgatattgatgggggtcttaagcgaagattgtaaggaggaaagacggataagcaatgatttattctttcagaagtcttctgtgttctgctacgaggattgatagtagggtactgcattggtgaaggtttcttagtcaccaatcttttttttataaataaaaagataatgggtagaaatacagcctttatgttcataggtgaatatacgaaaccaaagattacatgaacatactgaattcagtttcagttgccgagttatgttttctatttcagagcttgttcttcttccgttgtgtcagtcagcaaatctggcactgttgcttctctgatcgttgtgtagttcagctctgtgttgccagtgttaacaaccaaatttggtaatatcggtatcggaaaagaagattagatcgaagtggagttgaaggcggagatcggttcgagaacaaagcaagaatcggctggagtccagatcggctacgattaggatcggctgggtctgagtcgtattaggtaagctgatgcagccgattccgacaatacgacttgatgtatgacatcgggttaaatcgaggtacttctagatgattgccgcacatggatagagtcctgagaaaacaattgtatctattaattaggatattttatgtaatttccttagagatatgtttgggcaaaagtctgccgcaaagacttatagtatcttagagtttgttagagataagagtcgtatccggtatggacatagtttgtaattttcgggtataaatagaccccgaaccccatttaatcagggaacacacatgttcaatacaatttcggcgcatcgccaccttttgcttttgttttatttcgacgagttcttgctttcgggttgagctgcattggtttcgatcttcaacaagaggtaaaacttgttatgatggtttgcgttctcgggattagtgcttccatcttcatgatactctaatcttgtttatgtaattcatcgagttatcatatatcttacataatctctagcaatatcgttatctaacctataatcggctaacatctgttagcagagggcagccggctaggttagattttgacgttggtttagtttatataagatatccaccaccctatgaaacctccagcggcttgattgtatagatattgttcttcttttcatacttaatgctgcatcagttgagtttgatctattaagtcgtgcttagaatatcaatctctagcctgccttctggttgccgattagagtagcatcggagtttcagccgatcttatctgatttaactatatttgctctatatgcttcattgatacgttaaatatgtcctttatgtcaagatattattgcatctaagtatattaagcttctgtttggtatattctgcttgttttaaaatcttgacacagagttgtatcggagtattagccgatacatgctagatctatctgatcagctatgttatgaacatatatagtcccattattaatatatatttcgatctaagtgatttatactgtctcggcatggcgaccgatctatcccaatcacttgatttaaatatatatcgatataagaattatatattgttaatatctttagccgatcgagtagatttagttctttattatctatttccaactgccgatcgatctacatatgacatcggctcagagataaatgatatgtcatcggcacttagccgatcggctatcatttatagatttaactgcggtttctttgtctatatttcttgttgattgcaggatcaaatcaactggcacgctaacacacccgaagacgagttttggacatgcactggagttaagcagatctcccagacattgtgttttacgtcaacagccagaaacactttgtatgatcttactagatgagtacccgcgggttactgcgggataattatgtgaggctagaaacaattgagataatatggttccataatagaagagagaattaacattaattatacttagtggagattaagtttacatatatatatatatatatattgtacgattttctttcatatgctttatatattttgtatattaatcaattattcaaagattataaatgattaggttgtatgttgtggtttatgagagaagagaggcaatttgcattcttggtgaaatcatccaaaggctaaaaacaattaagatgatgtgactttataaaagaagagagagttaacattacctatatttaatggagataaactttatagatatataggattacaagttaagcagttttatatttcttgcataaggaaacatatcctctaacttaaaagatacggacatataaccccgctacataaaagaaaagatcttcttcgcttgcacttaccatgcggcagacatccaccagtacattattagtactggatgtagtggtaacctctgaattcagagcggcgccaaaagaacctaaacagcatgactgtggaacattagtacattgatgattcatcattcagtattcataaacggatcagatcgtaacagcatgattgtggaagacattatgcctacgttgtactatttcaggaccgtccgcatcagttgcacagcacagataaaaggtatgaccttttcaaagcaaaaattggttcacaggtaggctcggcaggggaaaaactaatgatgttgggccacattttgtctactctcagctaggcttgggattagtccggttgactccctcgaatatgagtgtaatctgatttgtatccctcaactataatactagatatctagactccccaactataaaaactggtgcaactattaacttctaaaatagtattgagagtggtattcgctaatgtggcgttcacatgtcatcccagtcatcaaagaaaattaaaaataaagtaagacccacctgttatattcccatctctctccctttccttccttctctatcccacatactctcttaacgatgttttctccccatgtcaagggagctgggcggcggcgacaacccgatgtgtggtgcccccacgaggagcggcggcgtggaacggtctccggctcttcgccgacaccttccaccaacaataaggagcggtagcgtagagtgaggatggcggcacggagcggggacgaggagcgactgcgtggagtggtctccaccggcgccaaggagcagcagcgcggagtggggatgaggacggcgacacggagcagggacgaggacggcggcgtggagcagcaaagacgagagaagacgagtagtagcggtgtggatcagtctctgcctacgctttccaccgacgatgctgagcggggatgaggagcggtggcgtggagcgcgctccccatcttccctgatggccgatgccttccaccatgttgttccgtctccgccaccaaaattgtgccgtgaatgaggaggtgctcagggtggctgatccaagcctcgtcgaggcaccgcttgatgcggaaggcctgcgatcacatcaggttgcagccaccgtccaactcccttgccaccgttgtgcactcctcaatgttccatccccctgtcgtcgcccgcccgctcatggtggagaaaacattggggagatagtgtgtggggtagacaaggaaaggaaagggaaagaaaagggagcataacaggtgagtcccgctttattttaagtttttctttgatgactaggataatacgtggataccatgtcagcaaatactgctctctgtactgccctgggagtcaaattgcatcggttttaatagttggaggaggatcaagatatctggtattacggttggaaatacgaattagattacactcatatttaaaggagtcaaggtgaaattattgagctaggctttagcctaccacaagagcatcgtgctattgtatttgcagccctgcccctcactcgtgcacgtggtgttttattttttctttccctcgtttataaatctcgaagcaatgtataacggtccaacggtctaaattttgacaaattttctatagaatttcaattgacaaatatctagcaaaatacaatttcttttatttaccgataatgatgagtagtacacaatattagtaccaacaggatgcagagtagcattaagcatgctacagcgacacaacaatccgagacagaatccagatatagagattgtagatttggctatgatatcgtttgttagctcagaatcaagagatgttgatctaatagggaggaagtatttttttttaaaaaaaccagcttaagaggtgccttttttttgacaaattgaccctttacaaaaacttatttcaaaaataacccctaaaaaaaacttcaacaaaaaataggccgtcggctccgcgccaatgctcttggcgctgagcttatacacagcaactccaactggtctggcgctgacatcgtgccaccatggcggccgagccgatcccccagccgacgtggcagggacctcagcgccaaggcaattggcactgaggtggccaacgtcagcaccaagcgcattggcgctgacttttggaacttagcaatgtctctgatgggtgctctacctggcgctgagatttgaaatctcagcgtcattttgcttggcgctgagtttgcagacaacacagcaacctgccggctatctgcgccatatcaatagcccaggcaagttacaaaagcagcataggcacattttgtcataaattcaacatagtaagccatttcatcaaacatccatccattccatccatttcaacacacaagcatacattgcagcacaggaacacaactttcagaaaccatccatccattccagcagaagcaaacattgcagccattccatccatcaagtccacacatagaaaataaaagtcgtagtccataaacatccatgcactttgtgaaaactattgaggcaatctacctctcgtggaggctgttcaagtcattatataccagacagagatacaacaatagtacaactcaagaccgaatcgtatattactaacctatacagattctacatacacaaggaaaacacctatacagcatcgaaaacgaatcagttatgcagtaacgtaagcagcagcatctctattgtttaacactccccctcaatcataactttgcacaagttaagattgttcctgaaaatttgcaacttgcttagagattgtgccttagtgaaaccatctgctaattgatcaccagaagatataaaccggatatccaacaaccgttgcgcaacccgttctctaacaaaatgataatctacttcgatgtgtttagttctggcatgaaacacagggttagcagagagataagttgcaccaatattgtcacaccaaagtactgcagcctttggttgtgatactccaagttccttaagcaaggtttgaatccaaatgacttcagcagtagcattagctaatgccttgtactctgcttctgtgctagagcgggaaactgtagcttgttttcttgcactccatgatattaaattggaaccaaggaaaatagcaaaaccaccagttgaacgtctatcatctgaacatcctgcccaatctgcatctgagaacgcactaatagtagtggagtctgatcttccaatttttagaccaaatgtcaaagtgccactaacatatctcaaaactctctttaccgccgtccagtgcaaagttgttggtgagtgtaaatattgacatgccttattcaccgcaaaggctatgtcaggacgagttaacgttaaatattgtaacccaccaacaatactcctatactttgtaccatcttcttcactcaacagtactccacctaccgatgaaaacttttccgaaacagcaagtggagtacttaccggtttgcaattccttaacctagctctactgatcaactcagttgcatatttcctttgtgacagcaccaaacttccttcagatgacggcgttacttctatacccaagaagtaatgtaaattaccaagatccttaagtgcaaactcagcattaagatctttaagtaaagcaggaatagcttgatcacttgagctaaccacaatgatatcatccacgtagaccaagaagtatataaccacattacctttcctatagaaaaacaatgaagtgtctgccttggaagcactgaacccaagttggcatactttgtcatagagacgataataccatgctctaggagcctgtttcaaaccatataatgctttgtctaacttgcacacataatatgaagaagacttatcaacgtacccaggcggttgcttcatatatacttcctcttccaaaatgccatgaagaaacgcattcttgacatctagttgacgtatactccaacctttggagaccacaagagacagaacgagacgaatagtagagatcttaacaacaggactaaaagtatcctcgtaatcaatgccatacctctgcttaaatcctttcgccaccaaccgagctttataccgatcaattgtaccatcagattttcgcttgatcttaaacacccacttgcaatcaataatattttttcctatcggtgcaggcactaaatgccaagtattatttttaatcagtgcattatattcctcatccatggccttcttccaattttcatcagctagagcatcatcgaaacaagtaggttccttgtcagaaccactatacataccccatctaatcgttccatctgtacgagtaagtggcttacgaatattactttgaagacgagtatgaggccgggacaccacaacaggctgaatgttctgttgttcaccttgctgagccatagaaggtccagaatccgcagaagattcaagagataaagtctcagtagatccagacatctcaccaccagaaacggacaatcccggcgtagactccgaaccggaacctgccgcaccactcacgtgtgacccaggagaacaagttggtgatggaggtgcagattccgaaacatgcgacacttgcggtgaccccgaaacagatacttctggcatatgagtagaagaagctggaccaatgccagataaaccaccactattttgatccagattatcatcaccagaatcttgtacgtacaggccagcactagaagcattgttaggagcattagtctcaaaagaaaaactattaatcataccccttgatgataacaaagattctggaagaagagaaatttcagctcgaagttggtttccagcattggaatgaagatcaacaaagggaaaaacagtttcgtcaaatataacatctctagatatatagacccggcctgtggaaatatctagacacttataccctttgtgatgaaaactatacccaaggaaagcacacttttttgaacgaaattggagcttacgtttgttataaggacgaagatttggccaacaagcacaaccgaaaactcgaagaaaggaatagtcaggcttagtatgaaacagaagctccaaaggggtagaaaagttaataactcgactaggtatacggttgatcaaataggtagctgtgagaaaggcctcatcccaaaatttgagaggcatcgaagcatgagcaaggagagctaatcctacttcaacaatatggcgatgtttgcgttctgcagagccgttttgttgatgtgtatgaggacaagagatatgatgtgctatccctattttctggaagaaagagtttagacgatgatattcaccaccccagtcagtctgcatcgtaagaattttcctaccaagttgtctttcaacaagatgctggaaattagtaaaaacttggaaaacttcggacttgttctttaaaagatagatccaagtaaatttactataatcatcaataaagcttacataatatttgaatctccccacggactgaggagcaggaccccaaacatctgaaaagacaagctccaaaggagcagacgaccgactgactgacctagaataaggtagttgatgactcttagcttgctgacaagcatcacaaactcgctcttccctcgactcactaacagggatattatgttttctaagaactctagtcacaaccgaaaaagaagggtgaccaagacgactatgccacctagactctgcagaactagtagaaacaagagcttgacgtccctgaggtgtagtagacttcaaaggaattggatacagaccaccccgggatctaccttgaagaagagtgctcttcgttgtttgatccttaacacaaaagaatttaggatgaatttcaacaaaggcatgattatcataagcaagacgatgagctgaaactaaattctttttagcctcaggaatataaagaacattattaagagcgagatttcgattaggggtatgaaaaatagtccttcctatgtgacttatactcatacctgcgccatttgcagcatgaacttgctcattaccatgatacctttcctttgtcataagtttctcaagctccccagtaatatgatctgtagcggcagtatccaaataccaatttgtatctaccccataagaagatacggctgatgccgactttgcttgctgatggtgctgctgaaagattacatcgtctccagagaacgatcgatcaaaacgcttccagcatgtatgcactgtgtgaccttccttcccacacaattgacaggaaggtcgagaaccatctccacggccacggccaccacggcctctgccaccaaaaccactaccgaaattgctgccaaaaccacctcgtccacggccttgaccttgtcctcgtccacgtcctcctcgtgacgcgctgttagccgacgagtgatagcctccttcagattgattatttagatgtgcctcaaacgagagtagctgggcatatagatcactgagtgatatgtagtccttggaggagaccgaggcaaccagaggattataatctgcgtcaagtcctccaagaatatatgaaacaatatcatcatcatcaagtttcttcccagctgcagccatctcatctgctaatcccttcatcttagtgaagtatgcagcagccgatgaatctcccttcaattctcgagccaattgcgcacgaatctgaataattcgcgccttagattgcgaggaaaacatctcgttaattgcagtccagacttgtctggcactctcaagatgtgcgacttgcaccagaacttctcgcgaaagcgtcgagagtaaatacccgagtacttgttgatcatgcgcaatccactgtgaataggctgggttgttgacggattccttcaccaaatcgtcgcccacctttttctccaccgtgatctcaggtgatggcacctcttttgtgccatcaagatatccagtaagctgtgctccacgcacggccggcaaaacctgcgctctccaaaccaggaacttgtctctggacagcttttcagagacgggatgtcctagcactgccaatgaagacaaagtcgacgaagaacttgatgccatgactagatgttttgtggaagaggatgctctgataccatgtgaaaactattgaggcaatctacctcttgtggaggctgttcaagtcattatataccagacagagatacaacaatagtacaactcaagaccgaatcgtatattactaacctgtagacccccgattttgaaaatcggaaatcttctgtgtttatccgtaccaatccctggatcagtagttggtacacacatacatagttggatcacaacatatcacgaatgaatttaggctaaaagagttaaacacttacattagggccaggtaggccaacaactatcagagaacaacagcggaagacaaaataatataagggcccggttaacatgccacaggcagtcgactggggaacgagacctagaacaagaccgcactccgatcatcttgtgggatacacaagcgtaccgacaagggcatctcttcaacactctcctaaaagatatataaatagcaagggtgagtaccaaccgtactcagcaagccaccacaacaacaatgcatatgatagagggtattcaaggaatggttttaggttcttttgcataaagctgcgttttgcaaatattttcacaagcctaagacctatcatagactgatcaaattttagtttcagtgttcacattaaacaacgacggttctgtccaccatccattgtgatcccaaggatagcttcccgccattgagtcgtcatggttttctgaggacgtccaccttccctccctctcaggaagtggctccatcagcataaaaatcaccatgcaatatcccatcccacacaagttaagaatttagagtctagccaagtgtaatacatgtcccggtgctcattaaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctcttggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcaaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaatcaggggtacaaggattttaagggtaaacaataatcaaggcatggcataatcacaagtaggacgttcatcattgcatgcaattttatttgtaaacaagacaatttcgcaattaggatcaacatgttcaaggaatatgtgatgacttgccttgctcaagataatccttattattgatataatcttgatcaaccttcacctcctggaagttgcagacgttgcctcacgactaaccgatacacaaggtctataatacgcgagaaaaaccaatattcaaacaacaatcaaatatgcacaaacaaaatatatttgctgaggtcgaacctagggttgctcatattattcgcgcttgctaatggactctaatcaagctaagagctaaggtttcttagtctttctcttgtcatggtggttcagtctagctaatggctaaggaaggattatggttacacatgcatctatctaaatagaacggttatacactagaggttatgttgccggatggattttggatcggtcaaataattactgtgaatcatttgtattattattttattaatggaggctttattttaattatgtacatatttcacttgtcaaaataaattataaaaggttaacaattacccatgctttg

SEQ ID NO: 67249 - DNA, 23712 bp, Oryza sativa
atttcttgcatgtattcgacgaagggagggacttccctaaacggctaataagtcatcagtaaccgtttaggaaccgctaccaatggtcgtccttatgctggtggataactaaacatcgtccttatgctggtagataactaaacagaatctatttcacatgttaatctttcttccccactagaatacaatctcacaccctcgtacgaatttgtcaacccatgtagtgcaggtacacacttcacgaaatttttttatttatacattttttttattaaaatatttacaaaaataatttttatatttcaaaaatttacaaatctaatcgcgtgccgccctctgggagggccaaagggcggcaagggatctaaatgcaaattttccaacacaacttgttagctctatgattttacaatttaaaattatattatataaagtcagatgaaataaaactttatattaaaattgtagagctcaaggagatctacaactttgtagttaacaactttttcatttaatatgttttagatatccaaatattcgttacaaaatataaaacatattttaaaaaatctcagatctacatttcaaacaatattgaatggagataaactttatataaaagttgtagatcttaatgagatctataactttgtagtttatcacttttccatttaaaatcatttagagtatcgaataagcattattaatttttaagcaattaaaaccgatggaaagggtttgaacacaaataaaaattttgcatttaggtcccttgccgccctctggaagggcgatttttaaaaatcgccctcccaaagggcggcaggcgattagatttataaattttcgaaacaaaaaattaattttgtaaatattttaataaaaaatgtataaataaaaaaaattccacacttcacccgaaaatgcttcgcggccgtcccaatgtctggttctttctattgggccctctactgttggtggccctttttttttcccatttccccatttcctctgttccaccacaaagctactctctctgttcagattcgttatactagaatgtgtcactatggtagaatgtgtcactatggtgtatgtcactatggtgtaggggagcaagagaggtcaccaactagcgcttggtgtgggaaatcaggcatgggagcttgtcgaagatatgctggtgtggccaaggtgctcgttgtcatggtgtgggctcgcatcagccaatagcggtacaagctatagcgatgtggcatgcctttcttctctagtgtggaagggaggagaccgatttcttgtcactgttgggtggttggctcagaaggagaagccagagatttagtcactgaagataaggaagaagctagactaagtaggtatattttttgatttttttttatggttgagctaatatatcttgatgtttcacatgtgtttgaaaaaggttttaactggaggtaaaacgatgttgcatttgtttgaaatatgtacaattttacgattttacgattcttttgatgtttgtttttgatgtttcgccgatgataggaaaatgtctcaactatgtttaggcaatgttgtattttttgctacaattttgtctagtgatgaaatatttctatataaagtgacgaaacaactgtcaatttgccgttgtgtcccactttaccacacacactaatatactacttcataaaattattttttttgttcgattatcgaacgttggaattgaacattggttgaggtacttagtgatatgggaagtgcgacatgtgattagcgcatgatcaaataagtgtattataaatatacaaattggattcatttggtttctaagaataacttctataaagtttttttttaaaaaaatacactctccatctcaaaatatagcaaacttctaagttctaaaatatgtcccaaaataacacctagcttcaaaagtgcactttttactatgtaatatacaaatcctacccttgccttgttttctatactaagccaagacatattaatgcggggtagtataattgtttttacccgcctccttaataattgtgctcaactctaaaaattacgtagtactatattttagagcgggtgaagtattgtctagcagcttgagactcacgataaacaaaccaaaagagaaggtcattccaatagccaaaacaaacgatatctgaatcttataaatacgaggagcgctccaaatttataatttgaatctgtattgaatggttctattaatattaatataaagctcaagcggaaacattagtgccatggagtggtcaaaattagccattgctttgcgtttctaaatatctgcttaccttaccatcatatacttctaagtatcgtattggtagcgatgatctagaccattatttattatgctctaaagttcagaatctacatagatttttggtaaataataaagctaagtgttaagtgttacagagtatacctccatcccacgatatttaaatggaatacagtgatatactccatctgttttatattataagaggcttttgattttttttctaaatcaaactgcttaccaagtttatcgaataatgtagcaactcttacaatgttccattaaatcgaacattgaatatattttagttttatagttttatgttatttgctattaaaaattgctacattttattacaaatttggccaaacttatataatttagacttcaagagagtcaaaataacttgtaatatgaaaaagagatagacaaatgtttactacggagtatatgatactcccttcgtcctataaaatcaactactgactatgtatctaatttatatccatacttagctagaagtttgttttctattgatagtgggagtactacctctgtctcaaaagatataatgctagcttttgaaattacattacatggaaagaaagctacttagataaatggttgggattacaatggacaagaaattagaataaagattgattgtaggaaaaacaatatttcattaccatttataaaaaaagaataaatttcacatagacccaaatattatgtctaaattgcacaaaaccacaggagtttttgacacgttacatataactccaggtattatggccataaagtttcacaaaaccacaatattaatcattttaactttgatttaccatgcttttgagttctacaaccacatctcaaattttgatataggagtacgtcaatttgatatatgagactttaggaccataatatctaatgttacatgccacgtaccaaaatccatgtgattttgtctaacttggatcataatagatagatagggttttatgaaatttattcttaaagaaattaaaaaaatgagtaagttataattattatttttattacggagggcctaacaaaaattacaaaaacaagggaaattagtacagttgttttttttagccccgggccggcgtaggtaacacgcagaccacctggcgggacccacagcagccgtggccccaccctccccgctccaaccgggccccaccccaccaccgctggcggtggcggcgcctctcccgtggctaacaaaaaccctagcgcgccgccccctcctcctccttcttaccaccaacctctccccccacgatcgccctcctccccgaaacttctggaaccgagagcagcagacgttagctcttctcctccgatggcggacaaggagcccgtcgtggaccgccccgaggacgaggaggaggcctccgccgccgccgccgccgcgggcggcgaggaggaggacacgggcgcccaggtcgcccccatcgtgcggctcgaggaggtcgccgtcaccaccggcgaggaggacgaggacgtgctcctcgacatgtgagccccccccgccgccgccgcttgctctctctcctcttctcccctctcttgtagctcgtgtgctttttttcggttcgatctggtggcgctgatccgcgcgattgtttgcaggaaggcgaagctttaccggtttgacaaggaggggaaccagtggaaggagcgggggacgggcaccgtcaagctcctcaagcacaaggagaacggcaaggtccgcctcgtcatgcgccaggccaagacgctcaagatctgcgcgaaccacctaggtttctccccaaactaatttcctcctccgaatttccccgcctctctctctctctctctctctctctctctctctcttctcttcgggggaggattggttacagatgttgcaatcgcggtgcctgtgtagtatagattcatgtggcccaataacctcgttgctaaggctttgtgtcgtcttgtgtgcagttgcttcgaccacgaagatgcaggagcatgcgggcagtgacaagtcgtgcgtctggcacgcggcggacttcgccgacggcgagcttaaggaggagatgttcgcaatccggtttggctctgtcgaaagtgagttgttcgctcccgtcgtctctgggctaatttgttctgttgtagtcgtatctactatgtagtgtggttatccttgcttggtagtattatgttggatcatgccgtttgcttttgttcatggtggcaatagtagttttcctatctgagattccgttgaacgttgatgggttgcaatttttgcttaaccaaagttgtgcttaagaacatgttgaattgggggtacttgtgaatctattggttgtttcatatgatgtttctatgaggagtgttggatagctaaccttgaaggattttcgcacgctttggatcggatgggtgggataacataggggcaccaattcccctggtcttccctgtcattacagttttcatctaatttttaccttaataattattgagatttgtcatgttcaattttaagattctgttattagaccctatgaggtaaactggagatgggacaccatgatgtctctctgtttatgttgctacttgctagtcatgtggagaacaatcttactgaaacttaaaatgtacagaataataatgaactagactggtccatgatatttaacattctgtttacctcatgttttgttttttactccctccgtttcacaatgtaagtcattctaatatttgccacattcatattgatgttaatgaatctagatatatatatccatctagattaattaacatcaacatgaatgtgggaaatgctagaataaacggaggaagtatgtggtaaagtacacttgatatgtataattcccaatgtatatttttgtgtagctatccaggtgcacactgttgtggtagaacacaggttgtttgctcttgctggccattggcttctttaggcactattgcggtagaatgatttaggtacacactgttgtggtagaaaaaataggctttctttgtgttaacacatttttagcagtcgttacagattacattctttcattccttgtctgtaaaggtgaagtagtgaactttgtaactttcatgtgtttgtgggggcatctttttcttgaatagtacaatataatttttgccattagtaatgaacgtgtttattattatgtagctacaacattatgtctagtagcatctgcatgagcagcatcctcttcatctactatgttccatttgttgcacatatttcattctgttatttgaatcttctgaaaactatctgaatttaactgactaagattcctatcatataattcctagattgcaagaaatttaaggatttggttgaagagatttcggaatcacttgcaaagacagaaggcaaagaaaccgaggaagattcgtctgccgctggccttctggagaaactcagcgtaactgaaaagaagtctgaggaagtggcgacaaaggaggaatcgaccgaagcagtcaaggagactgacaccaaatcagctgccacctcagagtaatcagcagtgtgttacctccagaacactagtgctcggtgggaagggtaagtttgtcagtgcttcccgtctatggaagttaaaagtcgttagccatgagctatgttgagaacatttgggcagagtcggaagatgtcagggtcatctttacctattgggcgttcacttgttattatttatttgtttgtgtatggtttctgcttagagtcgcaggttggcttttggatcaggtctgttcggatctcgcttttatcgagaacacgaaatgtagtccatgagtaggacgagttggaacgttttgggtccgagttacgagtatcttgacagcaagatgtttatggatgcgtgctattcatataaattacatgataccatgttcaactctaatccagttgctatgggaaagacgatatttcatttctatgtccaatttgtcatatttctataaggtcttctcgtatatactcctgttggtttgctcaccatagctgctgtccagcaactgtatatctttttgtcgtcgtaaaaatgtaaaatcctccggttgatttgcttgccatagctgttgtcctgcaactgtacaggaaaaatgttgtacgtaacagtggtttttgaagtatatttacgcgttagtgattcacgattcacgtgcacattaaaatttggatccttttggtttagtttcagaataattcatatttttctttttttatttggtaaaatattgatgttgttcagaaatatataggctggagctagataaatgtgttgatttatgttatctactccctccgtccaaaaaaaactcaatctgacccctcctaagacaacgaaagtctagattcacatttatgtagctagataataaatgtgttgatttatgttatctacttcctccgtccaaaaaaaactcaacctaaccccttctaggacagacatgttagtttgtgttagtgtcttaaggctcagatctttttcttcaactccaaacttaaacttcattgtttttcattaacacactttgaaactgtgttttttaaaaaagttttctgtatagaagttgtttaaaaaattcaaataaatctatttttaagtttataattattaatcttaattaatcatgtgctaaagagttttttttgcctgtgctaaaaatctaagagaggacgtcgccagatcacgtggtaagggcgcattctcgatggatgattaacgacggaacacagtttacgaggattagtcgaaaggacaatgtcaattaagaaagttttaaaaattacagcgatagtaagagcttaaaaaacgtactacggtgctatcgataatcgataagatgtttgccactgaggacatgataatccatagctttgaattgctaaatggaataaaaatacttacattgtatcttagaagtgagaaataacaaagtaaacaatacataagagcaaagaatagaaaactaagctttgatcttctactgcatgatgagccctgtcacaccaagaaccgcactggatcgatcttgaaacgcagccctaacatgcattcttcatccatgatccattcacggattcacctctaacttgctcttactcaactttgcccatatcatcatatagatccattcgattcaaaaccaggcccctagagtttttgcttgccaactcatctagtatcagactatcagatagaagccccccgccccaacatagtgctatatggatgagattcaggtagaaacatctcagatctagcaaaacttgagaccctagataccgtgttgcatcccaaccatcactggcattgccaaccaaccttttgttattcgccggttttgcaactcactacagccgtctagctcagcaaaattcaaccgactctaacccttaggccagatcaaactaccgttgttgctgtcggcaatgctcaagtccatcatcttcacttcttgttgcagccacctcacgtccaaagagtactttcatgtgatgttttataactaaaggcgatcatatgctacaaaaatgttatcctgaaaattttaattcgtaagtacatgagtgatgtttaaccttgtaacttctgaattttccaaatattaggtttagatttgttcagttgattgtaaagttttgcagttgttactgaaggtgcacttaaactccctagtgggttttggtgattaatgacaaggtggttaaaggggactaacatgtttatcaagtttattcacaggagtttagtcccaaagcaagttgtgatggctaagaatgcaaggagaccccccaatttgaatgttcctaagtgcgaaaaacaccgaaggtgattagactaggtttttctctttcgaaattgagtttaggaaaaaccgtactattaagaggggtttcaagtgtggttctagggtatacaaagtgctcttagtcatttccatgagtcaaaatatttttggaatcatttttgcaaaatgatttttctccccgggacagagagggctacccggaggttttggccggaacttccgggcgccattgcaaaagcaaaaatttcctaagtgctgcccggaagttcctggcacttttgcccagaacctcctagcaggtttccagttcaaatttgtgagtaacggctagatgacgtcacctagccgttatatatatggatttcgtccccaggtcaccctttggccattccacttcagctctttcatgttctagggttttctagccactcccaagcttcctttgctttctccactcaaatctagagcctatcttgtgagattgagatattagattagagtgtaggagcgttttggagatggcttgaagattaggtttgattgagcactttggatatcttgtgggctgtcacttgggcttattactcttggagatcttctcctagatggttaggtgtcgcccgtgagcttctaaagatcttgtggatgtcctgggaaagtttgtgaaggttttcctcacctccgcaaggaaatgaggtaagtgagtaaagattcttgtattgagttttcagaggttgtcctaggtagagcaacttgcacttgtggtcttttctaaaaggaattgtgagttggatcttggtggtcactcaattctagaaaatgacctagaagtgttgagttgaaggatgtggacttcttctgggatctttgcataagtgaggcaaggggttaatcgagactcggctcttttgagcacctcaacggagagtaggatccgtgtgatccgaacttcgggaaaaaatcgcctttgtctctcttgtgcatgatctgtgtttaaatctgctggtatcttgagatttacatcttgtgcaactctgtgcctgatcgtctctagctaggacctgttttacttccctgtttcgttttttttgttgcccggaagttcctgactcaagaactccggaagttccgggatactcatcctgcccggaagttccggtgttcaccaccaggaggttccgggtcctaccaatttaaccgctatgattgttgagaaaatttcaggaaagcctattcacatctctgcacattcagttaccttcatagattcatgttgccattgctatatcttgcatctgccattgttgttcaagaccttattaagcatttcattaatcatgtagaaaattaacctgataaatcaaataaaatgtattagtgatccatttatgcaatcatgatagaaaacaacaacttcaataaatatcgactaacttcattgaaacatttctttttagacaacatgtattttacaacttcatggaaatataaccattaaaatttttgtttataagacaaaaccttttatctactgagttggtcactcgggtccatcctgatatttgtcttttgtgtcctctaagagaaaatatattttcattcaaagatatttagtcactattgatattataattgtatcacgtattaactattgcgtaggctatgtcaggcggatctagcactatgacatgctatttgggagtaaataaacaaatctgaggtgaatagtaacatgacattatccatgtggaatttgttgtttttgtttctttcaaaatgaagttgagtttagacaaaagatttaaaagatttagtaaccgtatattttatatctacatctatcttcagtaattttattcgtaaaattaatgaaaattttaatatgattttcacgagtttcgtgtttttccccaactagagaggggaaacctaaatccggaccgtaccgcagctaacgctatatactctaggagtacacgctttgctctacaccgataatacacacatacaccgccgcggcggaggcgagagaaggggaaaaaaagaaactccgcccaatcagccactgccacgcgggctcaggtcccacctgtcatccgcacggacccaccgcccttaactggactggttccacccccctccggttcagagctttcagaccgaccggcgaccgaccccaccttccctccgccttccccgaagccacgcttctcgaagctcgcttctctttctctctctctctctccggctcgacctcctcctcctccgcgtcctccattaccggtagctcggaatccgccgccggcctccgacgatcgccgccccctcgccgggcccggagatccggatccccgccgcgctcggtaagccctagagcttcttccccccatcaacccccctctcccctttcggcccccaatccgattcggccgagcttgccgggccgattccggtgttcgcgcttgtgggggcggctgctggagcttcggggaagggagcttggggtctatttggcggcgccgcgtggcggtgggtgtgggggggccaccccgtccccgaggttggggggtgctgatccgcgcacggggattgggcgtgggatccggctggggaagcttggggatttgggggagggctgtgcctatgcgagaggtcgtggtgcgtgctgggttgtgccggaattggctggatctccgggtgagatccgtgaggagggggcgatggtgtgcgtggatcggccatgtcgtgctaggggtctcgtagctgcaccgtggagccgtggttctgctttgaatttaggtaattctcgatcgttctgtgggcgatgtaacagttggtggtggtggccgcttggtttgatgagtggagagcaattctgattgcttcattttgagctttggtagctttgttaggttattgttggtcgtgccatggatcatggctttgaattggttgttcccagaactttggatcaattcggactgctgtcctttttctgttgtagcacggtagtatactagtatgtgtcatttgtgggtgcatttcagttggcgatggaggtggtcgaatggtcttgtttggtgctataactagtctgaaggagatgctagtatctttgttgatcgttgctcggccatatgtgttgtcatctgtggcatgattaagcagatttggtggaaggtgacaatgaagtagatatctcactgagatgtttgccgaactttatatcctctagtaattcacgcgtagttcatcagattttggaagaatagaggttgtcgcatttcacctagcttattgcaacttgtttgagactaaatgctgttgctgcttttgctgttgtagagctggttgcatatattaatacaatgttattgcattaatgtaacacgtgcactgtagaatctggcaacttcaattgtttcctgatttatgtatatttggtttactgaatgcatttgatgtctttgcaaattatgttaattgatcaatacctgaaaacaatttttggtgtattaatagcaaaatatgaacaaaacaagttatcacgtactcgaacatttacattgaaatagagtggtggtacaattttaaaagccagatgttttgtttggtaaaagctattattttgcaacgtactctggtcatacagacaactctggattgttctgaaaaattgatttcaagttcatctgctacttactgtgccttctataatgacaggtatttgtttgatttgagattttccactgtgccttggacatttgagttctatggttgcaagatgaggctgttgacatcctctggagacatgttgaacttgttaacggtctaaaagtttgtcaccagcagggtgatggcatctagtacaaaatctgacttgatgtctggtagtcctgatgggcatggatacttcagtgggcaacgtggactgtattcagctgcttcgttggaaaggtcagcaagttttcgtgagagtggcgatagttatgcagcattcccagtatcaggttcatcaaggtcaccagcagttgactctgctactctgcttcaatcacttgccatggacttgcggacaacaactttggagccaaagacatctcggttggatgtaaaaaaatcaataagtttgattcttggaatttcccctgaagagtctacatcaactccatgcacaggacggaactcatctcttccttttgaagagattagacgcatgaagaataatcttagtgacatctcaaacaaagctaggtattattttactactctctacattgtcttgtgagattaacttaagttgtgcgatagggttgcaaacaactgcatcactacgtacttgattgagcaaccatctgtattatatatgtagaggcaacttttatttgtgatttactattctttgataatgtttattttacccttctaagggaagattattgggggaaaaaaatctcagtacatatggatggctatgtggactacatttgcttgaaactgttagaacatgttttcaattatgagtatctttgcagggaaagatctagagcttatggtgctgctgtaacaaagattgagagatgttgcccgaatattttgcggaagcgttccagaggagatggttcatcaaatgaacgatctactgcattgttgtctggaggacttatatccaagatgcccccccaaggccatctaaatgcagatgacacagaactggtatctccgagaggagaagagaggataaagaatgcaggacagaataggagattacgcacatccatgtccgaggttatgctcacatctctatgtatcattgtaggttactattgttgcgataatgtgatgttatacttctgaataagttagttctgacaattttcaggtaaaaaagtattattgaatcttacgtagtatgtattgcttgcagctaagccataggcctgttttggccttgctgtatttatctgtgcttttctttattgttgactttgttttattcatctgtttttcttgttttagcatgcagcctgtagctattagttttagcatgtttaatatgataagcatttttactgtgcacataatcatgatggtttgccatttcttaaaacttttactagtttggattgttcttaaaactgattaccacaacttattacttgtttactagatggatgcaaggaccactgttctgtcaaggggactgggctctactgatagaagtgcagatcctggcaaagtcaccggtggtggtccagcagttccagaagaaaaaattagggggctagcaactggtattgatggttgggaaaagccaaagatgaagaaaaaacgttctgctattaaggcagatgtttcaatgactggtccttcaagaaatgttgatgtagaccgggagcagaaaccagggatgcaacacaaatttaataatgaagctagggcaagaatgacaaactcccctagttttaggtcagagattctatcatccttttctgcatgttttattgttttgattctcttttgatgcagtcctttattctgtttgatcttacatcatggacaatctgaccttgcatattgcatagacatgatgattgaaaaacatattatcaagttattttttctccgaacattcaaactaagcaattcagctaataagaaaatgatttgtatataaagttttacaatctgaccaggcgtttcctttctgggtaacttttatatgggcaggtctggaactgtctcatcagtctcgagcattagtaaatcagatttactttctggacaaaatggggttgggcgatccttaagtaggagtgatcaagacagtggattccatcctactaacaaaagggatcgtcaagctgttttagataaggaaatatcagctccaaaatctcataacaagtaagatgcgttctttctccaaattcactatgttacaatcttgtctaaattcattgcttgccagttgtcacaataagcttaggtagtaatttcctgctgcatgtgaagacttaatatttgtacagtatgtgcttatttctacaagtttttttaggcccagcgaagatgatggtggtgccaatgtcactgcagtaccaaaggcaaatgggtctactaggggaccccgttcgaattctggttcattactgaagtcatcgccaaacattcataggttgcaagctaattctgatgattgggaacatccttctggcatgactaagcttaattctactagtggatctggcaatcccaaacgtacaaagtctacacattcattatcccctcccacccagtggggtgggcagaggcctcagaagatatcacgttcagcaagaaagtcaaatttagtcgctattatcacaaacactgatggtcaatcggtatcaggttcgcttgaaagtccctctatcaatgaagagtctgccggattacctaggcgtgcttctataaattgttcgcaacaaactagacggggagatcatggtctttcaactggatctgagggtgatgaatctggtgttgctgagaaaaagttaagggacaaaagcaaaagggctggggaactagatgacgggcactctggttttcaaaagatcgcaatgcttggccatccttccaaaaggaataagttatctgctgatgatgatgttggagatgctgcacgaagacaaggaaggatcggacgaggttttactccaaccaggcccagcacccctgcatcaattgacaagcttgaaaatgctccaactacaaaacaaagaagtgttaggacagtcactgagagaaatgaaaggtgatttcttcaattaccagcattccaatcaacttgtcattttttcttactgtgattattttgttcagtaaatctggaagaccactgataaagaagatgtcggagcgcaaaggcaatgcacgtcctagacatataagtagcaatgcgcagttagactctcctggtaagttcttgccgtactattatgtacatggcttccattctttgtgatcatgatgatttcatactgttaacatttcagtgcaatcggaagatgatcatgaggagctccttgctgcagcaaattctgctctaagtattggtttcacttgtgacatccttccatttatctagatatatttttctggaactatttgaataatgattggtttattacaggatctgctaattcaagtccattctggcggcaggttgaaccattctttagttatctgacaacagaagatatagcctatttaagtcagcaggtattgcagggtcatcttattttgtatcagaagatgtactaattttctctgcagtagagcggttggtagtttttgatcaatatttcatttgcttagatccatttatcggatgactccaccgcgagcaggtcaattgaaggtgatgaaagtcggaagtacaaggtactttatattacttttaagcacctttactgcaggaatatctgaagtttgtctgcttagttatgcagttgcagatagttaaactgtatagaagtagtagaatgcatggggtggttgatggcttgatgctcactttaccatggataactacttattttcttctacttctatctgcttctttctttgggttcagtttattatgctgatatttttggcttttgcagggtagtcttgaatacatctcgcaaccatcaactccggctggtagcaacaaagatgaccatagcgctcttcaaaatgggtataccctgaatgagatagataatgatgtagggattgcatgggagacaagctgcattgaacctatcctggatcaacttgtccaaggaattggggcgcgaggaggtgcatcagttggccaaagacttatgcaagctctgattgatgaagacaaggttgataatattaccaacaacatttacagaagtgaaacatatccatttgatacacatgaaattcatttcgaggaaggaggatggaaatcgcattcacagggttataagttggagtctttaatgaactttgaagctgcagggaaaggttctaatggtttgatgttagattctgattggaaatatcatgatgaactatcacataaaggcaataatgccatggagaaggccaaggtgtggcctgagtttcagtacagtgagatgtgcttcagtgataggatcatcattgagctaagtgaagttggtgtatccattgaacccgtggtatgtgttgtttcactgttcaactgtatcattctgtacaacaattttttttgttaggctggtatagaatttcgcgttgcttgagttaaactattttttttgcatttctatgcatggtttgttacagtttattattttattttaatctgttgcttttgggcaataaccaattgggtaataacttggagattatcagaagaggctgatactaattcttctatcatggattatggagtatataaatagtccaaaagatttaaaacttcaggtttcttgtcattatttaggtagtttgttgctttttatgggctctgattttcctgtgattgttaaaatgcttggagaaattggatactgacctgatatagtctacaaccatattatatttggtagcacgagtacacgatccaaataagaatatgaataggggatgacaaataaatgctagatatagttgtcttagtgtttaaatatgggtattggccatttgggtttagttctatatatagggatgacaaactattgtgcaatactggctcatgactacaagctgaaattcttaattccatatttatctatgtcctcttaagatgtacacaatttctgtcagttttgtgaattaaaatggatcatatatgttgcactacatccctaagcacatgataagaatagttttatgtcagttatctccaagaagcttcatcatgagtattttctttgaaacatttggttcttaggagtaccatataaactttgaatcttaacctgcaacatctcaatgtttcattaaatagcacatcaaagttttcataatgttttagctcttattgtgctacactgctattgtgccagcctgatcttgcccagagtgaagatgaagatatcaattccgaaatctgcaaattagaaggccaacttcataaagaggtactacttatattcactatgtgcggctggatgcatgtgcatgctccttgatctatttcactattttcaatatctgattagtacctgtcacatgctcctgtcacaagagggtgaagaaaccttagagcacatttgcagtgaaagattctataatgtgccttttggtctatctggataagtgaaataacatgaataaatttgtcaaaaagagaacactcattgtattacacaataaatttcactggtcaatgttgcattttcttgactttggaaagccaacagcatcattcttttgtgatgactgaagggagtgatgtgaaaattaatcttagtgtttttatgatgtgaaaggttgtagataagaaaaacttgctacggaagctggatggcattcttagaactaaaaaggagtcacagcacaggtatttcacatcattgttttgttgggaaactatttcttgagattcaagcccttacatctatgtggttaccctgtaaccagggaattttcacggcgtgccatggaaaggcttttgctgatagcgtatgagaaatacatggtaagtcttctgggcgagaaatacatgctgattgatgtttcttgttttatttgttgggttgggtcaatagctaaggtgcagtgtctactatgtagttttcctagttgccaacacagccttaacaatctaactctgattaagcctgctaatgttcgctatttgaggcttcatgtctatattgtgaattttctttttttttattagtaatgatttctatttatccgtcgaatgtataatgtcgagttttaaaactcctgtttctatctttcatcgtctttcgatataaattgcaaattgttcagtgtcaaatacataggtaaataatcgaatttagttgtatgagcaattatgtattactccctccgtcctagagtaagttcatttttggtccctcccatttgtcccaaaataagctcggttgtgaacaatcattgcattgtgaaagtagtgtataaatgcattgggactatataaagagagtaataattgcattaggatttgataaagtggggtgttttctagtctttttagttttgtattggtatgtgtgggatggttgaaaaatgaacttattttgggacggagggccattctaagagttattaatccgtgggacaaaaatttccgtgctgtggctccgtcacaatagtattgcattctgtattttcactgacaatttagcacatgcatataacttgtatgactcccatcctccaattcatgcctggcaagtgggaagtgcttgcatcaaatactattagacacttgtacactgcttagagttagccttatgcctagtttgaatctgcaacttggtttagcttttcggtgacacgtaaaacgaggtaatccattaccgcttgattaattgagtatcaactataacaaacttaaaaattgggtttattgatttctgaaagaaacttctatatattcctttttttatttttcaaaaagcgcaccgtttagtagtttcgaaagcgtgctaaccgaaaacgtggaagttgcagtttagagttgaagaagagaacgcagccttagggtgcatttgggaggagtttggaacttctccccgcacggaaaatgaggtggctcattagtgcatgattaattaagtactagctaaaaaaatcttgaaaaatggattaatgtgattttttaatacaacttccctatagaatttgttttgcaaaaaactgcactgtttagcagtttgggaagcgtatgcgcgaaaaaggaggaagtagaagttgggaaaggggagaaaagaacacacccttagcctgcctctaacctcatctgaaaaggtgcaactcaaattactctccaggggttatgaattgagctaccgcatgtattgacatgacctcatctaatacgtttcatatttggtagttcaactctaatctcatcttgaaatcatgaagcatgtcatatgtggtagttccactcataacctcatcttgaaaagtagaaatcataaaggtcaagggaggtgacatgacaggagccatcagccactaccatgccctccttgcatgacatgtattaggtctaaggggcattagggcatgtccatcagttgaactgagcacaatcaccagggctgtgttcgccatgaggagattgagaagaaaactccaacgtttgccccgcgcatgctttccgaactgttaatcggtgtattttttgccaaaaaaaaaaatctataggaaagttgctttaaaaaatcatatttaatcccttttcaagtttaaaataattaatactcaaataattatttgctaatgactcctctcgtcttccatgtcatcaagagcccctgccatctaaaataattcatacaacagttgggtctctaccaattaatacttattatattttattcattttaatgggcctcaatcttatcatcagcatcatggatacacctattttctcctcgaagtgggttcctccctcgtgtattgtgcctcgcatcgatgtttgcagagagacagtccctcctgtctcttccccctttctattccatgtcatcgaaattgccaagctggcagttttattggccagctattaattgctgttgttaaccagacattggggcgatggtgacatttttagaagtattctaacagttggatgttgaaaataaaatttgagacggtgcaaaaattagtagcatatgtagaagtggacactcactagtggcaacagctgaaatttcccattataatgttgttgcagttatggtgactttgcagtagctttttaacctaattggagtcccttctctgttttttttttttttttttgagatgaaacttgactccctctacgtggtaaatcatttcatattttgaatttatcacactgaccagtgctttaagttcatgtagtcttgcattgtctggcaactatgtttctgttggccaattgatatgttactctgttgatgaccttgtttgctttgtggactttaagttcactattttttgatacttattaaataattgattgttgttactgtgaaactacaggccttctgtggttcttcaagtagcaaaaatgtaaatagagctggcaaacatgctgctctaagttttgttaaacgaacaatagcacgttgccagaactatgaggagtcaggagcttgctgctttgatgagacccctttcaaggatatgtttgtatcagcaacttctcacagaagcgacccagattctgcttcacaaggtattatggtcccccagataatatttttgtgccttttgtgatctaccgagcatgcatctttctaagccatacttgtttgggaagttataaaattcgtttatatatattcttgttttgccttgtcttcgatatttacactactgatctgactctcatttcattttcagacaatattacggtaccaaaatcagtccaaagggctagtacatcagatgcctctcgagcaagcagtcaccttacggatctgtcattttcgaaggaggatccctggacaaataatgtaaaacaacgggaattgttgcttgatgaagttgtaggtagcataacaggaggaaccctgaaaacgtctggccttggtacttcccttgtgagcaacacaaaaggaaagagaagcgagagggaagggaaggggcacaaccgagatggtagcagatctgggcgcccgtcatcatccaatgcaaaaggagaaaggaagaataaaacaaaacccaaacagaagacagccaacatatctgctcctgtcagcagcgctctaactagggatccacagtcgcaggccaaaataacgccttctggcaacggcagggacaatacctctgctgctagtgctaggcatgaggaaccagcaaatgcatcgaatgacgcagaaatgccggacttgtcaaacctggagctcccaggaatggatgttgatttcggcggctggttgaatatagaagacgacgacggactccaggatctagacttgatgggcctggagatccccatggacgacatcaatgagattaatctcatgatataaccgtagcttgtttatctacgggccccccatagaaagcttcctatagtgcacaggtaacaggtgattttctcaagataaccaccaaccccagcaagtttaacacaaggccagataggctccaggtagttttggtaaagtttatagagacctcttcacattccactctcccacttcctctctgtatcagcgtgtacttatgcctccctaccttgtgccgtatgttactctgtggtgtacatatctattttggtacggtacgaggtagagtggcttaattgcttcatttatccagagaaatgtgtactcaaaaggctgtacatatatgatcatcatccctaatgctgaaataaaaccacgccagttatagctttaatttactcgtcacctgttagctgcggtttcccacaacagttggcgcacgatttcgttgctgcctgtcaggcaccctcttccccatcccaatttgaaaccacgttttgcatgcctctcaagtcttgtggggtatcccactcccacgtacaaaattgatcagtcattgtctcgtgtttgatggtagcatattcaagcgatatatctgatcatggtaccatattcaggtgatatatgtgcgagtacataggtagcatgtttttcatttctatatggttacacggaagaagaatatacacgaccatgcattgggggtgtccaatatgttatatgttaggaattgataggcaaacaaacgataaataacaatagattaatcactgaagacacaagatttaacgtggaaaaccctctcaaagtaggagagaaaaaaccacgggcgtcagccagcaaaatatctttactatatcggggtgaggttacaacgccgcacggcggcttacaagaggtgtatatatatatatatatatatatatatatatgagatgaaaccctaaaaggtattacgatccgtacagcgggggcttcgccccccacccccggacgtccccagatgcacaaccaatggcccagcttcagtctccatttcgctccggcagaagctggcctttattaagtgtaaatgaatttgaatcacaactcaacacaataggccgatggtgctagctatggcttcaaaacgagagtgaaggaggggggaggggggggggggggggtttgttgctcctccccaatggtaatattagtaattgtggttaccgagcgaggaaaacatgaaaaaaaattctaatttttgtttttttaactttgtcgatatatcggtcggtttcggttgttgtgccttggcaataagcctagtcagtagtcaccaaggtaaccacacggtttctgacggtaaattgtcacacatttaagatcaacatatgcttctcaattctagtccaatggctttgcataagatgttaggaagtatgtccatagtctaagaatcaatcgtaacgctggtcactatcaagacttcaaacaagggtaacaagctcaactgatatgattgctaagtgtggctagcagcgtttctattaatttcagaagacaggttaacgaaatattggttccgaggagacaagcgactaagcgataacggagcacacccacctaacctaacctccccttccatttcaagttgtaacggaaatggtggtgaagtgtgaaccaccactaccactaactcaaaaaagtcaaaattgacagattgaaataggcagcagcccaacctattctcatagggtgtgtttagttcacgctaaaattggaagtttggttaaaattggaacgatgtaatggaaaagttagaagtttgtgtgtgtaggaaagttttgatgtgatgaaaaagttgaaagttcaaagaaaaagtttggaactaaactctccatagaaactagaataaattgattgaaaaaaaaacagtaaccgaacatatatatagcctattaaaatagaaactagaatgtggtcaagttaagacatggcatattttagaaaaataaaaattctagcaatgttgtaacccattgtcataaaaatttggataagagtaaaaaaacttattacaaatacaatgaacaagtaaaatgagggaaaaaaaagaaatgccattacaaaataaaaacatagcaaaatacttagacataatggtgaggacattgggacaggatcctaatatcctatgggacaggatcctaatatcctataccttcaacgttagagacatatgggttttgaaggtaggatcctaatcactatgggcacttttggaacataggatttataaaaaattaggaatag

SEQ ID NO: 67250 - DNA, 14798 bp, Oryza sativa
tcggtacaaatttctagcatctttcggcctaagcccaaactgctccttcatcatatcggcccatggtcgttgctgaggtgctccttgaggttgttgtgacatgggctcgaattgattgtattgaggaacaaactggggttgagccgatcctccctgctgatattgaacttgcggtgatggaggctaatactgataattcaaattgcccccctggtaattttgaaaatctggctggatattacgcaccaaatgttcaggaacaacttgagggatcaccgtttgatctggctgtacatgatgaaccaagtgctctgggacaacttaattcgcagcatgctgccctggctgactgccaggtgttgcaaacccagccgatgcattcatcaagccttgctgttgaatcggttgaatgacctgttgccttgatggcgtttgctgaactggttgcaaaatctgccgtcttggtggcgtctgctgaattggttgcacaacttgttggactgcgggtgtttgttgaatcgactgcgcaacctgctgccttggtggtgtttgctgaatcggctgctgctgggttggatcaacagtaggttgaggaggtaagaacttagccgcaacctgatcttgcgttagccgatttacattttgtccactatgctgtggttgttctctcaccagcaaccggggattaactaattggcccggtgccgatgatggtgcagcaggtgaaggagccgataatggtgccgtcggctgagctgatggtgcattcagagaaattggttgaacagctggctgattatcagtgactaacggccgataattggggaacacccctcctggtagataaaccagtcctatagcctgatattcagccattgaaccatcaaccattgtcttcaccatgtttgacaaagtattgaccaatattccagattgattgatcaaagcatggtgcacggcatagtcaacctgatcctgaaagttgttaaactgtaactgcgccatattgccatcctgattagagccaacaccttgatttccttgagaaccatctgcagcacccttatcactcggttgagccacatcacttggagcttgtttcacttctctatccttagaagaaccggtcccagggacatcagcaactacctttacttcatatttctgcacaactgtccccttgcgggtttgcatgaatgagttcaagaataggttacgtgcttgttgcatcattgcttcaagatccttctgctgatcaggtgtcaacttgtccggagtgatattcacgatgttgccttcttcgacttcagatagacctagcttctggatcttagctttaacagagccgggttcaccagccgaagacaacgatgctggcggcttctcatccatgaggaaaactctgacttctaatcagtcccaccgggcatgccaaaagcgtgttgacgtaaaacacgaggcctgggagatctgcttaactccagtgcaggtccaaaactcgccttcgggtatgcaagcgtgccagttgatttgatcctgcaatcaacaagaacaaagacaaagaaaccgcggttaaattcataaatgacagccgatcgacccttggccgatgacatatcatttatttttgagccgatgtcatatatgtatcgatcgacagtcatgagtaaacaagaaggaaccaaatctactcgattggctgtagatattaacaatatatactccttatatcgatatatacttaaatcaagtgattgggatagatcggtcgccatgccgagacagtataaatcacttagatcgaaatatatattaataatgggactatataggttcatagcatagccaatcaggtagatttagcatgtatcggctaatactccgataccactctatattaagatattaaagcaagcagaatatatcaaacgaaagcctaatatatttaaatgctataagatcttagcataaagggcagatttaacatatcaacgaagcatataaaacaagtattgtagttcaatcaggtaagatcggctgaaaccctgatactaccctaatcggctaccaagaagcaggctagagattgagattctaatcatgactcataagatcaaactcaactgatacagctataagtatgaaaagaaggacaatattgtcacatcctgattttcgtttcaggatttataaattatttaataaattattattagaatttatattaaatgtttattaatttacaagtgaagttaaatgtgggaaataaaatttcctaaatataaagaatggatggatttaatttttattaaattctccatggttaattatactctctggaattttctcggatttttcggagctcaactcttaattttaatcatacaaagagcagttcagcaattatttaaatattaaattaatcatttaatgatctgattttaattttgttaaatactttgagtgtccaagtattttcaggatttttcttgaaattatttgagcattggaagtatttttaacaattcaaagctcatctcattgattaatttattaaattggaagtcctttgttgctcccttccggcccagcccaaaaagtctagttggcctccctactgctacagtgtcgtcttccagctccagacagagccgagccaacctgtgcagtcgcctcctcctccatcaaatccggtgcatccgttgcttcccttccaaaattgattgcaaaaacggattcctctctatctcctccacctaatcccgaagaaacccccatcaaattcgttatctatctcacgaattttggccgtttttattcgggtgaactcgggataagcccgactcttctttcaccaaatccatccgttcctgagccgatctcctccacccatgccgatataaagcatcccctagtcgtcctcttccgtttaccccaagtcccaagccgagccgtcgcccgtagagttgccgccgcgttgttttagccgccgccgtcgccggcgatcctccggtcgcgtcgcgctgccgctagtatcgtcgccgctgccgtccgtcgtcacagtcgggttcgtgaggaggagaggaatcccgtccgccccttcgcagccgccgaagaccgccggagcgtcgccgtcggggacccgagtcgagccgccgttgaacctcgtcgccggccgtcgttcgtcgtcgtccttcgttgttctttgcaccggtgagttcgcgtcgtcgtcctctacgcgtaggtgtcctcggatagcccaaccgagccctcttttgccggtggtcgtgtcaaccgtgccatggccggcgatgatgatgtcagcgatgacgtcataaatccctttttctaggttttctttattagatgaaaatcgattaaacttcggaacttcataactaaatcgtcgtaactcggattcgactggttctagttgctaaatttttctaaaatcaagatctacatgttaaaaatatccacatatactgtttatgcttgtttttgtactgtttatttggtttttattagtctttttcttcgttttgcgtgctagctttgtcgtttccgtcgttgcgaaggttcgtgagtgcgtcggaagtgttcaagaagattaattgaagatcgattattgcaaggcaagtcacacagatcctaaacacaatcctttgagcatgttgatcctatatttaaattctctatttatttcaactgtacatttattttcgaatgtcaccgggtggtgtgaacctattcctttgttatggccaatttgcattgaatgccctattccttgataccttgggtaataaattgattagcttgaaccttatgtattggtttggttcagctaaatgttatatatataattgcttagccatgcttagaaacattagctcactaatgggatgaatcatatatactacattattatttatggttatatttaatggtagctcacgatggttaatcgtgttatgataattaattggtaattaaaatataattaatggtgggttgtcagcacatggttttgaaggtcgtgcttatggcaattaaggaccggttcgcgagctactgttgtgagacattaaccgtgccaaccacaagccagcgtgggcaacggctttaccttttgtatagcatgattcattacggggcaccagactgagaagcggtgagaagtccgtggggatcgctagggagtccatgcctctggttatatttatagaggggttgattatgattcaagaatggtgcactgtggtgagttgtgttgtgcgaagggtattgtcatgatttccccctttgcagtgccgtggtggtacttcgaggcatggcaacatgtgtggaatcgtgtcttgtgggtatagtggtatacctctggccagagtaaaactattcgaatagccgtgcccgcggtcatgggcgggttgagcaatgtttttcgtgattagtcccacactactcattaatgataataatgtgataataaatttgactcctggtttggaatggtaaattcctggtttggaggtttgatctgtacgaccggggttggttgttcaggtttggttgggcctgagcagcatgggtgtgctgttcagtgttgattaaaatttctgattaattactctactgtttcactactcttaaatctttactaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcttgtgggagtggagctgaagccatcgctagaccgttattccgctgctgttttcttttcttttgtatgtatgtaacgttattattatgatggatttgtatattaaattatcagtttgtgtacctcggctgattcctagacgaggattttatgcacaaataagtttgaaattactagtgaatttccgggcgtgacaaatatctagacaatcaagccattagaagtttcatagagtggtagatatcctatataatccaagccaacgtcactatttaacctaatcggctgccttctaccgatagatgttagccgattgtaggccagataacgatattgccagagattatgcaggatatatgataactcgatgaattacataaacaagattagagtgtcgtaaagatggaagcactaatcccgagaacgcaagccgtcataacaagttttacctcttgttaaagatcgaaaccgatacagctcaacccgaaagcaagaactcgtcgaaacaaaacgaaagtaaaaagggtggcgatgcgccgagattgtattgaacatgtgtgttcattgattacatggggttcagggtctatttatacccgagaattacaaactatgtccttatcggatacgactcttatctctaacaaactctaagataccataagtctttgcggcagacttttgcccaaatatatctctaaggaaattacataaaatatcctaattgatagatacaattgccttctcaggactctatctgtggagattatggataccccatacctacacggcatgtatatccgactgggtatggggtgccatgtatagatagaatatctttaaagggactcgggttaaattccaaacttttatgtcaaggaaatacccgggatcctagtcggttacgattgtatcttatctgtaactacctattccgttaggagtatgggctgtactttgtaatacggaccccttctcctatataaggaggggtccgggtgtctcttggggcacgatttttctcctagatcactcgacggatcaatccctggacaggagtagggtattacttcttattaagaaggcctgaacctgtataaaattttttgtctttaaacccatccacttttccagcttgatagccacccccttttagtattgccgaaatcttgtttcgacagttggcgcgccaggtagggtagtgtcaagttcttcgccgactagtgcgatgggtttcgtctccggcatcgacgacttcgtcttccctcccgggcaggcgttccggtttggcagcctcgacttcatcaccaacgacttcggcaagatttctctcctcgactcggatccgaaccagtcggggggaggccaggtctccgccccgttcggtatcccgaactcggccgagatctactccaagatcatctcaaccgagtcggcttcaaaccagtcggacgagatccaatctacttcaacacgacctgatcaagacaatggggcctatccctcaatcctgatgagtctccccgacgacttggccacagtcttcaccacaagggcgtcttcttcccgtaggcctaggccagatccagcctcggcttcgatccagcctagctccagggaagtcggcgtcatactccaacgtctcgggacggtttcgacggaagaattgtatggcttcctcagctcccccggtgtcgattctcgaccaacggagattgtagagtacgactacttcgactaccactacgactaccgcaacctcgacaacttcgacgaaggccacgaagataactacgcgcctctcttcttcggcgttttcatggccgacaatgacacggaagaacagcgtcaagcccgagaagcagaagaacagcatgtgcgacaagaagccgaacgtcgccgactggaggaggagcgtcaagcacaagagcgagaacggctacagcgtgagcaacaagagcacgaacgggctacgaaggaggctgaggaccggcgacagcgcgccttggaggccgggcgacgagcacgagaacttattgggcaacaagacgtcgaagggacggcggtttttcgcaccccccagcagaacgcggttgcagcgatcacccttctcgacactctccttaaggaagatgcactcaatcaggccaatcacgtcgtcaacatcttaaatcagatcaagaccatgatcgtcgcttcagtcccggtgaactctgcaagtgtccgtacgccgactggcagccgagttccgcctcttcgatctcaagactatcaccaaccaagcctcagcgtcgtcggcgccggatctagccgcaggagtagggatcatggcgaacgatatgtccactcgcctcctgaccgacacagggagcgtcgagccgaacagcctcgctccccacgtcgcagtcgtcccgtcgatctttgcgaaactatcaaccagcgccgcacggcaagaggctacatcccccaccattcactggatcattacgatgacgatgtggatggagatgctgccttcacaagtgacctgcgtcgagtggattggccgaccggcttcaaaccgactggaatcgagaagtatgatggcacgacaaatcctgagtcttagctcactgtctataggctcgcgatccgcacaacaggaggagacagcaaagccatggcaaattatctgcctgtggccctagcagactctgctcggtcctggcttcatgggctatcccgtggcacaatcggatcttgggcggagcttcgcgaccacttcatcgccaacttccagggcacttttgaacgccctggtactcagttaaatctttacaacgttgtccagaagtctggagaatccctctgagattacatccgacgtttttccgagcaacataacaagatctctgatatcaccgacgacgtcatcattgccgccttcaccaagggcattcgtcatgaactcttagtcggcaagcctcccaggactgtcaagcagatgtttgaaaaggccaatgagtacgcaaaagctgaagacgtcgtcaccgcatccaagcagtcaggcaccacctggaagccaaagaaagatacgccgacgacaagggggagtggaagtaccaattacaaagatcgcaagcgtaagcccgaagaacttgtggcaactactacaccatcctcccgacagcgttcgcgcgtcaacactttcgacaagatcatgcactcccaatgcccacatcatccgaattcaaatcacgcggccaaggattgcttcgtctacaaatagttcgcagagcaatacgccaagaactcaagcaaaccgactgacggagttcaaagcacgtcgaagaagaaggatgatgaagatgatgcccctactggtttccaagactcacgcaaggaactcaaccatatctttggcggacccctggcttatgaatgtaagcgaaagcaaaagctaaccgagcgggagatcaacgccgttcagcccgatacgccacaatatcttcggtggtcagagacagctatcaagtttgaccgcttagatcatcctgactgagtggtccacccggggcggtaccccatggtactagacctagtggttcgtaacgtcaagctccgacgatccctcatcgatggtggcagcgcactcaatatcctttttgccaagactctggacgacatgcagatccctcgcacagaactgaagccgagtaatgcgccctttcacggagtcatccccgggctatcttctactccacttgaccagatcactttgccggttactttcggcacttgggagaactttcgcacaaagaacatttgcttcgaagttgttgattttgagacagcgtaccatgctatactcgaacgcccggtgttagccaagttcttggccgtcccgcactatacctacatgatgatgaagatgccaggacttgccacaaggaaagctgcgagatggcccagacccgcgagattacgctcgctcgagaggaaatccgactggctgcatccacagcaaccgaaggagaagtgcctgcaaccaagatgccaaagaacggagagggcgatgccaagactaagaaaattcctctagatccctctgatcccactaaaactgttgtaataggcgccgagttagattgtaaataggaaagcgcgctcatcacctttcttcaaaataataaagatatctttccgtggaaaccatctgatatgcctggtattcctagagaggtgattgagcactctttacatgttaaggaagacgctaaacccataaagcaacgactccgctgcttcgcacaggataggaaggatgcgatcaaggaggaactgaccaagctgttagcaacaggcttcatcaaagaagtcctacatcccgactggctggccaatctggtcctggttctgaagaagacgggacaatggcgtatgtgtgttgattacaccgacctcaacaaatcttgtcccaaagatcccttcgggttacctcgcattgaccaggtagttgactcaacggccggctgcgagctactcagctttttggattgctactcaggatatcatcagatccatttaaaggagtccaactacttgaagacttcattcatcacgcccttcggggcctactgctacatcaccatgccttttggattaaagaacgcaggagcaacttatcaacgcatgatccagagatgcttttcaactcagattggtcgtaacgttgaagcttatgttgatgatgtagtcgtcaagaccaagcagagggatgatttgatcgcggatctagaagaaacctttgcgagcatctgcttcttcaagatgaaattaaaccctaaaaagtgcatcttcggagtaacgtcagggaagttgcttggctttatggcgtcccataggggcatacaggccaactcggagaaaatcaacgccatcctcaacatgaaaccgccgagttcccagaatgacgttcaaaagttaactggatgcatggtggcactcagctggttcgtttcacgactcggagagtgggggatgctctttttcaagttgccaaagaaagctgacaatttccagtggggacccgaatcacaaaaagcctttgaagacttcaagaaacttctcactactccaccagtcttatcttcaccgcatccacaagagccgctgttgttatatgtgtcgacaacatctcaggttgtgagcatggtcctggttgtcgagcgtgaagatgatggccatgtttaaaaagtccaacaaccaatttacttcgtcagcgaggttttggtcgactccaagacaagatatcctcaggtgcaaaaattgttatgtggtgttttaattaccgttaggaaattatctcactattttcaaggtcactcggtcacggtggtcacgtcgttttccactcggggacatacttcataatcgagaggcaaatggacggattgcaaagtgggccttagagttgatgtctttggatctatctttcaaaccacgaactttgatcaagttccaaaccttagcagacttcgtcgccgagtggaccgagttccaagaagacatgccgatagaaaagatggagtattggaccatgcattttgacgagtcaaagaggcttttaggcaccggagcaggtgttgtcctgatttccccgactggagaaaggctgagttacgtattgtggatatatttttctgcgtcccataacatggcggaatatgaggtgcttcatcacggattaaggatcgcgatatctttgggaattcagcatctaatagttcgtggagattctcagttggttgttaatcaagtcatgaaagagtggtcctgccttgactgcttatcggcaggaggtacgcaagttagaagataagttcgatggccttgagctaacccatgtttttcgacataacaataaggcagctgacagattggccaatttcagttcaaaacgagaagcacctccttccgatgtgtttgttgaacatctttatgaaccaaccgtaccaagcaaagaaacaaccgaggctacggacactcaagaagtaatcatgatcgaatccgactggagagagcccctcatcaaatttttgaccaagcaagagctccctcaagataaagacaaagccgagcggatctccaggtgcagcaaactttacgtcatacatgagatcgagctgtacaagaaaagtccatcagggattttgcaacgctgtgtgtctttggaggaaggaaggcaattgttaagagatatacattcaggcatctgcggcaatcatgctgccgcacggactattgttggtaaggcctaacgacagggtttttctggcctaccgctgtatccgatgctgacaaaattgttcgaacgtgtgagggttgttagttttttgcccgacagactcatttaccagctcaggagttgcaaaccatcccgttatcttggccgttcgcggtttgggggctcgacattgttggcccattcaaaaaggctaccggtggttacagtcatctctttgtagcttttgacaaattctccaagtggattgaagccaaaccagtcatcacaattacaacagacaagtctagagattttttcatcaacatcgtgcatcggtttggagtacctaatcggatcatcactgataatggcactcagttcactggcggagtatttaaagatttctgtgaagacttcggcatcaaaatttgttatgcctccgtagcgcatcccatgagcaatggacaagtcgaacgtgccaatggtatggtacttcaaggaattaaagcacgagttttcgaccaactgcatccgtacgctggcaaatgggtagatcagctgccgtctgtactttggtctctgtgcactacacccagtcgggctacgggccagtcaccgttctttctagtctatggtacggaagcaatgttgccaagtgaggtagaattcgaatctttacgatttcgtaacttcaaagaggagcgctagggagaagaccgagtggatgatctcaaccgactggaggaagcccgtgaagcagccttaattcagtcggctcggtatttacaagggatgcgatgttatcacaccgcaatgttcgatcgcgggctttctcagttgaagacctggttttaaggaaaattcaaactacacgagatcggcacaagttatctcccttatgggaaggaccgttcataatttttgaagttactcggccaggttcttacagactcaagcgtgaagacgatactcatgttgacaactcttggaatattgagtatcttcgtcgtttttatgcttaggcattacttttgtatcttcctctttgactgctaacatcaagttgttccttgagttaccagtcgggggctactataataataatggagtgtgattattatcaattcaattttcttacttgatttatcattgccttgtttgatcttttggcttagtcaatgaggactgaaagtttttaacaacttttgcgagttctaggctcaataaggtttgacgaaaacttttaagaaatcaggagctgagtttaaattatcaagcacagcataaattcatcagtattgtacaaattgtgcctccatcatcataagttaatactatacaatgtaaatcagactcagttttttcatcatcagaattaccagacccagtcggcccgagattgttgtcctgaaacctctcaactacatcagcagtaatcttgtctgcagccttttgtgcatcattgatgagatcaagggcatgttcttcacttgtcccatctgcaaagtcgtcgacagcatcaatatcgatcttcgggtacaaggacttggtcattgccaatgccaggctagcccccatgcatcccgcttccttgatgttcttaaaatatgtatctggagcagctcttagcttgtcgaagatttcaacagcatcaaaagaactcggaccattattattgaaaaacatggcttggatgagtggtgtggcggcgttggcaacttcatctccggctccttcaagcttcttaattttgttgaccaagacgtcgaattgagcttgagatttgattttgcgatctgcgcaaatggttcacatcaacgactatgcaagaagacaagaatggtttgaagtttcagcaacaagtacattcgacatctttcagagccgagtccctttgtttggtcaattcgcccttgtctttttctagagctttgattcgcttttctagctcggatatcttggtagcttgcactgtattattttccattgatcaattacatatggatagcggctttgagtaagataggcaggactgaaggttggcgttggtacctttttagggagggctgcttgcttgagcctctgcttccgggatgtcttcatttcgttctgtacccgactgatttctagtcgggggctcctgatcagtactgacttcagcttcggccgactggtttccagtcgaggttcattgctggcctgtacattgtcggttgctggttgattactactcaggcgatctttggcagtcggcccggtttctgtcgtaggactagtctccgcgccagttggttcagagtcttttccagaaggatcgatgtcataaggcttcctgcaaatttgagatatgctattaacaatacttcaatagtgaatgattagcgatacaagagaaaatgctaagtgacatgtacctggatgacttcctgattttcggtatgggacgactggatgttttcttcttcgggttagcttgtcttggctgttttccagtcacccctttgctgccagccttttcaacatcgtcaccctcatcgtcactcagaactaatttcctcttacgagagtctgactggttagtcggcttcgaggtgtttggttgagcatcggaccggatttttggccttccactagcctgaccagcctgccgacagggtgagcggtgttgagcgatcggaggatcagacttcatcaaggaaaattcctatgcatgatattccaagttttcaatcaaccttgcagaagacaaaaggatgtttttcagagaggccgagatgttagatacaaaccggtggaggagtgcttgggcagcctcatctccaattggaagcaagttccaggtgtcttgatatactggaggaagacaggtgtactcaggaagcgctggttcaggattctgcacataaaaccaatttgcatgccaacccttgttcgaggttttagagggcatggagaaatatttctggctcaaggttccccttagttgaaaaccggctcccccaacaatgcatggcttgctcttgtttggctggggcttgaggaagaagatgtggcggaatagggcaaaatgcggtctaatacctaggaaagcctcgcaagcatggatgaaattggcaatatggactatggaattggggtttaggtgatgcaaactaatcccgtaaaactccagaatcccccggaagaatcttgaggttggaagagaaaagcccccatagaagaaatgagagaacaccacgacctcatgtgtgtcaggggtcggaaatgcttcgccgcatgccggacgccacccgatgatctccttcgccggaagaacaccatgcgccaccatctccttcaaatcttcctccgtaacatcggagggcgcccactgactttcgaagctctctctctcctctgccatggatgcaagtgggatgatgcgatttgatttggaagtggcgaggaatggatgggaggttgatgcggtggttgcacggaagattttgtggaagctgtgaagttctagagagatggattggagtggatttgtgagccctagctttcgctggtgtggttttgcattgtagctgagggtggggaaagtggcgaaggttttggcggggaagacaaatcaactcgacatgatgtcgtacaccaagtcgtattgtcggaatcggctgtatcacctaacccagtctgactcggact

SEQ ID NO: 67251 - DNA, 2608 bp, Oryza sativa
attcctgcagcccgatcttgcaccatttgcctagtggagggccaccttccacatcgatctgtcgtcggtgttgccatcgccaccatggcaccatcttgcccttcgatgatttatttgtcctcgacttttcaaaaccgtgatgtcgtgtgttggcaatgttgccttttgatgatctttgcaagcgatgggttcttggttgccttgttgcgccgttgttggccaccatccatcattgggtagtgctacttgtcaagatactaagtttacatgtagatcttggagaaatcaaaggaaaatccttctaatctattggggaaaacaggtatgtgttccataacgaatcgtttcctttatgcacttcgaattattattatttcagtcaggtggaaacattatcaacaaaaacaagtagatttgttagatctattagtatatctacatttggatgtatatatatgtacatgtgtccctgacttatttttaagtgctggaatctgatgcatttgaagggatgggatggggatgttccatcgttgatgatagacatggaaggattagacggaatcgttgatatccattggtgtttttgcaggtgccgcttggatccactgtcttcaaccattaagcattggtcgaacttgtcaacgatcaaagtcttaggtgtgtagatcttggagaagacaaaaaggttaaagactcgacatacatgatttgtgtggaatttcaggtgtgttctaggcaaatccttttccatggttaaacactttgaaatttcaattattatgtgaaactagggcaacattctcaacaaaaatcatcaagctagctatcagtataaacaatagatgaccagaatgtagtctcatatctattttattttgctatttatgtaaacatgtacctccaacgatcatcattccttcctatacaaacacgagtggtttcatagaacttcaagcaagttaaacataaacccctcacaccgaaaaaaaatcaaccaacaagttcatctctataaaaagcaatcttttaaaacagtcctattctaccatccaattaaacacctacttaaaaaaaacctaatgacattccacattagccatgcatcatttcagcccaaaccaaaaagtggaccaatgctacaccagacaccccaaagaaaaacccacagtcactcacaaagcgaagcaaaggaaggaaacatcattctactgttccatcttttttttttttgcacctctctattccattccatttcaaatcaaaccttcgaaccaattctatccccccttggagccaatttttccttttccctcctccgtctcggctcgtcgtaggcgtcgcctctcgccctcgcacaccacgcgcccgaaacgcccatcccacgaggaggagacgcctcacgcctccttctcctcacccacaatataaccacgcctccatcttctcctcttccccttctcctcctcctcatcgccatcgccgcggaccaaattcccaaccctcgaagcggccaaaccccgcctcccccgccgccggggacctccgatccgggccctgatccgccgccgccaccccgatctgccgtctacgcgccttcccctgcccgcaaaccctaggaattcgggccttcccggggcggcggcggccgtgggccgtcgttcgtggctatggaggggttggtggggagggcggtgaggaaggagttcccggggttcggggtgttcgacggggtggtggagtcgtacgacgccgaggcggggtacttccgggtgatgtacgaggacggggactccgaggaggtggagcttggggaggtggtggggttgctggttggtgggtcgccggttggggtggagatggcgcatccgctgccgttgacgcccgggcggcgcccgaagaagcggcggcgcggggatgaggaggggggcgttggcgtgggcgcggtggtggcgatggaggtggattccgtggttctggctgtccccgccggtggcgcggagcccgcgtcgccggtggtggtggtggaggggagtagtagggatgaggtggatggggacgtggtgtcggagatggcggagaagaggcggagggtggtgagtccagggcctgagtcgtccgggaagccgcttcggcggagcgcgcggcaggcgaaggcggccgcgcgggtggccgaaatggaggccgccgccgctgtggcggccgccgctgaggctgaagcagctgctgccgcgatggccgaggccgaggcagaggctgctgttacgccaccgcagtctgggagtaagcgtaagcgtgcaagcggggctggcaggtatcggtctgtcgcgaaggatttggagaaggctgcggtggagaggctgcctccgaagccggagcttccaccctcgtcgcagagtttggatttggaaggtctccctgctctcgacgtctttcaagtgtactcctgcttgaggtcttttagtaggcagctgttcctgagcccgttcctgctggagacatttgtggctgcactgcggtgtatatatgtgaaccctttgattgactgggttcatttttctctcctgcgagcgatgaagagtcacttggaagatctcgccaatgaagg

SEQ ID NO: 67252 - DNA, 695 bp, Oryza sativa
tttcacaaatcaatttcaccaagtcgcattttgtaacggtgcgtgcctatgtggttacacatcatatagtttgtgtttaccttcagtgttgcagttgacaagtgttgcaagagcaacaaggccagtgaggagaacaactgatatttttgctcctgcaaactgagaccccattgctatggctaattgaaaatgtgttgaaacttgaaagctgcttgtaatacactgaaatgcattgagagggaaggctctttatacaactagaggaagcagctaaaaaaatggtttctaacctaaatttcaagtctttttgacctgaaaaatcctttttcttccactcagctatgaacttttttaaaggtggtcaaagaagaaactccatttactattttcagcaatgtgatgaacctttgggcatttattattttcatcaattatgttgaacccattggcatcttttgttcttggcattgtgatgatcctttctcatactttcagttttacgctacgaatctctaataattttgtctgtatgcatctcacgaagaacaagccagtatattcctagtatcaaacccagaaagaaaaaaaaagagaggaagaactagtttgaagacagcaaacaaattttcgatggtataggctaagaatatagattatttttctaggaatgtcaaagggtatgtccgtatgttcac

SEQ ID NO: 67253 - DNA, 6012 bp, Oryza sativa
tgtttaaccattcgtcttattcaaaaaatttaagtaattatttatttttttcatatcatttgattcattgttaaatatactttcatgtacacatatagttttacatatttcaaaaaaaaatttgaataagacgaacggtcaaacatgtgctaaaaagtcaacggtgtcaaacattttgaaacggagggagtacaagagaaggcatcagtagcatgtgcacgcacatgcacaattgcgtctgtacattttcgttgaagattcagagcttttatcttgaaatgttcatacaaccgctgaaatttaatacgccataaaaaaaagccaagagatactttatctgtaaatcttgtgcagttcaaagtgaacataattgttcgatttcttttgtgcagggatttgttgaatgtactcatctcagggcctctgattcctcaattgggaggactgaaaaatctccagtacctgtaacaatttcataacacactttgcttaggacatgacagcttgaactcagatgctgagttgctggaaaaatactaacagatcatgtttgcagtcagttgtatgggagtcgcctaaatggatcaataccagcaacactggggaagctgaaacatcttgtgagccttgatctttcgaacaacctgctcactggcgcgataccaccttcgcttggcgccatcagcaatttgctaattctgtatgctattttttttacaacaattttatatgccgaatggtgaagaaattgaagtaaaatccggatattgtttgaagtgccaaaatgaatgctggttatatgcaggaggttatctgggaacaacctgacaggggctatacccccatcattgggcaatctgaagagccttgagatcttggagcttggcaataatgcactgagtggctctattccagcttctctcggcgatattgaaacattgaattacttgtatgtgctcatttctaaatttctcattgataagttataatatatctcctcctcaaaaaaaaaaaaaagaacttgcaagatgtttttaacttgaaataatattcgtttgaatgaaaaactaataaaactttaaagagattataaagttgcagaaatgttgatagaaatgctactagaggagactctggtataagaactaagaagcgaacgaaagcttataaagttacaattctgtattaaaaaccttgaagtatacagctttgatgtgtaattgttctcaaataaactgaacgatatgttttatatttatgtccagagatttgaatgacaatatgctgactggcaccgtgccattggaaatcctttctcgtcttgtcaccaccttggatgaactgtgagttgcatacatgttattaacatattgagttattacattccagagcatctgtgtccggcataattcatgccgagacatgtttgcgagagaaaaaaaaaaacatactgagacaaaactaaatttccatacaggaacgttgcacacaatgatttgtacggcacaaccaggaaatctgtaaccagaggtatatatgtatcattctaagattttgcattttctttatacatacatgccaaatgtgtgcttacataaacttcgaattgtcattcttgcagttactaccgtagtccatgacatgccgaaaacttcaaactgagtccagggacatgattctgtactatttcaggcatatttttggaaatgaaggaataaaataatatcgcattaccatatgctgaagagttttttttttccttggcattttgtgtttcccctgtggagcatatgcctgcactctacgcagaagcaaggctgcgcgcctcaagttacatcgtgtacccgagatcggaacgtgtgggatggcactcgtcgtgaaccaatcatggcatgtatgcaggagctcgtggctatgggctcctcttattttttccataaattggcaatgagatagaacagaaaagctgcagcaaaacagcagcaccgcgatcactcgtgttgttcattgtgctctggagttcgagctcgtgcgtgagttgaaaaatcgagcgagagaaccgacaccctatgtgctcactgaagtgctgaacatgtcctagcttaatgttcactttagtttgcaataggttggaattcaaactttgtgtttactgataaggttattccattattctattccatacctacatcaatcatttctacaacttcctaataattctaaagtaaatcagagaaaacatgaatacatctagttcacataaacatgtctagtttaatttatgcttcagatgaaagggaaactttcacctcggacaaatgcagttgttactaattaatactctagctgcaatttgaaccgaaccaaaccgaaagagcattttcctgttgttgttagtttcttcttgagttttgattttgtgaattgctaaaaattgtcaagttctttaggcagaaaattttcaaatgtaactatagtattattgcagtgtaattacattttgactataggcaaaatttgctacatggcatcgaaaaaacgtgtaattggctggtggacatcgcaagaatgagaatttactgtcaggcataaaaaaacgtgtaattagctggtggacactcacgggcttattttattatttccggtggatttggagagagaaacactggtgagagtacgattttgcccctgtcattgttccacttacaacgagggagcgagaaggcgagcaccgcgtggtggattggattcgattcatccccgcaaaccttagacgctgatccccccacttcatctccgactcgatcgccgccggtcgccataccgtacaagcatgtttccgtcgtttctactccgggcactctccctcgccagtcgcaaggcggcgtgcccacctcacccccgcgacctcgtcatgctcgccggcgcgcacagcgcaagccaggccaccacatcctgttgtcgtcccttctctaggcgctctccagcggcggcgtcgacggcacgaacctggtgtcacctaccaccactacctctggtggcgacacatggtcggaatcgggatatctacgaagcccgctccttggcagatcagcctgccggtgcgagcgcggaaatcaagttggggtcagatttggtggcttcggtgaccgctcgcgaagactctgctctcctccgtgctcgtcacctcttgaacaaggtacaagtccaggcagagcaacatcacctcgccgtgcacgacggctacgggggagtgagactggactgagtcttggttcgaaccagacacagtctactgtaagcaaaacgatggcaggggcaaaatcatactctcactagtgtttctctctccaaatccatcggaaataataaaataaggccacgagtgtccaccagctaattacaccttttttttatgcccgacagcaaattctcgttcttgcggtgtccacaagctaattacacgttttttcgatgccctgtagcaaatttgccttgactatattgtaactattatatgattgtagtgtatttacaccgtaactacattataacttctatatacaggttatttaagttatgtgcatttttaatagttatatacaagttatataaaagttacaatttaattatattacaatttgttcttcaaaacccagtagaactgcgattcatttcattaagaagaagaaaacaaatatttacaccggagaggatcaaagatcacccctccctccaaacaaaaaatgtctcttaattacattacaattatactatactatagttatgtttggcatgcggcagtatttaggtagccctttttttcttgcatagctcaggatttcgctttcggctcggtgttcaaaggtagaaaactgatgttatcacataaaccgaagtaggctatacctctccatgttctgtgcagttgcccctgtcaaccaagctcttgcgatcaatcgctcgcacactcccctccatagcccttccgccctcactcggtttaacccaagaaccgaagaaaccgacctggcctggaatagtttggcttttaaagctcttttttttccgacaatttctcaaaaaccgaacttcctaaaaaacgaagaaaatgactgaaaaaaccatagaaatctactccattgtagtaacacaaacgttatatgctttatgtaaatgaccaggtacaattttagattgtggtaaaatatgttgagggttaaaatgaagtgcatggtaatgagaattacaaccattaatatccaaaaaatatcatttactgaaacatctactcacgtgtttatatagcaatcgaaccaactagggggaaaatgaaaaattagaaaaatgaaagaaaaaaaaggaaataagtaataaattttattgtttaccaaaaaacaatggatttgctacagttgttggaaatcttcacatgaaaagatctcttacaagttaaataaaaaaaatcaaagcaagtagcataacaacgttgcatgatacctatatttctagaaaataataaggtacttaatgaaactgaaggacacctttcacaactcattgtatgtttttcaaagtaaatggataaaaataagtatgagtacaaacagacataatagatataaaaacaaaatcaaaattcattaccgtaagacacatgcctattacaatgtgattttctgctcgcttattctattaaaagtagcattagtacttgtagtcacatcaaaattctcaatccaaaagaaatctgaatctgtacctcccgtgtagttgaaagtatttttcactgattataaacaaaatcgacaacaataggaaagaaaggttcttcttatttttcatctgcttgcttgtctaacagacatatactaggctgcattcggtagtgagctttcccaacatataccctcgtttttcatgcacatgtttttcaaactgctaaatagtgtatttttttcgcaaaaaattgcaaaaaatttctataggaaagtcacttgataataccatattaatttatttttaaagttagttttagctaatacttaattaatcatctaatgagttgctttgtttttcatgccgaagggggaaagttcccagtcagagcaatgaacgcagcctagtatgtttgataagttagttttacttaattaatgccaatgtactgtgatactcggcagtataacagaagcatacacatgaacaatctacaaaataaatgtgtctaggtatagataaaaaaaaacccttttttctacttgaaatataaaattcctgcaggaaaaaatggccagaaagctccattgactgcaagacttggacatatgtgtcattggaagcttctatagaaaactttctgattgcttagatgacaagtacttcctccatccaaaaatataaacgtatttctagaatagactttgactaacaattactctaatacgatataattcatacaacataaaattgatgccatagattcatattcaaaagtatttatgattatgcttttgtagcacacaagtgatgtagagtaattgttggtcaaagttttatcctacgagataaaataagctttatatttttggacagagggtttatgttcatctgaccggcttcttcttttaccattgaagttaacctaacaaaagataagcatttatggtcgagagtcaatccaatgggtagtaggagaaagaattgttccatggtttccttctatggcttggtattggagtatttgaaactttaacaacttctgaaatagaatatgaaatgacagtacatggatgtttgcaattagtcaagtggtgcacagttgaaagtagatgtatacttttttcatatatattttgttaatagcttcatatatatgtttgttaagagattcgtatatatatcttaagagtttcatttttgcatatatatttaaaattatgactattttgccataacccatgcatttgatacttaaattcacgtatatatactccctctggttgtaatgtt

SEQ ID NO: 67254 - DNA, 12585 bp, Oryza sativa
cctcgtcttagattccgtttcgatctaatcttcttttccaatgctgatattaccaaatttggttgttaacaaaaggcgagcaagtgccaccctcactgatcaatctagctcgcccaagaatccaccaaagtattcaacgagatcatcccaccggcaacattttaggagacatcaacaagggagtatccactcattctcgtattgcaaatttttgtgagcattactcgtttgtgtcttctcttgaacctttaagggtggaagaatcttttaatgatccggattgggtgatggcgatgcaagaggagctgaacaatttcacccggaatgaagtgtggactttggtggagcgacctcggcaaaacgtgattggcatgaagtggatcttccgcaacaagcaagacgaggccggggtcgtaataaggaacaaggcaaggttagtggcgcaagggttcacccaaatcgaaggattagatttcggtgaaacttttgcaccggtagctagacttgagttgattcgcatattgcttgcttttgctagtaacctcaattttaagctatatcaaatggatgtcaaaagcgccttcctcaacgggcctatcaacgagttggtatacgtggagcaaccaccgggcttcgaggatccgaactatcccaaccacgtgtacaagctccacaaggcactctacgggcttaagcaagcccctagagcttggtatgagtgtcttcacaattttcttgtgaaaaacggctttgagatcgggaaagccgattcaactctttttactaaaagagacatgataatgatacttttgtctaccaaacatatgtcgataacattatatttggttctactaacaagtcttttagtgaagagtttagtaggatgatgaccaaacgatttgagatgtccatgatgggtgaattgaagttcttcctcgaccttcaaatcaagcaactcaaggaaggaaccttcatttgccaaacaaagtatttgaaggacatgctcaagaagtttgggatggaaaatgccaagccaatccacactcccatgccatcaaatggccacctcgacctcaacgagcaaggtaaagacgtcgaccaaaaggtataccgttccatcattggctcacttctttacctttgtgcatctaggcccgatattatgcttagtgtgtgcatgtgtgcaagatttcaagccgctccgaaggagtgtcaccttgtggccgtgaagagaattcttagatatttagtgcacacacctaaccatggtctttggtatcctaagggagcgaggcttgatctcattggctataccgatgcggattatgccgggtgcaaagtggatagtaaaagcatatcgggtacttgccaattcttgggtaggtctgttgtttcttggtcttccaagaagcaaaactctgtcgccctatccaccacggaagcggaatatgtttcggcgggggagttgttgtgctcaacttctttgggtgaagcaaaccttgagagactatggcctcaatgtatccaaaatcccactcctatgtgacaatgagagcgccattaagatagccaacaaccccgtccaacactcccgaaccaaacatatcgatattcgccaccatttcttgagagatcattccacaagaggcgacatagatatccaacatgtgagaaccgataaacaattggcggatatcttcaccaagcctctagatgaagctaggttttgtgagttgagaagtgaactaaatatcttggattctcggaatgtggcttgatctattgcatgcatgtttgcttggtagaataggtttgcatactactttgtgacaaaatggtcattcaactcatggatggacactagtcacttttgtggagaacttgaatctatgtgtattgggatctcatttttcaacaaattttggtcgtagcacaacttgaaatagattcacacattccctctctcgagggtgaattatcttgtctcatggtaattccctctcttttgatccctcggattgtccatttgacttgtggctattgttttgtgtgattgattgtgtgctagtcacaagttcaaatggaccctctagagctcgaccatccctcctttcctaatcctatcaaaaatctttgtgaaatgtgtttttgaaaaaaatttcccggtgcttgtcccctacaaaattcctttcaaatgtttgcaaaatagtttcatcaaaattcccggcgaaatccccttgcaaaactgtgttttccaggaattttcggactttccgaaaaattttcggaccttccgaaaatttcccatcctgtcgctcttctattcatgctattccaggatttttcggactttccgaaaaattttcggatatatccgaaaatcatcaaaaccgtgtgcttcccctctagatccgttcggacttatccgaaaattttcggaaatgtccgaaaatttcggggctcatatattttgacccgtggactcctctctctctctctcttcctcactttttcccaacgggtttgactccctcctccactccgcaccggcgaccccattctccggcgacctcccgcggctcccctcctctccaacattgtgggagcgcgtttggggcacttattgggacttgcgttgtcgatcatcaccgcgttcttcaagtgttcttcgtgttcttgaggtatccgccctaaaatcaaatcctttgattcctcaagttttatcttgtgattccctttggtggagatgttcccctagtgccctaggacctgcagattcattttcccaagtttttgttggcggatttgtgctgcatccggatgataaggttcggccggatttttccggaaaatccgaaaattgtttccggatatatccgaaaattcctggccgacccctatcacctcggttttgcacgattcttgccttcacttacttggtccttgcttctttggcttccattcactgattcattgtctatatcttgtttgaaggatgcctccacgcaagcaaacctcccacaagtccaagcaccaaagggaccgctctcccaccccatcctctcatgatgatttggacagtgattggtccgggagagaggatgcggttcctcaggttgcgcgtgtggcttgggccgacactctccctcctcggcggtccactcaagctcttggtggtggtggtgatggtgagggctcctctcatcaaccgcaaacaccaccgcaccaacccaatgtccccacaggtccttttcgcattcatacacccaagagggatccggcggtgattcgccaagtgtatgattggaagcggaagactgaggttgttgctcctcgccgggatgaggatccgcgcccccttcgccgcaccgccacggattcgcggttttggactctctttcaacaagactttgatgagtctgtgatcaagtccaaagctcatcccaccgttcccatgcaatggatcaactaggaggagctgcaggcgcatgatgatccggtgctaaactttgtgattgcaaattgtgagctcatgggaattcgctctttcgtgactttgcagcagaattggtgcagcgaagtcatcgctcaattatatgccaccgttttctttgatccttattgtgccatgcattggatgacccaaggctcttactattatgtctcctgtccgcgatttgttgagatttggggttttgacgtctgttccttgctaaaccttcctgatatgcatgatcttcccattcctgccaacactaatctcctccctctttacactccaaatgatcctaatgtggtgttgggtaaagtcgacggtctcaaaccgtactttgcctgcttgaaccggatgttttgccggtcctttgtgcctaaggatggtgatgccagcagcattaaccacctctccaggaccgtacttctcaggttcaatcccctcctcatcgctttcatgttttgcactttgtgtgggaggagatccgcatggcctccattcagtacaagaaggggttggtctatgctcctcacattatgcggatgatcgagactgtcactcagcttcagtttcatcatgatgtgactcattcccagcttcaacttgcgccttgttaaggcagtaaccccgacaaataaattcttcaaacacccgaacggaaatattattgaaggatttgggattgtacaagatgtacctgtctgctttgaagacaaggaggcagtcttggatttccacgtctttgtgaaagtgcgactaggcccctagtgattttggtgattaattacaatgcgattagagaggattaaaatttttattcacgtaaatgtgaaggttgttatgtcctcaatgagttaaagtaatgcatttcccacccaatgcattgacatgatgtgatgcggcaaatgagcaaatgctatattgtaccttttcttttccttgagttaataggaaagccgcactattaagagggatgatgcattgacatacgaggagtgatcaaagtgctcaaaatcaatttttaaaagtgtttctccttagtttggtgtgttctggaatttttttggagttttccgaaattcattttcggactttccgaaaatacacagagccagtttttcgcttctggaaattttcggatatgtccaaaaggcattttcggactttccgaaaatgactgagaaggcaaatatggttctgcatattttcagacttgtccaaaactgattttcggattttttgaaaaacatcaatagagtcttttcgcttctgtaaattgtcggagttttccgaaaggaattttcggacttttcgaaaatgtccagaagggtgtttttggttctggaaatattcggacttgtccgaaaagttttcggaatgtccgaaatatcttcagttaactttactgtcggtgccgagctggaattttcggacatgtctgaaagagaattttcggacatgtccaaaaatctttcggaatatctgaaaatcacaattattgtgcataacgggcataatttaggctgtggctataaatagccccctcccctcacttgtgagggctgctggtcacattggagattcttgtgctcttggcttgctcttgttgagattcacttttgagccttgcttttcttgtttcccctctcacccgtgttcgattcggatttggtgtgtgtgagagttgtggattcgagtttgtgtgagtgcttgttgttgacttcgtgaagatttgtgagcacttgcatcatctccaggagttcattgcttcatttgttactcttggaggctgaggactcctaggcggctaggtgtcgctcccgagccaccgatctacttgtgattggccgggagaagtttgtgatggtcagatctcacctccgaaagggaagagatacccttagtggaaggaggagtgcttagtgcaacctcttgaggaaagggttagctaagacccaactcttagtgagctcctcaacagagagtagaatccccttaaggatttgaacttcgggaacaacatcgtgagcttcatatttggtgactttacttcctccctctccactagctttgcttgtttgaaccgctataggtctagttgctgtttgtgctagcatattcttgttataggcaactagatctaggatttactttgagtttgtgctgactccgaaaattactgcttccgcttttaattgaatttttgaattagcctattcacccgcctctatgcctaattgatactttcactttgaaatctaagattttgacattctaatcgggcttcccatttgagaaactcctaataaacatgccctgattagatagcctcaagataactttgggaggaaacgaattctcagttgcattctcgcgggcatggttcgccttgaccggctctctcctagagattgagtctgcggaggaggttagagcagttccccctcacgagtctcccgaggcccttctggaaaatgaagtccctgacttcatcaaggaagaagcggaacctagtgagactctcgaacttccaatcatggaactgccacctcgacctccgtttgagcttaaacctctacctgaaggcctacgctatgctttcttgcacaatgacagagaagcccctatcataatcagtgacaagctttctgaagacgagactcaacgtcttctgtctatgttagaaaagcatcgtgttgttcttggctattcccttcaagacctcagagggattaatcctgcactttgcactcatcgtatccctattgaccttgagagtactccctccagggaacctcaacaacgactcaataatgcgatacgagaggttgtaaagaaagaggtcctgaaactcctgcatgccgggattatttaccccataccatacagtgagtgggttagcccagtccaggttgtgccaaagaagggaggaatgatggtcgttgcaaatgctcaaaatgaacttattctgcaacgaaccataactggatggaggatgtgcatagaacaaggctacgaaaaaggatcattttccgctacccttctttgatgaaatgttggaacggctggcaaatcattcctttttctgtttccttgatgggtattgcaggtatcatcaaattcccatccatacggaggaccaaagtaagactacgttcatatgtccgtacgacacatatgcttatcgtaggatgtctttcggactgtgcaacgctcttgcatcttttcaaacgtgcatgatgtctattttctcgaatatgatcgaggacattatggaagtcttcatggatgacttctctatctatggaaggaccttcggtcattgtctgcaaacgctcgacctctgaccaacctgttagccaaagatggtcccattgagttcgatgacgcgtgcctaaaatactttgaaattctcaaaaaggcactcatctctgctccaatcattcaacctcctgattggactctgcccttcgagattatgtgtgatacaagcgatttcactgttggcgcggtcttgggccaaaccaaagacaaaaaacatcatgcaatctgctatgctagcaaaactttaaccagagctcagttgaattatgcaactaccgagaaagagctgctcgcgattgtttttgctatcgataagtttagatcttacttgatgggacgtaagtgataatttacactgatcatgctgctctaaaatacttgctcactaagaaggatgctaaaccacgcctcttaagatggattttgctgctccaagaatttgacttagaaattaaggataaaaagggagtagaaaattctgtagcagatcatttttctaggctgcaaatcactgacatgcaggaataactgataaatgatttcttgagagacgacatgctgatgacggtacgtgactccaacccgtggatggaaacatagtgaactacatggtatcaaaatacataccaccgggagaaaatcaaaggaagttgaaatacgatagccgccgtaacatatgggatgagccatacctatatagggtctgctccgttggtttactaagaagatgtgtgccgactgaacagggacttaagattatagaacgatgccatgcctcaccttatggtggccattatggcgcattccgcacccaagccaagatttggcaatgcggtttcttctggccaacgatgtatgaagattcaaaagaattcgtcagaagatgtccaagttgtcagaggcaaggaggaatcactgctcgtgatgcaatgcccctcacatacaacctgcaagtcgagatattcgatgtttggggtattgacctttttctaagtcatgtaactgcgagttgcaagtttattctggtggcagtcgactatgtctccaagtgggttgaggctatgttgtgcagcgctgcggatgcgaagcataccaagaagatgttgatagagatcatcttcccaaggtttggtaccccaaggatggtcataagtgacggaggttcgcacttcattgacaaaaccttttgagacctcctacgagacatgggagtgaagcacaacgtggccacaccttaccatccacagaccagcagtcaagcagaaacgtcaaataaacaaatcacgaatattgtgcaaaagacggtcaacaaaatgggaacaggataaaaggagaaattgccagactcattgtgggcataccggacagcatacaagacacccattggaatttctccctatcagattgtctacgggaagtcatgccaactccctgtagaacttgaggacagagcatattaggccatcaggaactggaatatggactttgaaggagtaggagaatggaggatgatgcaaattgctgaacttgaagaatggagagagaaggcatatcacaacactaagatatacaaagagaggatgaagcgctggcatgataagaggataaaaatcaagaaattcaagcaatgagacaaactgctgatgttcaactcgagggttaagcttttcggccacggaaaattgcgcagtaaatgggaaggaccgttcgacgttatcgacacctcttcgcacggggcaatcacactctgcgacgactcaaataacatatttaaggtaaacagttaacgtttaaaaatttttcatgagcctaatgaatctttagatgaagaagtggatattattgaattaatcgattatgaaccataatgatctcatctaaagcatgcttaatttcctgtaaaattgtcatttctgagcttagaataagtttgcttgagcgtgtgaaaattttggtagccagctgagcccactagggttcggccgaacccctggttccattctccttcaaagtccatattccattctcctgctcccaccagggtagcacccatcggccccaagtttgaatagcttcctctccgcgctcgttcgagtttgtctagatgcgcattcggaggtagaacttttggatcagcaccataagacccttcttcctcctctcctccatctctgcaactcttctctccatcctagctcacttccttgatttacaccctcaactcaccaatggctggcaaatccctgatgccatacattggctcctcctcaaactccacctacaaccttgaaggagaaacaccggcgaatcaagtcatcccagtggaaaactacacaatggaagggggcattcaccccttgctacggtgcccagctccccagcaaatatggagccggccggcaaactcactggttcggccaaaccaggggttcggtcgaacccgtctcggccccgttcggctccccgttcggcagcacgatccctctcccctcgtcatgtcaccaagaccaaaatccgggggtattagcctgcacgacgaacaacgacgggtgaactcagcctattaaagcgagacgtcttttccaagacgatgacaaggccactccgcctcctgctgagcggtatgtgggcaccctctacaccaaggcaggggatgaggagctccacaactacatcacacccaccgccactccatccacccccaaggaggattggttttgcattcggagagtgcgaactcccggcggtaggtatggtaaaggcttgctccggccgttgacggcatcggagaaggaggggcagcggaatcccgttgccctccacctatgacggtgaagcgtcatttgacgccccctccaattgtaagggcgcttggccaatttcaagaggaagaagtgaagtcgccggaaccctcggtccataagctagcggcacaagtgaagaagctccgcaaggagaacattgagcttagggaccgtaacgcagaactaggggtagagcttgctgagcttaggaataattttgatactcttagtcgcggttcatgcgctagatcaagcgtgcattcgtagagatggggaaggagaataagtatgatgctaattaaatgtctcctttctcatgaataaatgtaattggtgcttggtcatttattttccaatcatgtaagcacttgctataaataatgtgactcattggtgttaaccccaatgtttgccaagatttgtttttgttttgtttaataaagatcaggttttgaataagtgtgggggagatatcctagcttctgacgtgcacatactctgaaatttgctgaatatctaaacacctgaggtacactgaactctgcagggaattgcagaggaattgggtaccaaggtggttgggctgaacccaaccagtgctagtcccaatccctctcaattttcctaggtaagcaggtgagcacgtctattatctgtatatctccaccatggtatagtactagagctgtgaattcagaaattaattagttcaagcataattaaaaagataaaatttccaactaatgaaattcttcctatgattaatcttgtatatttattattcttagctgaacttgtacttgtgaacgaacatccatgtttagggaacgttatgcatcaaagtaattgttatatgtgagatggttaaagatgaaggaagttcttcaactgttgtcattacttatgggaatttgtttttcaaaataaaattttgttttaaagagctcattcctccaattgactttattttatacctaccaaggccatatgcaagtatatcaatgataaactttattatgcatatgactgcttgacattatattgagctttgtcaaatctatgtgactcatgttagatatcttttatactctcatgatcaaggggtcatttccatatatataattaagctaagcttctacactggaagttggcttcccacaaaaattccattaaaatatacacctattttaaactatgttttcttctcctagaaaatccttggaaaaaggaaagaaaatgagaaaaggagggaaaggcatggctataaaaaagagagagaaataaagcttgctctcaaaacattgagcatgatgaaaaaaaaatatgcatatagccatgccacttccacattcatgcaagaaaaaaaaatggaggaggtataggaaaaaaaaggagacacatttctttattccatcattccacaaaatatttcacttttcctttttccaccacatataaagacccttgatctaggagtatgactgataatcttcttgagtccatatatttggctttgcaatatatatgatgcatgtatgtcacacttttacccctaccaagctccatatatcagccttagaataggggtaagtttggcacatttttgccttggtgaggatccacaagaaaaaaaattatttacttgagtgacaagggataaggtcaatatgaggaaaagagttagtttgtgaaaattcataaaaatcccatgagtctgaccggagaagcaagaaggactggagtcgagatcattccatttattaattacccaagatggcaagtaaccactgttaaagttcacaggtgtaggtatggttctgaataatttatatactcgaattatatcttggagaaatttattctacactaacttttactccgggacgagtaaagagctaagtgtagggggttttgttggcagttattcaatgccaattctataccgccaacatctgcataaagtccagacaataaaacatccaacatagagtgataggtgttaaatctcacatatttcacaagtgttggtgtatatttgtatgcaagtgataaactctaaagttgggaggaaaatcatactaaagtgagagaaaatatgtatccatacaaggatggtttttgaacttcatcaaaataccatagaatcaacacaaaactccgagaaatggatagagaagaaccaggagaggagatgggccgaaggccaggccggaagggcccatgtcacgtcctgataaattcatcccgaaataaaaatcattctctaaaaggaataatagaattaattaaaattcgaaaagaaattggttaacactaaaatatgtacaagaaaaattcgaatgtggcccggagaatttttgttaaattctccttggtctaaaatgagccctcaaattttacttgaattttcagagcaccggaaatatttattaagcaacaaaaacaattatcaaagtttattaaaaaaaacggtggttgtactcattcttgctctatctttccccccttcagtaagagaagctttggagaagaagtcttaggtggagtcctggcttataccccagttgagcgcctgtgaagatggagccgtaggcctgctagtccgctgctgtttatttttgattgtcaggcctgaagtgcctttgtaataatgtaaatattatcgatataataaagatgtgccttttgtatcatgtttgtttggtgtaccccggcttttcctgggacggggattaatacactagcgttcgggaaaaggcaattttctcggtcgcgacaagctagtatcagagccatctcgactgtaggataagccaagtggataaaacctaaggacatattttataaatgaaactatttgcgaaagttccttgttcctcctttccctaatgctatttgcaaaatgtttattctcttcttcctccttcggattttcaactagtactagatggttagttttgcgaa

SEQ ID NO: 67255 - DNA, 11344 bp, Oryza sativa
acatcaaccgtaaaacgatgcactcaagaatagcttactgttggaatgtgccatatggcgtgtaagaggattagaggaatcccatattgctttatcacagtttacttaagaaaagaattgcattttctttctatcagatattagctagttaaatgcaactaatcattacatggtactccaatgttactaacttaaaaaaaaggtactaaccttgtattaatggtttttcttaatacaagcccatcttttgtggcttagttatttaatactaaccttgtcttattattattattattattattattattattattattattattattattattattattattattattattattattattatttctgtggcttgatttaacactaaaagttatttaagcatcatataaaactaacaattaaatgttttaaaaaactcaatgacgccatctaataaaaataaatttaatataacctaatgtcaatagctaatcttacacgaccaccaagaccacattctgaaataaacatatatgccaaaaccatataaatatgaaaaaaaatctaataaatatcatcaacaaacgttaagaccatcgacaaacacaacttcaaaaaaataccattatacgagtcaatttattccgaaataatattgtcgttagagtttcaaccattccactctattaacccatcacattttaatacgtagaattgtacgaaaccttttgaacgcagaggaatgtatgactgtatgagaccccaagatcatagtatttatatggcttttacaacggtattttctaaaagtcatgatggccaatggtatttcgtgcatttcttacattttctccatgaatataacgcttaaaaaactgtacctcactaaaaggaaaaaaaaacatatatccggagacaacgacatgccttgacaacgaaatgaaacaacgaactcaaaaaatcgccccaaagaaaatgaaagaaaaaactgatttattttttctttttccagattggcttcggctccttcttccatcgccgtcctgttcaacgttcaaacccttcctcctcccgtcgcctagtcgccattggcgacctcctcctcctccacctccacctcccctcccttaaatccctcctctccccgccccacctccctccccatccacaccgcaagcaagattcccaagagaaccatccatcatcttggaatccaagaatcgcccgccaagaacagccaagaaccggaggatttccgcgagggagggagctccaggaccctatcaatcggggattcggtgaggggggaggaggaggcgggcgagatggtgaggctgccgtacaccacggcgctgacgacgctcttcagctacgggctgctcttcgcgttcggccagctcagggatttcttccgcaagctcatcgattggttcaaggccaagaacgtcaaggtagggcctggcgaaaatcgctgcgggctctctctggtcggatccgggtgtttctcttcgtaattcttgatgagagatttggatttttctttttggacgcagggctacgcgccgatctgcctcggcctggaggatttctacgtgcgccgcctgtaccttcggatccaggtactcgctttggatcgacgcatttgcttgctcgccttattttggtttaggaaattctgatatgctttagagattaattgaaatgctcgctgtttatgcctcgtagctagaaatgtctgagttgtatcggcgattcgatgaatgttttctgtgatttggggtgggctttgtgacgatgagatgggggaattgctggttccggaacacattttgttgcattttcacaaaatgttgcattcgatattctacgagtatatgggagcatgttgggggaaatttctgattatttaggagtttgggtgagtgtttattattgtggagaagattattttgtatttttttaagctctgtgaggaactttggatgcaaccccctgtctttggagctgaagcaatatgctggattctttcatggcttgaaataatctcattatctgctgacactaatatgtaaataccaactaaaattgtagaagattttagttccagttctaaagtgctggttttctaaaataattggtagcataacatgcttgatgttcatgtctttttttacttggctgtttgaaatgtgtttggcctgaaatggcaagggccatgttatctacttcctgaatatatgtatgacataatccaatcatgctgctcatttcaagtgttttacggatttagtccaccgcacgctaaatgtactgtactagtcagtattggactggattttgcatgactctgttatgttgcaaggttatctccttcaattatttcagtgttaattgcattggatattaaccaatccatatttatggtttcacaggattgcttcggtaggcccatagcaagtgcaccagatgcttggtttgatgttgttgagcgctactccaatgacagtaacaagacattaaagtaagcacttcttcttcttattgttatcattctaggatagagcttgagcttaagacaattgggctgaaaaaattacgtgcagttctgttatctgggcatttccacatgcagctgcatacttggtgcattgaccaaaacaaaaatcagctgatcatgcaggcaaagtcaacccacctgatctggacctatatctgtacaaccttttaagctatatatactacataatgaccataatcaagtttgtcaatatgcacttattggaaagttgtcggttgagcttcaatgatctgttctgacatatagatgattatgataaaaatatatgatccaaaaataaatgaaatgaaaaacacgcacaagtttcaactgttgtttaaactccaaatattgtttcaggcgtacttcaaataccacaagatgcctcaacctaggatcctacaattaccttggatttgcagcagcagatgagtactgcactccacttgtgatcgagtctctcaagaaatactcacccagcacctgcagtgttcgcgttgatggcggtatgcctggatgcttgtcatgcttttttttttaaagaactgcagtctgtaggcaccatgctgattccttttatttggcaacaggcacgaccaaacttcacactgagttggaggagttggttgcacgctttgttggaaagcctgctgctatcctatttggcatgggttatgttacaaactcggccatcattccttgcctagtaggaaaggtacaatcaaaacgtcaagtggttgatctatccagtaacagaaaacatgactaaacttagcagcaattaacatgactaaatttcatgttattccagggtgggctgataattagtgactcactgaaccataactcaattgtcaatggtgcaagaggatccggtgcaaccgttcgggttttccagcataactgtaagcttttatgcctttatgcaatgcgaagcaatattcactgtttgtggttcacaaggacttatttgtcagcatgctgcttacagcccctgctcatttggaagaggtcctgagagagcagatagctggtggtcaaccacgcacacacagaccttggaaaaagatcattgtcattgttgagggtatctacagcatggaaggcgagctgtgcaaactacctgagatcatagctgtatgcaagaaatacaaggttcgaggaaatttcttctaatttacagtttaagttctgcgcataaagcagcttaattagcttctcaatcaattagcaatctatatgaagtgcaacatcgagagttgaccatgttgaattattctttattctgtaaaataggcttacacttatctggatgaggcccatagcattggcgctgttggccagtctggtcggggtgtttgtgagctccttggggttgatccagctgatgtggacataatgatgggcactttcactaagtcatttggatcatgtggtggatatattgcagcatcgaaggtacatcttcagagcacttctttcagttgcttgaattgaaaatttactgattcaccttgcttgaactctcaggagataattcagcacctgaagcttagctgcccagcgcatatttatgctacctccatgtcaccaccagcagtacaacaagttatttcagccattaaagtgatccttggagaggatggctccaacagaggtactagccttttcttctgcttcgaccctttcaatgcgctgcaggctatccatgtaagttttactttcaattcttatttattttggttttgatgtcttgcaggtgcccagaaacttgcacgcatccgtgagaacagcaatttctttaggtcagagctcaagaagatgggttttgaggttctcggagacaatgactctccagttatgccaataatgctctacaatccagccaaaattccagctttttccagggagtgccttagacaaaaggttagtaatggtatagaatgctatttatcttcagaaatggtacagaataatggtttttgccagttttttgtcgttccctagcccctattaccgtgcgactgatgtggcactggcatttcaggttgctgttgtcactgtggcattccctgccacacctctgctccttgcaagggcgcgcatctgcatttctgcttcgcacactagggaggacctgataaaagcccttgatgtgagtgctttcgtttgttaattttcggctgttcacatatgtttaaacggattccaattcacattgttctcatgtttgtaatccactcacgttatcagcagagttggtgatcttgtgggcatcaagtacttccctgcggagccgccaaagattgctgaagctgatcacgataagctggagtaaatgatgaactgggttgccccattgaatgctcaagttgctggaatctggtaaacaaggcgcatgttgttgattggtttcatcggtttgacttgggattttgttgatacctgagaatccagagcctgtctcattagctgactactgttggttgtacaatttacacttctaaaatgtgtatagctggtcgaagtttgattgttctattgttaatcgattttcttcatgtaatacttgatagacacaatataaattaaatttatgatagaacatttctattgatttctgtggaaagttgaagtaaccattttcagcaaatgaagcaatgcttttcatgtgtttctccatattcagtcaatgcggtatttgagatacagcagatgcatatgtattatgttgtataccaatctcctttacagcagttctttggattgcattatttcacttagtattagagaaatatatactggagtttctagaacctttgtaaatacgatgttaaaatataaaaacgggtagtcactggaacaaaattttcattttaattcgccttgcacaatcacctaaagtttaatatcatttgacttaaattcttgaaagtctatagtatataccaccttttcatattaaatcgttttgattttttttaaatcaaacttttttaggtttgacaaagtttatgaaaaagtatagtaatattttcaaaaaaaaaatcaaaatatcaatatgttcaacgttaaatgtaataaaactaatttggtacttaagcgttgttaacttcaaaaatttgaagtaccttataatatgaaacggagtgaggagtgttaagggtatgttcggcaccccttttcccaacccctcttcctcgtttttcacgcacacgcttttcaaactgctaaatggtgcttaaaaaaccaaattaatccatttttgaaaaaaaatagctaatacttaattaatcacatgctaatggactgctccgttttccgtgtggagggaatgagttcccatccggtagatgcaaacacagcctaaatgagttctcatataggtggtgtttagatctagggactaaactttagtccgtatcatatcggatgtttgaacactattttggagtattaaacatagactaataataaaactaattgcataaatgagagctaattcacgagtcgaattttttaagcctaattaatttatgattagtaaatgtttactatagcatcacataggctaatcatggattaattaggcttaatagattcgtctcacgaattagtctaagattatggaatgggtttttataattagtctatatttaatactctaaattagcatctaagagcctgttcactttgatgcaaaaaaacccttacaaaattttggcatagttgccaaaattttggcaggatttcttatatagttaccaaaattttgcagcaaagtaaatgtagccacttttttggtaactttactaaaacttggtaaggttgaaaatggcatcaaagtaaacaggtcaataggctctaaacatccaatgtgacaggcacttaaaaaagatttagtctacacaaaaaaaagaaaaataaaaaagagaaattaggaaatgaccaaaatacccgtaggcatctcatcctctacccttgcctcctctctctctctgttttccagccgcctccccccgcttcgcctcccctcccctcccctcctctcgcgcgccgccgccggcgagcacgtcaccggaggcacggcgcagacgagctcctctcctctcctctcctctcctctcctccccgattcctccctgctcccgccccccgccctccgtctcggttctattcgaatcgaatcgaaggtaaactcatcctcccctctctctccctcttcctcccatatgagcagatgtgggagattcatcaggacatggatttggattggtttttttttagtactgaaacccccatttacccccagcaccaccacgtgacgccccctagttcagatgtgtcgccgtttgcgcctaagatggcagtggcagagtgcagcaaagagttgagagatgttagttcgccatatcgtcaattaggatgctccacggagctctcgtcttgatgttagtacaaatttagtcgaaagccattctaatgtggcggtgcccctgggctatttattgggagcaagggggatttgctccattttgttacctctgtacggtgtctttaccaggaatttttagccgaaaggaatcccgcgccgccgattttaagcgctttgaatagatttttggttatagcctcgaatcgctagtaatattccctgcgcatcttcgacttatgattcatcacctgcggaaacatgtgtaggtctgattttgtgttgcaagagagtgtggaaaggtaggtcggctaattcagtttgtttcagccgtcctgtgtattatattgtggtggttggttttattcggacctgatttccaatgactaccctggttaatatggttatgctgtatagcagtattttactacctatgtgtattcttaacacttcagaatgaataaaatcaatctatgaatgtgtaagccaaaacttaaattctacactacagctgtatagctgtagtagcaactgtggtattgctaaagaagtctgtatgttggatcggaaaatgtgaaaccagaataatacagtccagtagtccatatgttttctttctgccttttcttataaggagtaaggttatcagccagattgtaagtttatttctgtgaacatggaacttgaataggcatatgatctttcacaggattgggaatttaggatataccctaatgaactacaacctctaagcagcactgccttcttgtgtgactaattaagcaactattagtttgattcttactttcatatgatttatcttaaatggccatgactgttcaatatgtgtcttaccaggaattagtaggcagggattcatatgactgcctcatttgtttttttgttacctttgtttgctgttcaatatgtgtcttaccaggaattagtaggcagggattcatatgactgcctcatatgtttttttgttacctttgtttgctgttcaatatgtgtcttaccaggaattagtaggcagggattccattcagattttgagtgctttgaatagactggtgattagcttcaattctctagtaagattccctgagcatgcgcaacttatggttcgtcacccatggaaccatgtgtaggccgatttttgtcttggcgaaagtgtacaagtttcctaggtaggacagctaattgaatctgtttcagtcgttcctatcaattgtatcatggtggttttttttttaccttgaatccttgttcttatttcaaataaccgtgcgttgcttatatagttattttgtacagttactattttactacctatggtttgtgctgacatcggaatgaacaaaatcaatatatgaatgggtaagtcaaaacatagaaatcctacacggcacttgcttgatggggtattaccaaagaattctgtttatgaaaacagaatacagtccagttgtccatattttgctgcttttgcttataaagagcaaggttgccagccagattttccctgcgaattcggaaattgaatagaagtagaatctttcacaggattgggaatttaggatgtactcccatataatttaatcattttaacttccgtacctgtggaagcatgaagatcggtactctgactattgtgtcatcttttatttcttatgaagaactacctatctctaataatgcaacaggaatgtggaagagttctagatggaaccattatacatgggtaacaggggattaataggcatcactcttcgtctgttttctgtagttcatatataccttcactttgcgctgcatattaggctctactcatggtcttaggaatggtatttccgagcatattttgttacatggttcaacaatctcacttaataagttcaatggacgaatttgaatatacatgatgatggagatttgttttctaatggagtacatctgaatgtgatctttgacttttgttgtcttttcgtgtgactaataatcaactactacttcgatccctactttcatattatttatcttaaatggtcatttgactgtctttttcttcttcatattataccatcctaccttcttttgtatgattgggtggttctcgcatgttttgcttaacattggagaacttatgctcatttatgactgggtggtacatttatgctcatgcaacatttgtgtggcagaacttgttcagcatcactccttaattggcttgacatccaccgtaatgtgaacattcattatgatgatatcaaaggtcatgcatttgttaccttttttttttttttgcttttttccgaggattcttcttattactgaccattatctcctaatctagttgttatgtagtgtatttttaggaactggatatttcttccatggttaatgtccagaaccatgataatagatatttactagttacatttcttttcgtgtatagtgtaagaagaattgttcagcataaaaacttgtagccttttctgacatccttgcatttttttaattccttttgaataggttgtaaggatgaagaagggactgcatcctcagatgcagtggatttcatatgtgacacaaagcggcaggttgatcaatatcatgatgaccaaggtcaaccatactggcaaagtgtatcatatgagagcaaagcgtcaaatggctcaaagcctgggccagattgcaaagttcaaccgccgataccagcaggaatctgaggaaaacaaagaaaagtaggctgctgtcagcaaggagctacatatgctctaaggcagattagtgtggtgctatgtttatcgtccaggaacattgctcatggatctttgttttggatgtcatcctcttccatgtagccatctgatcattgtggtttatccctgtagtttcagttctaccattcacgaatttttctggagctatttttgttgctcaattctgcccgatatctctagagaatacagcatgctactttatgttttgttgattttagattgaagctccctgaattcctgtaagatggcatcgtttggcttgtcatgctacgtctcttttagcttatataaattatgtttattgttagtacataatatttctattattctcaggtgtacttgaacctttttttgtatgaactgtaaccttaggtgatcctggccttaggatttatataagataaccgtagtgtgatgatgattgattatagttgtagacgatggacaagggctcaaatgtataaattaaatactagaattaaaatatcatttagaaaagtcatagaagcaatgctgattgctgattgagcaagtttttgaaatcaacgtacagtacttcctagaagtgtttgtttggataatttacagaagttatgcccattgtctcgtttatttatatgcttatccaaatcgtttattagcacataaataatcatttgtgggtgaaacttttatgtagtgttcttagcgacccaaaagtacatgttgtaaaataaattatgatgcaaaaacaaaaaatcaaattcaaaattagattccaatatttaaatttcaacttacaaacataatttaattcctagcatcttaacgtggagttagtggagatgaataataactaaaatatccttaattattaaaaaaggtagtaaaagtgaaaagtagtaaaagtgatagataggtaacatggagttagtggagatgaataataactaaaatatccttaattattgaaaaaagtagtaaaagtgatagataggtaaagggtattgtaggaataaaactgagagtaggtagaatagcagatgttggtattttgtgggataaaatttacactctagaggttattttattttattattattattttttgacgaagggagtatgcgagaccgaccaatcaagggaagggaatacgagatactcgtgcaaagcccgcaccccctgtctctctctatcttctcctcttttctttaagatttattaccgttgaagaaaccatttctctccctgtgtctctcgctgcaagtggaccccgcggtttccgggccccaccgtgtcagtgggagatggggaagaaccgagaggtgtttgaagcttcttccccttgtcgccgtcaccgtctcgtgagtcgtgagtcgtgacagctgcctgctccttctccacctccaccctctctcttctcgccgagcgccgcgtcggccgcatcctgctcccggggccccggccgccgccgccgacgacgccgccacctagcagctgcgggttacagcggcgctgagggcgagggagggagaaggccggccgcgcgcaagccgcaaggtggcaggtgaggtggggggggggggggggggg

SEQ ID NO: 67256 - DNA, 7493 bp, Oryza sativa
cccacttgattcgtgccctctaacacccggaacggccgcgccattcccggccgccggccacatactccaccgccgttccccgctcctcccctggccggctccctccccgcgcctataaaatggaatccccatcctccgttctatagttttagcctcatcccgagcctccccatggtcgtatcacccctccccgccgtcgcccttctctttcccccgcgccggccgcctccaaccgcctgtgcggccgcgcgtgagcgtcggtcggccgtgccgtcgcttccctcggctctgtgacgccgccctcttctccggcctcacctcctcctcgcccgaagctcgccagagcggtctccttgtcggtgtccagtaccttcctgcctccggccggctactgttcctcatcggtgcggcagccgtcgtcgtcatctccttccccggctccacggcgtcaccctccaccccgaccgctgcccgtcttcgtccggagcccgccgccgccgtgccggcctctctttcctcctcgtcgacgtcgccttcggcagccccttctgccatccccgtgcgccgtcggccgtgccaccaccacctccggcatcgcagcggcgagccagcgacgtcgtcctcggcatcgcctcctctccatcctcgtcatcgccgacgtcccttcggtcggccgctcctcctcgccggctcctcgtctcgttgtgccgccaacatctctgtctggtgttgggaaagttgcgggaacatcaattgtatgccaagcttagcaagtgtgagttctggttgtccaaagtcaaattcttagggcatgtgatatctgctaaaggagttgctgtggaccccgaaacagtgaccgccgtcactgattggaagcaacccaagacagttactcaggttcgcagctttttgggtttggcaagatactaccggaggttcatcgagaacttctccaaaatcgctcgacccatgacacagttgttgaagaaagaagaaaaatttgtgtggagcccgcaatgcgagaaggcgttccaaactctcaaggaaaagctggtttcctcgccagttttaatcttaccggatactcgcaaggacttcatggtgtattgtgacgcttcgcgccaaggattggggtgcgtgctcatgcaggaaggtcatgtggtagcctatgcctcacgccagctacggcctcatgaaggcaactaccctacccatgatttggagttggccgctgtggttcatgctctaaaaatctggcggcattatctcattgggaatcgctgcgaaatatataccgatcataagagtttgaaatacatcttcacccagtcggatctgaatcttcggcagagaagatggttagagctcatcaaggattatgatgtgggaatccactatcaccctggtaaggccaacgtggtcgcagacgcgctgagtcggaaaagccgttgcaacactcttggcgtccgtggcattccaccagaacttcatcaacagatggaagccctgaacctaagcatagttgatcgtggattcttggctacgctggaagccaagcctaccttgctcgatcaaatccacgaggctcagaagaatgatccagatatgcatgggatcctcaagaatatgaaacaaggtaaagccgctggtttcacagaagatgaacatggaaccctatggaatggaaatcgtgtatgcgttccggacgacaaggaacttaaacagctgatacttcaggaagctcacgaaagtccttattccatccatcctggcagtacgaagatgtacttagacttgaaagggaaatactggtgggttagtatgaagcgggaaattgcagagttcgtggccctttgtgatgtgtgctaacgtgtcaaggcagagcaccaacgaccggccggacttctccaacctctccaagtaccagaatggaaatgggatgaaattgggatggatttcatcaccggacttccaaaaacccagggcggttatgattctatatgggtagttgtggaccgacaaaccaaggtagctcggtttattcctgtgaagaccacctatggagggaacaaactagctgaactctacttcgctaggatcgtgagtctccatggcgttcctaagaaaattgtatctgataggggaagccagttcacctatcatttctggaagaagctccaagaagagttgggtacccgcttaaatttcagcaccgcgtatcacccgcagacagatggacagaccgggcgtctaaatcagatcctagaagatatgcttcgcgcttgtgtcctagattttgggaagacatgggataagagtctcccctacgccgagttctcctacaataacagctaccaagccagcatacagatggcaccgtacgaagcgttgtatggccgcaaatgccggacaccactattgtgggaccaagttggggaaagccaagtgttcgggaccgatatcttgagagaagctgaagcgaaggtcagaaccattcgggagaatctaaaggtggcccagtctcgagagaagtgttatgcagacaaccgacgccgtgacctggaattcgcagtggatgactttgtgtatctccgggtcacgccgttgcgaggcgtacaccggtttcagacgaaagggaagctcgcacctcggtttgtgggtcctttccgtatcattgctcgacgcggagaagtcgcttaccagttggagctgcccgcctccttgggcaacgtgcatgatgtgttccatgtgtcgcaactcaagaaatgccttcgagtgccgtccgagcaggccgactcagagcagattgaagttcgcgaagacttgacctacatggagaggccagtgaaaatcctggacaccatggagcgcaggaccaggaactgggtaatccgtttttgcatggtccaatggagcaaccacgccgagctccggtccaccgccgtcttcgccccggaccgtttcccgccccggcgtcacctccttcggcttcgccgcaccgccgtcgaccccgtccaccacctcgccgagcccgccgaccgccggaacgccgtcgaccccgtcgacccgagccgcgccgccgccttcctccgctccggccgcctttttcgtcgtcaccgtcgacctagggtgagccgtagaccgccgcctcttttccccctttcctcccctctctcgaccgccgctccgccgcgccggtggtcgccggcggcgaccatcggggcgcgggggcgccgcctcccgccggccgcgccgagtggccgccttcgggcgtgccgagtggccgccacgtggggcccggccgtcagccgcccgtgccctcgggtgcggctgacgcgtggggcccacggcgccggccggtgcgagcccaggtgcgcctggtccactgtggaccgtgaggctgccacgtgggccccactcccgtggacccggtccgcacgcccctcccctcggctgacgcaataaactctttttaaattaaaatttaaatgaagaaattcgcaaatattcatttaaagagcatataaacttcaaatggccataacttggccatttaaactcagaattggaccgttcaagtctctaatttttccttaagaagtcaagaacccatttttgtgctttgttcctgcttgttatatagagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttagattcccacgttatctctgttttatttagccatgcctatttacctttgttatgaccttattattattgttattgttattattaccttgttcaccctagattaaacaaaaccccaactagtggacactctgctcatggtaccactagtatgaatttaggtagatgcttcgccgcttaattaggtaacattaggtggttttacaactctagactttgggatattcatatcacctggatactatggaatggttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttgcacatgtctagtgggtaaggcttagtttgtggctcagtctggttataaacaaaagtacacagatggagatggacgaagtcgggggtcgatggacatctctaggacaaatgaaggctacacgagccgcgacccggtagtcgagatgtcatggcacagggccggtgtcctgctgctagggactcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgtgccctcggttatgggcaagccgagtaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtggcttcacggccttgtttaataatcttgtatagctctaggatcgtatttacaaaatagctttgagcaactaagtgtcttttaatgctgtttactgcaaaccctaaccctttatattacaaccccccttgtactcccttgcatttattctgcacttatgggtgtgtcttgttgagtacggtggttgtactcagtcttgctcaatttttcccaaactcagaagaggaattcctggaagatgaaggctttggtgtctagctcgtgcctgccgtcaagcgcctgtggtcgtcgccctagccttccgctgtttcccatttgtctttgtgtgtgctgggccttcgccgcctatgtaataaattaattaattacgcttcagcttgttaaactctgagttgtatcaacttttggtgtaccttgcctcctgggacaaggaataatgcacgcacgtaaggaacgcccgttgggttatttccggtcgtgacatgtggatatgcctagctctagctctagctcttgtgtttctatttgtgatgcctcacttgttgttgagaacaatgagcgtaaggagcaagtggccaagctcaacaagagtttggagaggtgcttcaaggataagaacactcttgacaagattttgagtgagcaacggtgcatccttaacaaggagggacttggattcatttcaaagaagggtaagaaaccttctcactgtgccactcgttttgtcaagagcaatggtaagtattgctccaagtgccgtgaggttgggcatttggtgaatgattgccccggtggtaagccttctatgacatgcatgtttgattctcattatatgcttaggaaggctcatgatggtagcattgttgctagatatgtgggttcccctatactcagtggtaaaaagaatgccatttggttgcccaaagttttgatctctaacctccaaggacccaaacaagtttgggtacctaaaagaccttgatcttcttttgtaggtgaactaccgcaccggttggagtcattgggtgcttgatagtggatgcactcaacgcatgaccggtgatagggctatgttcaccacatttgaagtagaagggaaagaataagagaaagtgacatttggagacaatagcaaaagaaaactaattgggttaggtaaaattgctatctccaatgatttggcaattgataatgtctctcttgctaaatctctaaatatcaatttgctttcggttactcaaatttgtgatcttggcttgtcatgtgctttcttcccacaagaagtttttgtttctagatatggaaatctttatttggttgatttcaattctagcgaagcaaatttgacaacttgtttaattgcaaaaacttcattgggttggctttggcataggaggctagcccatgttggcatgaatcaattgagcaaactttcaaaacgtgatctagttgtgggcttgaaagatgtgaagtttgagaaagataagctttgtagtgcttgtcaagccggcaaggaagttgcatgttctcatgctactaaaagtatcatgtccacatctagaccattggagctcttgcatatggatttgtttggcccaacaacctatagcagcattggtggaaatagtcattgtcttgtgattattgatgattattctcgctatacttgggtgttctttttgcatgataagtctattgttgtcgagtgtcacgtcctgataaattcatcccaaaattaaaaatcattcgctaaaaggaataaaagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgattttataaaaagaaaaaccataaaaagtctttttcccccccttcccctcttgggccggctcggcccacctccctccctctctctcctctcccccgcggcccaatcggcctcctccccgcgtgcgtgccgctgacgggtgggcccgcccgccaccctcgctgacgggtggggcccacctgtcatccctgtcctcccgccgctcccgccgcctcgcccgtgccctagcgccgccgccgccgcgaatcccgccgcctcccgccgtccccgcgcgcaataaagagggggaaatcactccccgtgattccctctctctttcccccctcttttccctctctctctccctcggattcgtttggaatccctcccgaaatcttcgccggcgcatcaatggagcccgagatcgccgcgccgatttccttcctctccggccgccctctctcactcccacccctatttaagcactccccgtgcctccctcctccgtttccgccactcgccgctctctctctccgccggaatcgagctcgcgccgtcgtcctctctctccgccgtcgccgccgagcttcggttcgccgccgtcatcgccccggacctcctcccgcttcggcatcgcctccttcggcttcgccacgtcctcgtcgacctcgtccactcctccgttccgcccgccgaccgccggagcaccaccgtcctcgtcgacccgagccgcgccgccgcctctctccgcttcggtcgccgttcccgc

SEQ ID NO: 67257 - DNA, 44266 bp, Oryza sativa
ggatggatattatattttaatgcttctagtgtcctgcagtaaattaccacacttttgaagtgttttcgggcaaattcacatcttttcggtgtcccacagctaattacacattttttgagtgtcatgtagcaaattttgcccaaaaaatagcacaagaatttttcgcttttgatcagaagcataggccaccggtttttcttcgccccgtagcatttccgttaggtttggagttaacagcgttagattgaagtacagaaaaaattcgttggacccatttgccctttgtcttcctcgccgcattttccccgtgtcatctacccgttccgttttcaccctattagcctcgacacgagtacacgatgacatgctccggcgggtggcctcctagctcgttgagcaggcggggcgcctacgcctccctgctccaccgcctccctccccggccggcgactgctgcagcgatgatgctcgagcgccatccgccggtccatcctggcctccgccccgcggcggcgacggtgcagcttcggcgcctcccatcaggcctgagggttactccacctccgacagcgaggtggacgggctaggcaagtacttcagcgaggaggacgaggaggaggaggcggcggaggagttcgtcgaggacatcgtggcgtaggaggagtgggagggcttcacgttggagtacgaccatggctccaacgccgacgaggatgctgcggagtaggagaagaagtagcggcgctggaggtgggattctcttccttagtctgtgttgcacgctaggtgcttgcggaaatgcatgtgaggttctacgcatgctttaataaactctttagttgtcgataaatgatcttggatgcccatttgggtcaaacctgattaccgttgtcttaaacaatgtgagtcaaaacctaattctaccgcaatatcgtaggcatgtattgttggtttattggagtggtgtctcccctctaacagccgccgccgccgtcaccctttctcttcagcttaatcagcgaaaccaacgcaggactggctaggggtccagcccaaccaagcatagatagaacaagggcaatatggtctttctaactcttgactaataactaaacaattcactggaacgatgaccacgacggaagtgctacggggcgaagaaaaaccggtagcctatgcttatgatcaaaagcgaaaaattattgtgctattttttatacttattttttcctatgctatggatcaaattctctagatttaaaggttttcaaagcccaaagataacgatgtgcttgtgctgtttaaacagcagtaagtaaataggacggcccagcagcatccatccgacgacccggcccatcttattaccaaggaacaagcgtggacagtatcgaagttccaacaaaaggtactcttattatcatcagcaaaaagtttctcaaagaaaagattatcagcaacagtagaaggtaaaggtaaggcgacgctgacgctgcagatcacggatacatgatacaccagtacaacaccgattgataaagatctcatccccaaatagaatatcaaacactcagcggcatactcttagtgagtgtccgctggggtcatcacagtaggcaataggagtctcatctctccacttactaagatttcaggacttttaatttaaagtttcacaggactctacccactgttccaaaaacagcgacaggaaaccgtatgcaagcgcatcatcatcttaaggcagcgtagtgacatggtacggtatgttacttaaataaacccccccaaaagaacaagaagcgtatctcagctcctccacttcatggactcggtgcattgtggcgagagttgggcttcaaccttcaatcatctgatgccttcggggagttctcgggtgtcttgagtgtgccggacgcctttttcgccttgtgcatctccaccgcagctttgaactcctccctgatgctggtatccctgaacttcagagcaaatgtggcaagcccgctctgcgagtcgccgatgctgttcatacaggcaaacgtcacgcccttcttgtccatgtccttcagcgacatgtcctcgtaaaggcttgcgttaagaactagcctgtaattgcccttggttctcatgacgagacgagacctctcgccaccagatactgggatgttcaactttagttccccctttcctctttctttccaacccccatccaagtattcatacaatgctgagtcggctgtgaatatggccttctcattctcttcaccagtttcaactgggccctctggcatagcaaatttcttgggagcttctgccgaagtcgcaagcgcaggggaggaactcccattattcgaagcaccaatactaaaagatgggaatgatgagccatcagtctttagcccaaacaggggagcactcgagctttctttagagcctgatccaaatgaaaatgaagagcctgaaaatccagttccagccagtcctgtgaaggcattttggccactcgacaggttcttgaaagagaaaaggggtgttggtgatgacgactgccccttgttatcagcatccttctgctcctcagacgatccatcctttgtctctgattcatctccatctttcttctcatcatcacccttgctaattttgtcttcagctccagcctcatttgctccatcctcttcttcagcatctccctcttttgctgttttgtcctcgatatcagatgccttgctgttatcttccttggcctctccagctaccactgatccgccccccaagtcttttgcttcgtcagtggtctcaacaggttgagaaggtggttcaattgagtcactggacttggctttttcatctgatccgtcagatctgatccatccttttctgtctcacctacctcactagaacctgcactcttgtcagttacaggtaaagcatttttcccactgccattggctccttattaactttctcacttgaactatgctttgcattcgctgtaatgacatcagaaggttgaggctctgagacagggatagttgcttgggcgctggtatcactgggggtaaatctgattgcagagaaaggattagaaggagctgatgagggctgctggcgtcgaacctttacaattctccgtgttgccatcacttcctcactagctctcttaaatgtccccatctcttgctcagttgagtcatcatcaggctcaggattatccttgttgatttgggtacctgcaaccctcttcctagacgttggagcatgctcctcgtctgccatttcaagttcctgagattacctggaaatcaaaataaaagaccagagattagcaaaccaataatgatgtcgtaaaacttacgcaggcgttgcaattaaaacacctattagtgggtttcaaaattccagatcaaatatgcagtcttttcatgtacgtagcatgagtcaaaacatgaatgcagcatgaactctaaaagagagttaacagaaaaggctcaacatgctctctaattacacaaaactacaaaacatcatgtctgtacaggtcaatagcattatgaccatgcaaattccttacaatccatcaatctatgcacagaaaagaactaaaaaaccagcgaacttgaaacgaaaaaatggttgtgcatgtacacagcaattgaaggcagagttgaacaaaattacatgatttttctaaaatatatgtgtgaagtataatatcctagtttaaaggctccggcaacttttagctctttccttcaatcctctagggcacataaaaatagtttctgacaaggactcaattgatcaataacatgagataagagatatgtgcaaaggcctcataagcagttattaataaaattaaggttgaagttggagagaccaaagtttataaagtcatttcaattggcccatgaatactatatacatagtttttgaactaaatgttgtaaatgaccaagaatatctaccggcgtttaaaaaatatctaccgctgaacaagagcattcatgtttttcattgaaaaaagaaacatggccaaactatgtaatctagtgatgaacatctgaagcatgtacgtttatgggcagtgcagtatttacacctgggcctagggcaagtaaaaaaaaaacttctttttttctatctttgcttggcatcctaactagattcacaactgaaaaaccggttgccctaacagtaaggacccctccaatatagttgaagacagcaatggaacaacataggcatggacgcatggtattgactaactggaagctatgcttcagcaaacgtctgagaattagcagattctagtacacattataggaattccaaaattgtatacgcaacgttatactcagaagagttgttgctacagctaccaatcagctaaatcaaaacaaaagtttctacataccgacagagagaagtataaaggtataatcaatactcaggaggtaaaaaatttgcagctaaccaaacaaacatgaacaagctgaaaattcatgcattcccagagtagtgtaggtaccataagaggaccaatttcaaaaatactttactcctttaaactcctttaaaaggagttgggatgatggtgtgttccacagtagactctgtttgatattttacatttttctcaggaccaagcccagcacaggtaaaagccccaaagcctgaagtaaaccctaatttcagtttatcttgactaaaaagaaaattgtcctttgtacttcactagaattcagaaatcatcagctcatcgctacttcaatagaatttcaatccaaacgcgtgcagtaccgaactactactgaccaaacaagcccgtactcaccagaaacggcggtcgacggcggcgtagggagggaccacgggacgaggtcgaacggagaggcggacgggcggatggcggagaccggggcgtggccgctcagaggcgccggtgcgccgcccgagccgaggcggagcgccgctgcctcgccctcgacgacggcggcggcggcggcggcggcaagtagcgagtggctccgacccttcgcctccggagtacagatctggcaatttagggttgggggattgggagtggctcgttttatatggcggctgggtgctgggctttgtaggcgatttgggccttcgtcgtatccggacttcccaaaaggccggcaggtttacataggagtcggaccgggccgggcttttaagggttcagactttaaagcccaattctgataggaaaaacaaacctagctggaaaaagtacaccgagggtccctcaatttgttatcgggatacaaaattgcctccaaccgtaaaaccagatatgcgaggtccttagctacacaaaaccggtcacaataggtccatcggcggttttaattccggttttatcctacgtggctgttgagtcaacgtgggacccacatgagccccacatgtcagcgtggccacgtcagcttcctctctctttcctttcctcatctctctctctttcactcctctcttctcttttttgggcaatctggccggcggctggggcgggcttgccttgtcgacggtctcgtagtcggagaactggaggagctcgtcgacggcccagccctgtggcaggaactgcgcggcgagggcgcctgctgcatcctgcatgtcgacggcagcggtctgtgccggctgctgctgatgatgatgtggtggtgacgctcggaggacccatgggcggggcgtggtggtcggagtcatgggcgtcgctgccgccgtcgcagggcgaggcggaggcgaagccgacgcggcagaagagcgctagtgcttcctgcggcggctgctccggctaccggctagctagcaagcaaacaaatagtagtatatgtgaggctagctagcttgtcattctgtgcatgcatgagccatgcgaatatacgaatgtacatgccgtatatatactctagctagagaatcaagggctagcatttgctaattggccggtggagcaattacgtacgtacatgcatgcgccatgcatgcttatcgtattgagggtgaagtaattatcgtattttacgcgccgccggccggataaactcagtcgatcaaagtaaagattttgatttgatcaagttaaggccgcgacctcggcgacctcggcgttgctcatcttcgacggcgctgtcctcttccttaagatggtgctgagagatctgcctcacgctcatcatcgagccactcggtagaagaatgctactccctccgtttcaaaatgtttgacaccgttgactttttagtacgtgtttaaccattcgtcttatccaaaaaatttaagtaattatttattcttttcatatcatttgattcattgttaaatatactttcatgtacacatatagttttacatatttcacaaatttttttaataagacgaacggtcaaacatgtgctaaaaagtcaacggtgtcaaacattttgaaacggagggagtactaccctgccgaagcacgctcgccgagggtcgtcggaacaaggccctgaacgccgccaagattgcctgcatccatgaacgacgtcgagatacaggatgtcctcgcttcgccggtcgatggcctctcagacagtgcccctcctcctcctcatcctcatgctcgaggcggcggcgacaggggtgcgtcagcggcggtgcagtgcgggcaggtgacgcagctgatggcgccgtgcatgccatacctcgccagcacccccgggatgacgccctacggcatctgccgcaacagcctcgtgcgtgctcaaccggatggccccgacccccgccaaccgcgttgccgtccgcaactgcgtcaaggacgctgccacagagagaagagtgagagagagaaaaggcagagaagaggggaaagaaagaggaggctgacatgtggggcccacgtaggtcccacgctgactcagcagtcacgtagaacaaaaccgggatcaaaaccgccgagagacctactgtgaccggttttgtatagttaagggatctcgcatatctgattttgtggttggaggacgattttgtatcccgatgacaagttgagggaccttcagtgtactttttccaacctagctcgagagtactacggggctgttcagattgatgccatttttaaccataccattttttggcatggttgctaaaaatgtctctacgtttagtttgttgtcaaattttggtaaatacataagaaatcctaccaaaattttggtaatattgtcaacttgccaaaatttggtaagatttattttggctacaatctgaataggccatacattataggaaaacagtccatgacttcctcaaatatcagtcgaatctaattcatatccatcaaccctctcaattattaaaaccatacaaaacgtccccatcgattgttttgagggcaatctttactggtatggtgttcatgtaacaatccagtcatcaaagcaattaaaaatagatataggcccacatgtaagtaacaaggggggaaaataaaaaaccatggggcctacatgtcaatcccactcttattgtcgttctttcttctttctttcgcacatgggcgcaacaatccagcggtgcaggcccgcttatcgttgtccccctgcactgaagagtcgaggaggcgagcagcgaggatggtggaggaagacgaaaaggccaccaccgccacttgggttgtgtaccatcaaagcccactctccctacagtggtagacctcgagtcgctttgccctggctccttctccgagtgtctcggcgagcagcgaagatgcggtcgacgagctaggccacatcgacaccatttcccttgatcccatctccctccgctcccgcgcatgcaagggagaaggcacgtgctaaagtcattgtgctgcacgagaacgacatcgtcagggaagaagaagggatgcatcggcggagctagcagcggccatggagtatggcatcggggaggccaacatcatcggtaaagcttgtagaaggcagagatggaggggatacgacatagggtggcatggcagagccggcggtggcgctctctcctccttctcctcctcaccgccagctctctcctcctcaaccgctccgccttgaggccgcatcgtcgcttgtcggggcatgctagcacctagatcttggcccaccaaaaccgtctacctgtgtcccctcggcccttgctcgagctcattgccgccatcgccgtgtgcccgtgtggggaaaaggagaggacagatcggggagatattcttttaaaataattaataaatctatctaagttataatagttaatacttactcatatttttccgtggcaaaataacctgaatttgttcagccgagcctaacataccctaaactgtatgtgccaatggtttaatcataaaagacgtgatacaagtatgttgggaataacggattgcgtgtcctatgatactgtaacactacaataccttatagcaaatcaagtcaataaaaaattgctcatcaaggattgatatcaatggtcttgatgggcctattcgattggcattttctgcagctagctgcagccgtacaatataaaacgtctcagctacagcgttgccgtaataatggtagctgaacaggcccaataaaaataagtttactgctgggctagaaaagaatggttgaaggagcatttacctccactctttggattttagttcctaggccgatcagggtaagcttctaggcctcttctgttgttgcttgtttgcttctctttgctcctggtgggatcgttctagcaaccagatcggttgcaaggttgcctgctcattgtatcttcgacggtgttttttttttcaatgctaaatgattctctaccggtcaaggccatgtaaggccctgtctggaaacgtgccgatgcttgttctgttgcggcttgccatggttgctcttgccacctttgtcatcaacatagatgaagcaattgcgtaagacaaatcaagaaggtcttgattgtgttttttagattttcttttgtcctgccttgaaaaatctaggacctttatataatttattctatcccaaatgattgtctgatactggttgtcgtagtattttaaaaataaagtcagcaggtgcaaaaaaaaaattaacggttttactataaatatatcgacggatttcttacttcaaatcacacggttttttttctttgacctaccacatcaaaacataagttttcttgtctgttgaccatagtaaccgactagtgttaatgtaggctgacaaaatcttctagcaaatgcctttgtgggatgagcatatgaattccaattgctagaacttgcacttcaccagtggaacaagtgaataatttaatttagttgcatagccaaaattacacaataattacagagtaactccaatgtaattatggtgtagatacactgtactatgtactatggttgtaattatggtgtagatacactgtactatggtagtttcagtgtaattatattacagttatattgtaataagttgtgataaaaaaagtttgactatgagtctgtttataattttttttagcccgtgcgagcaccgttggttggtccagttaggttgaagcccatcaagtagttactgtagctgttattgatgtgcgtcggatcttgatctaagggttgaaaattctgtgtaatatcgactctgaaatctgtggaatgcaagctagttagtctccaaaaataatatttccttccctacccaaaaaatatagttatatctagagcttattcggattacaagatagacaaaacatattactacgatagaaatagaaaagaaatccaattgtaaaacataagaatgaaaaacaaaggaatataaaagctgagagcattcggattataggatatgaattaaaaaaaagagcttgaggtggttggatttttctcgtacttttcatgtgaaattagcattaaatgaaattttcctttggattttctacgatctgtttccacatccgaacagcaagaaaggaatttttttttaaaaaaagctctcatacacagtatcctctaaaaatcttgttggaatcctccaattcgaagaatataataatttcttcatctaagctcatctcaaccaatcacaaccatcgttgattttattttcttcagctacttattcatccaatcacaaatatcaattatttaattttatctcttacaatgttggtcacaaacattaggaattttctttaagattgaaagagacataggaaacacgtatagttatgtgctccctccgtctctaaatataagagatttttgataggatgtctattcagatttattttaatatgtcacattgcatgaaaatgatttagggagggagggaccgagggagtactccggtcaagcgatcacgccatcacggttggtcggatgaccggagtgcttgtgtagtactgtagtaggagaacaggcacaaggcatgaacacacgcatgaggacgaggccgaaaaagggtcaaaaacatcgcgttatccttccctcctctcgcctcggtggtgtgcgtcttccccacccacccccagtctccaatggccacctcccacctcctcgccgccgcctcctccaccgccgcctcctccgccaccttccgccctcccctcctcagcctccgctccccgccgccctcttctctccgcctcaaccgtactgcctccccctcagttccctctctctctctctagcttcttgttcttgcagctagccccgctgtgtgtggctgatgcgtctgagctcctccattcgcaggcaggcgccacttccaggtggtccgcgcggccgagaccgacaaagagagtaagctcgggcgtctccctgtttgttcgattgatttctatggcgttttcgggttttcctaatgtgcggtttgggttggctgcgcagcgaaggccaatgcgcccgagaaagctcccgcgggaggctccagcttcaaccagctgctcggcatcaagggcgccaagcaagagaacgtgagtctcccatcccgctcccttgcgctacgttctaatctggttgcagaatgcatatagagcactgggcactggggttttagcagcatatagagcgctgcatatatgcatgggcattgagcatgtcctacactgggttcttggtgtgtgctgtagcgggattgccgatgcgctacccagtggcgtcctcctcgaaaatttcctgtttttggatgccatacatggccctttctctacctttttgggagagcattggagcatttttcacaaatgttatatgcagctgcggcttatgatgccacgccggcgcacgccctaccttaccgcgttgttgttgtttgggtcattttagttatgtgtatactagctaggtgccttgaccaagttatggacattcatgccgttcgttcttcaatagattgatgattagtgatacgctttgctctatgcatctttcttgtttgtagtagttcgcagtttttgttaaggcaatagacgattctccagattgtgacaagtttagtactaatggctcatgttgtggaaggcttggaatgtcgatacataatcattcaaaatagaaaataggatttcaatttgaagcattccttagtttgcaagcttttcccccaaaaccatgttttaagcactctacttcacatttctagaagctgataagatatgcatctttttctctttttgcaatcaatatgttcatgtatggaaacaactaatgctatattgctaatcaattaactctttcacatggtgcatataggacatatggaagattcgccttcaacttactaagccagtgacatggcctccgcttgtatggggagtgctttgtggagcagctgcctctggtatgcctatggtacctttcgttgattttatctgtttggagagtttattcttctacttcctaataatcatttgagcacctgtagaattggtaaactactttttttactttataatcatgtgtgcctgtcactacattgcaagcattcataagacctaatcaacggtttaaaagtgtgcatcgtccctaaatgatgaatttactgaaccctagtaattttactgtgttgccaatttgcataatttacaagatctgtaggtctgcaacttattttgtgatgaagttacttcctgattatcgctgtattagagtggaatcagccaaaagattgaatatatgtgggctaggctctatgcgagataagtccagccaaaagagttctttagggtggcaatggcatactattagctcattgctgacagtacctgtacttatgaacagtgttcctcctggtgtacaaccataaatttattatttgcttatagtttattctaacctcttgtattcaggaaatttccactggacagttgaagatgttgcaaaatctattgtctgcatgataatgtctggtccatgtcttacaggatacacacaggtttgctgttaggacttggatatgttttatacttttatcgactctcttcataacttcatattatgctgcatggagaactttttgcactgctgctaacaaatatgtcagctttcaaatgttcctgactgtagacaattaacgactggtatgatcgagatatagatgcgataaatgaaccttaccgtcctattccttcaggcgctatatcagaaaatgaggtatgccaatggagctttttcctttcttttctgtgctcatatttattcacagttttgtttagtttcatcagctaatgacaaatgactactctgctgatttatgtgccatcagctatcactttaacattggggaagcacctttagcaatgggtttctgacaaaatactccctccatttttctttataagactaaccaacatcatacagaaaaatagagggggtataccaatataccataagtcgtaaaattgaaaaggttatatatatatatatcatgtaataaactaataatcttattacaagccatatatatttattgatcaactatctacacaatacctcatcgattaaagaagtggtggtgggatggcagacttactgccaccacgactactagttttttttatatatatacactagagattgcgaagtttcgatgcaatccctaatgatgttgccaggtgcaactgtctcaacaatcattgtgtcatgcaaaatgtatctcatgtatttactgacggcaacgatttcatccaggtcattactcaaatttgggcactgttgttagcagggcttggcctgggtgctctgttagatgtatgggtaagtctccagctaactgatcttgaatattagcaggttgaaaaagaaaacgctcttctttgttttcttaattttttttgctacattttgcaggcaggacatgattttcctattattttttatcttgctgttggtgggtccttgctttcttacatatattcagctccacctctgaaggtatttgatacatctgttctgaatcacacaatcccccttgtttttagtacagtacatcataattagtcaacagcttttgattgaaaaaattgaaaaaaaaacacccttgcacatttcagctcaagcagaatggatggattggaaactttgctcttggtgcgagctacattggcttgccctggtaaattaacagtgcggatcttcttccatattgagtaaaaatctatgatattatatgcaagaaattagatgtatatcctatctgtatgtattcttcgcaggtgggctggccaggcattatttggaacccttactcctgatattgttgtcctgacttctttgtatagcatagctggggtatatcttcatacgattacttttcttgtaacagtgtatgcttttcatgatcattgaccgtctttcgtgattttctagctagggattgctattgtaaatgactttaagagtgttgagggagatagagctctggggcttcaggttcttcttctgtctgtagtgtagagttatcacagcccttttctgtagttccaaagaaaagcaatcatccatatcacttaccttttttcagtcactcccggttgcttttggtatggaaactgcaaagtggatatgtgtaggagcgattgacataactcaattatccgttgcaggtaaagacatgcattttcattatgttgcttttgtttcaaacattatcttcaaggctgtatcttggtttcattgattatgtggtccatgttgtcaacttgtcatgctgctatttagcatgccataatgttatgaatttattttattataaggggagggctaaacattaaaggagctaccatgtttgctcagaggcctaaaaattaccatgttattcagagaaaaagagaaatatttgcacggttcgatcatggtgggtctatactctatactgtaacaataaagattgattgctatagatggatgcaaattataattgtatttatagaactagatgcagagttttaagtaagacaatgtaggtctgcacaaccatgcggaaatttgatctggttactatttaaaaatattgtcgtttaaatttccagtgtaatgacgaaagttttaaagaaactataaaagggcagttgctgtgaaacaagaaatgtttcctaaatgttcagaattagctttagaaatgtttcccgtcatcccatgtcagcaaactgtccagcagataaatgttgctatgtcatctttgtgaatttccgtagcaaactgattattctgaggattgctatgttttcgagtggcgaccctagtactttcgaagcaccataaaatattgcattattctgacaaaatgaattccatttttcaggctaccttttcagttccggcaagccttattatgccctggcactgctaggactcacaattcctcaggtggtctttcaggtgagctggtcgttccaattagttctcccaaatggtttcctttatttctctggtctgatcccactcagtacaaaacatttcaaactgctgtgaatattaacatttctccctgtaatgctagtgagtgaaccttttaggttagccatctgcagttcagacaatatcacaatagtatggaattagtgccaccaaactatgtatggcaaaaacatttcttcttacagtccttatgacttaaaaaacaaacaacactgcaaactaaactctggctgccaggaaattcagtcgctctctgctttctactcactctatttcatattataaggcgctctaacttttcctaagcttatagaaaaatatagcaatatttcaacacaaaataaacgtattatcaaaatttatttaatattagatttagtgaaactaatttagtgttatagatatttgtatattttcctatatacttagtcaaacattaaaaaaattaacttagaaaaaattcataacttaggaaaaagtcaaagtatggttgtaatatgaaatggagggagtagcttctaatcctcctcattttccttggagcagttccaatacttcctcaaggaccctgtgaagtatgacgtcaaataccaggtgcgcttctgttagcttcttcaattcattcatctcttccttccccattctgaaactgccaagcagtagaaactggagacaaccaacgcacagtcatctgatcagtgcaatcttacatttgccaaatgcaggcaagcgcgcaaccgttcttcgtcttgggccttctggtgaccgcccttgcaaccagccactgatgaaagcagcaatcgccctggactgtgattctgtgacagcgaagttttgggtggaagatgcagattgatggttctctgcaactgttggtggagctaggttcagcagctatgttcgcgagtgtattagcgctcttttggcggtgctgggtagtagaatgtagaatcgtttcttgttgattccctgaactgatccagatcaaacatcttctaaaggttctgcgatgcaatgctagctgcagacgggagatggtacagggggtcgttttgctactttgccgccgatgttgtagggtgtgtagacagactgtagatgaataatgtcagtaacacctgtggggggttcagtgctagtgggctgcaaaacttgagcactgcttcgatcaaattgtgtctttgattatgaaattatggaatccagcacaggcaggtaataatttcgtaatagagcataaacaatttgtgaccttaggtgcgaagaacataaagctgaccaaggtgaagtaatattgatgcattgtgcgctgcatttaatttggttgttgaattcagagtacgtatttaaataggtgtccggaggggaaaatgtacacaaatgtttactccgtttgctgtgcatctcgcagtgatacaaaaaaatacaaatcaaaccacgctaaaaaatttagtcagttgctcgtcttcagaattcagtcctcaaatatttttaatgtttcctccatggctgctcgtccgttcattttgcactcgttttgctctctgtgaactggagagccccagaggttctctttttgcatgtaatctgagtttctgatcaaccattcagcctggctaagaaaaccatatggtggtggcgttcttctaacttgtgtctgcgcggctgttggcttcatccaattcatcgatcgccagttactacttacttactaacagcgtccgggaacaggagttgagccaaagaggcaggtttatcttccattaagcttaagagaactcggagatatctcgaagttcttggcacggcacgtcctgttttcactttcaaacttgagcattcagtttagacgaggtacttgattttttttttgtgtgcacgccccagcaggtgttttaagaaaaaaattaggcaacttaaaattgttgtcccttctcctgtgttttgcgctaataattccatcctgcacatggcatctctgaggaatcaaagatcaactagcaacagcaacaattagccgcgatagatcagacatagacactggcactttcggatgaacaacagctagctagattaactgaaagcaagcacggttacaaaggacacacccagcagaggcatcagttggaaacaagaagctagcagctgctggccatgaaaagccaaagcatcacctagctagcattcagcccctgcctgaccgatcctgcaataaactaaaacacataccctagctactgaccatgatcgatcagcacctaaaccaaactaccaaagctagctaaagctaagcacgcatcaccatatgaaacataacatagcaaatcatacgggcgcctaaatgcgtgcatccgtcaagacctacattattattgataagagagctagctagctaagactgactcgatgactacaactgagacgactacgacacactggcattcacggatgcaaaagtgtgtgtagtctaggacttggtcttgtacttggactcgtcgatgtcgatgccctcgcgggcggcgcgctcgccgccggactcgtcgccggtgctgaggccgcccttgcgccccatctcgcggtacccttcctcccccatctgctccttcctcgtctgccccccgcggctgcgccctgatcgatcgatgcacacgtacgcatattagttacgtacttcaaccgaaataccgaatgaaatggcaagtttgatctatcaaaagtttcagtattattttgcataccctcggcgaggttctcctgggcctcgaggctcttgccgccggtgccgccggggacgacggtctggccctccctggccatgcggtccagctccgacctgccctgctgctgctgcccggacgccattgccaaacactagttagctagcctgacgtacgctgcgaactgatcgatgaacaaatcggaagggtggcttgtgtttgtgtgtgtatgtcttctgcggcttgagctgatggggatggacgacgcggccgcgctgtccttcttataggcggcgacggacggggcggtgctccgcggcgggatcagggcgccggcaacgtacgtgtcgcgcggcgacgcggacggctcggtgcgcgcgcgcgcctccgcgacacgcgtcgtggcgaggccgccggagcgcgacacgtacgtgcgcaagctatgcctccgcccgtgcgcggcgcgctctggttcgctgcatgcgcgtgcgcgcgcgtgcctatgcatacgcatatactactccgtatgtccgtgctagcgcgactgcgcgagcgcgagcgagcgagcggcggggtggctgcactgtcgacacgtcgatcgggatgtcgatcaccgtgcatgcatgtggacatgtggtaggctcgcacgcaccacctggtcggggggaagcccatgcgtagaccgatcgtggaccggcgaccagatgtttccggctcgctctctcagctactgtgtgcaactgcatgtgtattgacgcagtactactctcatgccctttctcagatggttttcatgtatgggtaaaattgcttggaccgacaactcggtgacactgtagagtgacaattaatatgaacgttgcatacgtctgtcgtctctttatggataactaaatatttttatgcatgaaggattattcatttatcatttatggcttctttaattgatttgtttcgtgcttcagattagtggtggcgttaggatttcttctagcctagagctcaaattgaagattaaaattgcccatgaccacacatagaccaagtacagtaaaaatgtcaaaaaaaaagcaaaaatgagggctaaaattaccatgacaattcatacacggaacggaagtacagtaaaaattaaaaagaactgaattaacatttcattggaatacccccatgatcttcactctccatcaacagcactacagtatggagagaggctgaacttgaatctgaaaaatgatattactgcaaattatgagaacttaactatttacaaggaatatatgacatacctcgatgatcttcatttctcaaagcacgattatgataatgttctgtaatatcttcgacactagcaaaattatctcgctcttcaaacaacaaaaacatctcatgttttgcttagaaaggaagcaattaaaacagaaaattgcatccttagcaaccaattgtgctttttaaaacataacttccgaaagctcccattcacccctatatttgttctgctcctctttatctaggaaatcaaaccaaatttctcactaactgcttgtctacaaccaaatacaaaatgagaatgtacatcaaagattagagactagactaacctggatttgggggatcaaaacgagaatgcagatccaagttgttgccgctatcgatgcgcgccccagccgatgttgcgagatgagaggagcagtgaacatgcaccgatgcatgatgcaacgttggagtcatgagtgcagcgtgaggagtgaggacggtagactggtggagattatagtttagggttgtctattgggaagtgaggagtgaggacactgaattagggttggtcacttgggttgtctattgggctgtgatccgtctattaggctaggaacctggccacttgaggttgggaaaggatgtgcgtggggctgggctagaggagtagggttgggccaagcgatgttgagaaagtctgaaaatatgataatttcttccacgagtagggctcgggcccaagctgctaaagccacggttctacccctgcttcagatgtgttatgctattatcaccgaggagcacatgcggaagcctttgtaaaatgtgccgatgcttttaccgtgttctctattgtacaaccataaaaacaatatgagttgttggtttataagacatattactactttactagctatgtgatccgggataattttcacatttggattttccccttccattacttaggtcccttggtcgaagggcgcctccttccaccacatcccgctttcgccgtcgcaaaatccctcctatcaccggcgctctactctgatggcctgcaaacggttttcaccactacatgctgctgccattctttcaacatcgcctcctccaattgttactgtctgaatcattggatatattgaccgtattactgtaatctttgtgcgctagagctccgcaagtgtccgatttcaagcggcgacacccacttaggtggacgcgcggaggatgactttagtccccatgcttcagtgttgttccctgtcgcctccttagttcatccccaatactagtcccgaaagacgtctaatgtgaaggaactggagggcggcatcgactccgtatgcaagacttgcacgaaccatcatcgcccacattgtttcttccagcagtctctagtaccgttcatcctcgttgtccttgcgagagctgtccctagccgtccctagtcccgtgcaggttgtgtgactctacagggccctaaatcatatattaagtaccctacatatataatgccatattggttttcgtttcttttttttttcaagttcagttgagtttttttattcacaattggcctaatctctctccagttctccttgtttcctaatccgtgggttctcctacctagctcactagttgcttcccctagggtcacttcgcattgctccattagtattgcaacacgggaggaatgcaatgacagcagcaacactgagcgctcgtggttgctgtcagcctgtcactgctcttagttttcttggagcctataggctgctggcgacgcatatacaatcaaaagcaagttgctgctgtagcggccatagaggcaggtgggtgattggcagttgcagcgacaaagcttcagtattctggtatatactccaagtccaacccttatattccgcttttccttttcattttttttgtatgtacggatcagctgatttagtgttttattgttaacttacaagccaacttaagtttaaagttttgcatggggccacggaattttcggggatggtcctggtccccttgacaccgtttgtccccgtcatcatcaccgcaggtcatcgccgttgttgatccctgcttcgatgatgctctattgcattgccactgactttacgcggggtgcagctgctagcactttcctctggcatgccaaaggccatgtctcgccggctgtgttctattctaacatggagagatgtgctcaaggatggatctagatctagggcagctagggctcaagccataggtctttaaaagttctagactccatataaatttctaaaatctgtatgaatttgtaggaaattatgacaaagtaatggaaatgagtcctagggggtggctcctggctggctctgtaactgattgttctccactgtccctgaagttcatgttaaaattgtgcctttatattccaccggctctacatgtgaaaagtagtagtggtagtatagatgcgcatatcattttgttaatcatagatcacttatgcttgtatggaaagtttgataatggactaatagaaatttagcatgtccaggtcatgttctgttatacaaaagtacgtaaatgtaaatcactcttactactagaatcaatatcgagccttcaattgtttctctatctatttgagtgtcatgattattcttagttagttaattttctcactctccccaaaatgtgacgaattagaaactgggagtgtaacaatcaaactagaaaaaaaaaagtagttgcaagcgggccaaaaccgttttcccaggcagacgagccttccgcctacgagcaaatgcctctggtaaattggtagtagagccaatactgacaaatgcttgtgcctataagggcagacctaaattaccagagggggctcccaagaactcggttaagaattttttttagctataattagtttagtttcaccatatgtgcacccctcaattcaaactcaagcacccatatcagcttatacttgatcaaaaacaaagtaaagcaagcgagtggtacccctctccattttattctagctccaccctgccttgtggtgtgggtaaaactatatggtgatttggtacgttttaacctaatagcttggggtagaaacaattgttgtatttttttagactagaaacaggcctatatgttgtaacgggtcatacatacataaaattagggatgggctagaagggtgattgaggttaaagcaatgggttcggtagttatgcatgcgaggagtgtaaggagtaaggacgctctgactacggtgggaggaggagatgtaaggagaatggttccacttttacagtctcaaatttcaattagcggaagtgcaatagtttggacaaccagttgtacaaactgctccatgcctagagcctaccgagaaagttattacgtaaacatgtgagtttatagcattagtgttagactgttagtgacattagtgctagtgagaactaatggttttgtttagttcaaacatggccttttttttgtgttatttctgatttactttgtaatatctttgggtgtagtccgacaacatgaattctagttacattggcctaaaggtttgggaggagtataaaatcgaaagtaccttgatgccacctataggggggtgaataggcgttcctaaaaattatcacaacttcatagcatattagaatgatgagagctttcggttcaaatcgaaacttcgggtatgggattggaagttccgatctcaaccgaaaagttcggtggataacggaataaaacattagctatgaacttgtagctcgaacaaacaaaatgtatatgaatcaaaaggtgacaaataaggtatctatgcaatatataaggtcactaactatattaattaagcatgcaagtagatcgagtaaaaacaagctcaagcacaatatgggagatgacaagaacgagcaaaccaagagagaagacatgttgatttgtttcccgaagtttggatccatggatcctacgtctccgttgaggggccacaaggccgggtctatttcaacgctttcctcacgaggttgcacaaatgcactcattggtttcactgttgatttcttcccttgcggaggcgaaatcgaagccttcacaaactttccgtggcacacgacaaccttggatgctcaccggcgacgcctagccgtctaggagatcttagtccccaagagtaacaaacaccatcgaagatttgcttgctatgaactcgagtgctcaaagtatagagtgaatctcactagctctcaactcctcactctctcaatccaactctcttcccttctcaaatcccactcacaaagaggcactacaaaggatggaatgaagctcactagctctcaacttctcaatctctcaatacaactctctccccttctcaaatccctctcacaaagaggcatcacaaaggtagggaaatgaggatgcctatttggctttggatgcgtctaatgttgcccaagaacagcagcccctcaaaggagggctggaggagtttatatactcgagcctctcaaaaactagccgttggaggccaagactgcgatttttggaaattccgaaatgaattttcggataagtctgaaaatttacagaagcgaatctcagtttcgcagccatttttagaatttccaaaaattttcggagttttccgataatttttcggaatttccaaaaagcacagagtaaaacgactataacttttcgctcgggagtcccttttttttgatgatgttgaactctatggaaagctcactcagaggactaccaactcaaccaaaaataaggtctaaaaccactcaaaggataagttaaagcttgggtttctctcaaggtagcactatgatacacaaacatctcgacgttgcatccctcctaatagtacggcgttcctaaactcaaatgtaaataggaagagaattataccaataggaatgccttctttccatctttctttcattgtctaaagggacatcaatgccgaaaaaccgtttcaccatatattcttcaaatgattgatgcggttacttgtagcttcaaatggcctcacacggtctatcatgacaaagctgtcactcgtccttcaccaccggatttggttcttcggcgccaagcaccttgattgcccttcaccgccgcatggtccatcgtgaccgagcttcgcttgcccttcaccgtcttgccatagtagccacttcgtatcccacatcttcaatatcttcactttgtcattcttggtatcgttaggtgtaattatatcacttgagcatcaacacctttgcaatccttgggacctatttctttcattcaacccaataaaattattagtcccaatgatccagttgtcaacctccacaagttgaccaaccgatcgcatgtataaaagaatatgaataaatgatgagtattaatcaataccacaagtgccatatactcaaacatacactcaaatgtaaagatcccaattaaatgaaagtgaataacttggatcaattacatgcataactaaagtataggatttgctccccctaactgtatgaaaaaaaatgtttgtgtgaagcaagagtatgcataaaagaatgaaacattaggagcttaccctatacaaggatagatggcatttatcaaatataaacattaaaataaatgtataccttcatcatctttaggttctcaatgtaaagagataaacaagagaaaagactcaaacaaaacattagtctcacatgtatattgttattcacatggaaatattatatatgaacatatcaatatgtacatggagagaaacagtgatacatatagcttgatctccatgcatttcatccttgtgatttaggtctatcatcaatgaatgtttctatctcaactcataagaagtccggtaatcacctctcacacactccactttcatgtccacatgagactaggcaaagaaatgcttataaaaatattagtttcacataattggatttatcattaatcaccaaaaccaaattaatggcacttgaactttcaaaaatgatgggtaatgtggtttttataagcgaggacaaagactactaattctatattgagtatgctaagggtaagggttttattgtgagcccaaaagcaggtgtgcacgcagaaatgctaggtaagatacattgttctctcaacccttaatatccatcgttatagaccagaagtagatcggattaagtagagcaagacctttaaaaactaggtgaagtggaaggattgtatggtcatatggagtcagtttgtatgctcaacttaaggctatatggatttgaaacactttgaaaagacaaaccagaaaagagatccgcaggccctcactcgttgtggttgcaaagctaagcttgacatagagctcaatgaggagagaggagtgtgttgtgttaaggagtttaaaaaccaacatacacgtgaacttgcaaatctctattaagtgacaggtttaataccagagatatgctggatagaagacattgtgcgaaggatgatgatgatctaacatgtcttgtgtaatggtgggcacagggaaactagacttcatcttttctttacttgcccttttagtgtcagatgttggcaacacctgagaattgtttggaacctggaaatttgggagatagtaatatgcaaaagcaattgctctattcgtctcatttttcatcgaagattcttgcatcaatgttgattccattaatttgcaaagctttcctacttgatgattctacaatttgtccccgatagaaataaacatatctaaaatctatggctaaacgaatttgcagtgatttgatctgaagtagactagatttgagacaaaggtaggacgacagacatggcacaagtggaatagcaccttgttggcaaagagcagcgacgctcaaaggcgtgctagctgaagatggatgtgatcgacagacacacgatgacttgcacgtagcccagccaatgcatgtgtggaacagttgagctaactagagttttcagtaaatgaaataaacctggtaaaataatacctagtttaaaactagtaaaatacaacagttaacttactcagtggagattatgggtaccccatacccacacggcatggttatccgaccggtgtagggggtaacttatatctatgaaatatgtaacggatcatgacttgggtattacgtttccttgtatattacggaacggtctaaagtcctggtttggtaatattgtaaaatagatttaggaaaccaataccgtattggttaaggtttctatcttgtaatccttcccaccatcctatataaggtgggtaggaggccttctagggggcatgacataactagatcgtcagatctataatacacccggcggattcaaatccccaaacaggattagggtattacctctcatcgagagggcctgaacctgtctaaatccctgtcttcgcatccatccacttttaggtctcgtgcgctacccccttttattattgccgaaatcatgtttcgatagttagcgcgccaggtaggggtgcgtcgagtttcctatcaagaagtgcggtggaaccaatctccgacgtcgccggattcatattcaccccaagcctctcactttgggagtttcgatttcttcgtccaccagtttggaattttccgcttcttcaattcagatgcaaatcagtcgggaaggctcaagacctctttcatctcgtttgatcgccgtcatgtttactggttttattgaagaaagttgacatgttgtgttcatcatctggttcaatctgcttggcgataccatgcaacggatcaattctcaactgccagcgttttttatagacgatgtcaaatttcctagcgatactcaattaccaatccaaatcggaatcagcctgcacttggagccaaccgatcagagcagtcgtcgccgagttatttccctgatcagcaatactcgaagacaatggctatcatgagtctccacgaccaatcatgcaagtgtatgtttccatctgaatctgatacatgtgcaaacgagcgtgcatggcaatttggtcaatcaaccaggagctgtcatgtcatcaacaatttcgaccagggggcctccacttcatcagcaccgtggacgtcgccgccagtcgccttattcaacaacaatcacacatgcataactctccgagcgctggtcacggccactggacctttgcaatttttgtttgccacgatgatctgcacctaccacggcctcgacgcgcacacacaggcggagattttgccctcttgggtagtttcatctcttctgtccagatcaattgcgccaaacccgacgccatgcaattttttgaggaacaatgcaatacatcaagccatgtatagtatgttcatctatatattcggcacggctgcctattcatgttggctgtcatccaggacacctcgctgggatctgccttcaccgatggccgtggttgctttcgctaccgccgcctagtgtcttcgtatccacagttggatggtcacaccaccattgctgggcatctacgtcttcaccgaccggctggcgttcgccgtcgcagactggtgtttccgcctgcacggttggcctattatgccgccgttgttgggcatctacgacttcaccaccggcatgcctccgtcgccgccaactggtgtcctcacctatacagttagttggtcacaccaccgttcatggacgtccacgtcttcaccgactggctggccttcgccaccgctgactggtgtttccgcctgcatggctggtatattatgccgccgttgttgggcgtctacgacttcaccgtcagcctgcttccgtcgccgccgactggtgctcacgcctatacggttggttggtcacaccgccgttgatgagcatctactttttcaccatcgacttgcctttgtcaccgctgactggtgtctcgcctatacggttggttggtcacaccaccgtcgatgggcttcatcatctacaccaccagcttggttccactggtgccgactggtgttttcgtcagcaaggggactaccaaaagctaagtcatcattaattttcttttttatatgatatttttccttttcctctgcctcattgcatcaactagttctccgttgactagtgagtcgggggctacagatgttatatcatatttttttcaataattttcataatatttatcttgattgcttgcgatataatctgagtacaaaagttctatcttcctatgctttccgtttggtttgtcgatggatagttgcctttgggccgattcctagcaccgggggctcgttggatggaccgagtaacgcaaggtgctaagtattattcggaataaatcaaaagtatagagataagataaatttttttctgctcttaacaattgcgaaagtacctgagtagtaaattttgattcgtgaaactttgttccattaatgacgaacgcatgtcactcctatgcatgtttaggaagtgcctaggccgactcccggtgcttgggggctatgactagtcgggcagagtgtttaaacgtaaggagtcatctgcttggggaaatcaaaattaacaagaggagaaatacatatttataaacattttgaaatcttgaattttcctcaagtactatatttacatcagatactactcattctatacgtttgttctgcaggatccagatccagatatgcataatagggattcatggctttaagcttatctcctatgcttcaggaatagatcaatcagaacatcaccattggcttgttgtcgccgccgccgactggtgtccttgcctacacggttggttggtcacaccaccattgttgggcgtctactccttcacccaccggttcgtctagtccgccgctgactggtgtttctgcctacacggttggttggtcacaccacagttgttgggcgtctacgtcttcactgatcggcttgcctttgccggcgccgactggtgtctccgcctgcatggctagcctattatgccaccgttgttgggcatctatgtcttcaccaccggcttgccctcggcgccgccgactggtgtctccgcctgcatggctggcctattatgccgctgttgtcgggcatctacgtcttcaccaccggttcgtctagtccgccgccgactggtgtcttcacctatacggttggttggttacaacactgttgttgggcgtctatgtcttcaccattggcttgccttcgccgccaccgactggtgtatccgtctgcacggctggcctattatgctgccgttgttggacgtctgtatcttcatcgaccggccgcctcgtatgatgccaacttgtgctatcgtcttcacggccacgacgccaccgccaccgccgctaataggcgtcatcatcttcaacgcaagctgtctgttgactagggccctcgcctctacggctggtttataccactatactactgatggacgtcatcgtcttcattgctggccaccttgtctgacgccgactggattattcgccttcacgattgcgtgtcttcatcatcattgaccggcgtcatcgtcattgctggtttgccttcgccgccactcgtggtgtcttcactttcacggctggcctattatgccgccgctcaaggacgttttcgttttcttcatcactctacttcttccgtcgccgactggttatgccaccgtcggctggtgtttttatcttcacaatcacgcgtctttgctaccggtttgcttatgatgccgccgactcgtgttcacttcatcatggctatgcaactttgtcattatggtggagctacttcatcttcattgtcttcggcaccagcaaactctattgccggtacttcgcaagttttgctactttaccagccacgacgtctccaagagcctcgacatctcggtatgcgtcactaaatatgatgccatgttattataacaagtggtgttccagtattcaagatttctacccagacatgctcaacacatatcttcactcaagttatggctattcgacgacaagaagctacagttctcgactctatgttcagctgtttcccaactaaccaaagagtcgggggctacacaaatatacggctcaaatctcgacaagttttatgtccagacgaagcaatcaactaatcagccaatgagttctatggaatctacttcgggagtcatcagtttcgttttcgcttcagagcagacgttctacttcagtaactcttattatttcaccggcaattttggtttctccacgccgctacaatctactccaagttgctcaagtgtcaagtttgagatgtaatctacatgtccgggagtttggggttattaaccaatcagctcagtttcgatgagttgaacaacaatatctattttcctccaaatgaagcatctgcaacagctacaacgccaagttttactgctatcgtcataaatcaggaagcattgtctcaatctcagttatggacatgccaacgtcaaggaaacagctcgagcttcgatatcttctcaatagtttgatggattattgtcactgacatcatcaccagcacatctacttcatcggccctgacgtctccaccgttgctaagaggtgcctacatcttcgccttcggttgcttctggaattaccgactttcaacgccaacttgttttttcaccttcacggttgagctactacgcaaacgctgatgagcgtcttcgtcgttatcatcggctgctacaccattattgactggatcgccgacatcgtcatcttcatcaacatcctgtcaagcctcttcaacatagcctactatgctgctgttgatgggcaacttcgtcatcatagccggctatctctgttgctgctaatcatcattaccgtcggatgcgtttgtcgtcgccgactattttcttcatcttcatgattggtggatttcgccatcaccgttgatgcatgtctatgtcttcatcatcggcttggtttcgtcgccaccgactgctatgtcgttgttgttgggcgccttcatcttcactgctagctgacctgactgctatcgactggtttcttcgcctccacagctatgcgacttcataacctttgattggtgtcactgtttttactaccactgacatcttccgtcacctctgatgagcaatatcatcttcatgttggtcatttcatctccatgccgactgcatcagctaccatcaatggacaattatgactacaacagaaggataagctatatgctcaggggcttacgagctcaagcacaaggattataccttcaagttggattttgttctatatacaggcaacatgcactcgtagttctgagattattttctatgatcgaagactggaccaatcattattccccgtaagggctatcaaccgaataattgcgccagttgggattcaatttttatatatattttggagtatcccataagggataatcactcagatcagaagctattcatatgagctacacttggtctatatcacctggaagatttattactcgggagcatgttacatgcgtcatcctttaaagggtgttgaaggcatattttttggcctaggcctaatatgtctgcagcccatattttcaggtgtggcctgtcatgttcttttagggacttacgcactttttgcttaggctaaagtgcacgtgatcaagtgcctaataccttaaaatccttttataccgtagttacttaactttttaggagttggtacaatgcatcttaaaaggtgtcaaacagtaaagctttatatagctgccccgctgacttttttatataagtcaaggtgctgtttgggtttttaagcaattgattggatacaatatcgttgctttttttcacgtaagtgtgcatttttattgaccaatattatggcttagggtgattatatatcttagtcattttccaggcggttggtaaatcctttatgagtttatttactcggattttaaaccacatatgccgtatatttccaggtgtggtgaaaccatgtgtcttttagggacttaagcacatctgttaaaagcagtgtgcgcatggcgtatgcccaatactttggaaatttctttattcatagcattcaagctttttttatagttgcttttctatgtgaattttcaatgatgtagtcagctttaggttgctcgcatcaatttttacaaagcagtcggtatatcacttggataatgttatttggggattgacaccgcatatgttatatattgatatcaagtcacttggttgattacaattatcaaaaccactcagttggttgtattatctactccttgactatatgtttagattgttcaactaagcacatagtcgggggttacacctattaggtgcatctagtcgatgcacctaagtttacatttaattatttttcagccctccatagtctttagatttgctaaaagtactcgggagaccatggcaaagatgatcgaagcactcggctttggagtaatctggttcgagagaagattatcttttcgactgtgaaggtctcaggggctactgtagagattatgggtaccccatacccacacggtgtggttatccgatcggtgtagagggtaccttatatctatgaaatatgtaacagatcatgacatgggtattacgtttccttgtatattatggaacggtctaaagtcctggtttggtaatattgtaaaatagatttaggaaaccgataccgtattggttaaggtttctatcttgtaatcctgcccaccatcctatataaggtgggcaggaggccctctagggggcatgacataattagatcgtcagagttataatacgcctggcggattcaaatccccaaaaaggagtagggtattacctctcatcgagagggcctgaagctgtctaaattcttgtctcctcatccatccacttttaggtctcgtgcgctacacccttttattattgctgaaatcatgtttcgacatactctcttgtttatttttcaatattttgtaagatcatattattaacttctcacttaaatgtgttatcggctcttgtcctttatgagtaatgcaaattcatcttctttgtttcaacgatttgtctagtaattactatatatggccaaatgggttgttcggtccgacacagctgttggtatttcttaacaacattactagaaatataattcccagcaatggcgcagaaatacttccggtatattatggttatagagttcatccgcaagcgcaagcgcacggatataccattgtagcatttcacccgagagtattccaagggtatcatatttattttgtcccgtgggaagatcatgtagagagaactcaactaataatttatatattacttgtgataatcatattctaagcagggattaagataatccaagggtagagtgacacacaaacatttctactcatcctcataataaataatctaagctaggtggaaagaaaagagaaagagaatctattcctatacttctaatatacatagtatacatacattctagttaactgatatactagctaataccctctatccgatgccctcctggtacttcgagaagccacccctgactgccgagttccttacgacagcccgtcatgaccatccaactggggctaaatacggaggaataccctccccagtaaattaacttaggattatatataggcgcggaggaatacccgtactgagctatcaccatcagcggcccacctctcatccgcaatatataaccccaaataatgatatcccgtaatctagacaccacgcctaaactaccagatactactctaatatcatcgtcatgacatagagtaattgcataagcaaacattataccctcaccaaagcatctcccagataagctagcagtatattcagtataataagaacataatgtaaagttggtactcatatactcggaaagtatttcaataccagaaatgtatttagaagagtattctaataaaagtacaaagcttacaaaagaggaaaggaaagctactagagccatacccgaactcttccgaagccttccggactccttattcctattctaattctattccaccatctagatactactaaactaaacttgagaggaatgagagagctcttgcttgaggtgtgtgttgaagtgaagagagtgagcttcttatatagaggtaggtatgacggttgtggaaggggaattgtccaaagtgacctccaaccgtcattgggatgcaatcctggacgttcttgccaaaacctagatccatcgacgcctggattggttcggccgaacctggggctggcccaatccagcccaatttcggctggtggcctcctctattgctccactccgcagacttgtgaattttggcccaatttatcgtgtcaattctaagttcttggcccattcatacataagtctggtcctcgacatcgtctgattgatttatcgttggtgttgatgttaattctccttcactttattgtcattctctgcaaaaaaaggttagtagacctaatactagtggaatattattgttctaacatatttatgcattgcaagcatcactagttctctcctgttttagtaatattgacggccgaaactgatcgataacgaccgtcaacaaacccccccaagcttgaacctttgctcgtcccgagcgaagaacgaaaggaaacaatgacttggttgttaatcaggagctgctactatgctgcatatctcagagatacaggtgcaaggtacatgtactctctctcagattaaataatctttggcacggtggcttacccttacccctgattcccacgagacactgcttctccttgccttgggcggttgaaagatagaacaacaattagagcaccaatcacccaatctttattcaactcttattccggaagttttcaaatgattttggaaaagaaaaccaagttcctcaattgattcactcagtctctctaagtgtatcagcatgatttcctcatcaaatgttgccttgttgattccaactctaaggtttatatgtggagctcggtagggatcaaacatggcatacttgcattcacatttattactgagtcaaaaacttagactaaagcagataactaaacatactcaagatcaagatcatgcataatgtgtgtgtggtatatagtggaaatggtgtatgaggaaaaataaataaaaataaacaaaatgcttcttctttgtgcttactttcttctcccaaaaatctttcttttattgattaggagagggcatgattacatttttttttcaatcatgctcatgcttgatggagcataactttttttttcataaccatgcctttccctcctctcttttttttctttttaggagaagaaagcacatgaaagcatggagaatttattttggtggtaatatggatatggaatggaatattgcttagctcccagtgtaggagtttagcatgtccatatatatgggtgtatgatcttgatcatagagcatgagaagtatctacacaagtcacaagagtttgacaaagttcaatggaatggcaagcaaccaaaatgcatatggtttaatcatgatagcacatttttggctctggtaggaatttatatcaaatgaggaactttcaatttatcattttgaaaaacaaaacatctggaattcaagccaacctagtatcaggatcatagctactcatatttactatctcatatctcgcaacagcttagacttagatcagcaagtgcagcccatttacctcaggttcccggataattgttggctacttatatttaacctttgagagagtacttaccaagaacccatatatcagagatatgcaacagagcaactattcatcatttcaacaaagagaactagcttgtcttacctagcatgactcaaacctatcctatctttttggtattttctattttgcaaatttttatgttgttttcaagttttataagatgcaattggaaagcaaatatgcaactggaaagggaaatatgcaatgtgatacaagttacctcagtggggggagcgaagtctccccccaagcttggctttcgctcagggtccttgattaggattgaacccctgaaagcgaaagtacgcttgaaagtcatcgtgctgttgctgcatcatgctgttgatgctggcgaactgagcatcagcagattgttgtcattcttgcgtctgagctatgtgttccgtgaggttgtactgaatctctcccgtctgcacatcaagggtgtctattctcctagtgatttcacccaagtcccaacgagacgaacttgagcgccattcacttggggatggaggcacaccacttgatctggagggttggtagtccccccagtggatgtcatgaggcgcatgccaccggtcctcactggtgctttcccaggttgagactccgatgctatggcgtggagcttgggtccatccgggtgcatccccagttggtgcccaacctgcctcatacatctgcacgggtgtcgaggatgatgaacttccttattcgttccttgtcatgttgcgcgtctccctgtatgttccacctgcacgagattcttctatggtctgcaggggaatggtcagttcatggcagttgtacaaataataccccgcatttggcaacgggatttcttttgtacaaccggggaaaaagtatatcaaagatccatctactccatgtttcaaaatatgcccttgcactaaataggcctcatcaatatgcagacgagcggctgagataaaagcaatttggtcgctaacgacccctagcccttttgctatccaagtaatcagaaaagtgcactcaacaagagcagagaactttatactttctaaccattgtcttatcatacatttcacaggagaaatttttatctttctaaccatggcaaacatgataattaattcatctcccctaatgggtctcagatcacttctaggaaacaaagtcatagaaatccatttgtgcatgagcctaagtgtaggattatggatatcatttgttctaggtttcttgcaaattggagcaccagaaatatcttcccaaaatctatttttctcgaacccagaaattcctttctagagatcggttttacaggaatcgtgaaaaccaagaagtgtactcaagcctttccatctgagcgtgaactccttacggaaaaagcaaaaagaaataccatcttctatttctttcaaagtgcacagaaattgcaaagtaagcaaatgagaaccaggctcatctaccacagcaaatctctgccaaccaacagctttccaaatataacgaaattcaacatccatacctatctttttcagcagctccggcgagtattctcgcgtgtgagcacactcccgatcgctcagcatgtagtaggcttgtctctcccgatcactgtcatggtcgaggtcagcgtcgctcaagagttgtcgcggagcgtcggtgtcttccatcgagacatcagctgatgaacgagtactagattcgtcatgacgacttgatggatagcctgatcccttgaacagacgagacagtcgcctcctcatactgcacaatggaacaagaacaggctaactcggcgggggttagaattgacaagagtttcaccagccggttagtttcgccaaagcaacttgtatatatgcaattaaagatttgaatttgaggaactatcaaagcatgaataaacttgagagcaaactttggagagggaatgaaaatgtgttgaaatggggtggaattccctctcttggccggctggcttttatagggtgcccacaacggtcaagaatgacatgtgggacccactagccgttgcctcaaaaagtgaggcagccgaccgttgcctggccggttcggccgaacccctggtgggcccaaccggccccactttcggccgatggaatccaacggtcagtgcggtcgtggcacagtgaatttttgttgaaaattttattttggtttgctctgaaaaattcatttgaagaatttcctcaaaattcaaaaatcctaaatgcaattttgaaattcaaatatgtggtgatgcaaaaattcaaattgttgaaaacaaatatgcagatacataccaatttacctgttggcgaaggtcgcgtcatttaaagtccgacatgcaaaaccgtacctcctttcgattcagtgcgcggattttccacccgtctccagaggtgatggagcgggcgtctttggcttttccttccacaccttctttgattttggtgcgaaaaacggcttcttctgagccgggtgctctaacttcttgactggtacaggtgattttaccggtgtcctccaataacggttccttggcattgttgtttccttctccaggaagttctgcatgaactttaccaggctatctgtcttgggtggctccacttcgaccacttgaatattctgcgggttcggcccgtacttgattctgaccatggagcattgttccgtccttggttgaaactcaaacttttcctccttcccgttgatatggaaacggatactcccagttcccacgtcaatgttggctcctgcggtgctaaggaatggacgccctaggatgagcggcgtctccttccccgtgtccatgtctagcaccacaaaatcaaccgggatgaagaaatcccgtatcttgactggcacatcctccgctatccccgccgggtaacggactaacgagtcagccagttggaggcgcatcggtgttggtgccaacaccgtgaagttgagtttgtcaaagacatcctttggcatgacgctgacgctagctccaaggtcgcacaaggcctggtcgaattgttgtgccccgatcgagcaggtgatcatgggacaccccggatctttcttcttctccgggaacttgttgagtatgacgttgctgcagtgttccgtcagcttgaccacctccgttgttgggagcggtctcttgttgttgagtatgtccttgagataacgggcgtatgttggtacttgcatagcgtccaacaacggcacgttgatgtggatcttttggattacttcaacaaaacaagcgaactgctcgtccactgacggtttcctgctccgctgagggaatggcagcaaacgtgtgtcgcagtactcctacggcactgtcttctctggctgaatcttcttgtcagccgagttagtagatggcgtttcttttgacatcccattagttcctgcaaggttaggatacggcggatcacgagtagacttacctcccctcgttgtgatcgccttaacattttcaatggaggagtcaggttgccctgaaatcctcccggattcatttgcagggactaaagatgccaactgagttaactgggtttctgtcatcttattcaagagttggttagagaagttaccgttattatttcctccttcataatacgggcgcggttggttccacccctgacctccttgtggacgatacccgttgttgttgcccatgtacatcgcctcctcatgggtttctgggcagtcattcccagaatgacccatgccgccgcagacctcacacgtgacgtgtgactccaaggccttgacgttgccttgtggccgtttctcatggtcgtccaagcgtttcatgaggaggtccagcttggcagcaagtaactccgtctccttgacggtgtgcatgcctcgctgacgggtctggagtcgttcctcgctccaacccatattggagaccatcttctctataagtttaacggctccttgaaccgttttagagaagaatgctcctccagctgccacgtccaggtgatcgcgggacatcggggtgagcccattgtaaaagttctgcaggatcagccagtcgtccatcttatgatgaggacaggcggccacgtactcctgtagtcgttcccatgcttcaggaatggactcgtcccttgtctgctggaaactggaaattcgtccacgaagagcgttggttttgcccatcgggaagaacttcgagaggaatgccatagagcatttatctcaagtgttgatagcagcacagttggcatagaaccactgcttcgctctcccgaggaggaagaacggaaacagtcgcagcctgacggcgtcaggactgacttccttgatggtgtacgtgctacatatctccaggaattgttgcagatgagcgttggcatcctcattaggcttgccacagaacgggctagtctgcgccatcgtgatgaggctggacttcaagtcgaaatccatatctcctatgttgacttgcggcccgacggccatattgtcagtagagggagcaacgaactcacgagattcttgctggccataatcttgaaagttggtggcgctggtacggctggtttctctgttggtagagttttctacggagcaacgactcgcggcctgacgctctggaagaaagcttctagattttctttggagttttccggcaggttgaaaccagtcatgcactaccctgttttcacaacaaaaagtgaaaacaaacaaggttagcctgcaaaggaaaatgattatacagaggtaaatataaagtgttactacaagtaatctctattatgaatcttccccggcaacagcgccagaaatgcttgttggtatttcttaatgacattactagaaatataatttccaacaatggcgcagaaatacttatggtatattatggttacagagttcatccgcaagcacacggatataccattgtagcatttcacccgagagtattccaagggtatcatatttattttatcccgtgggaagatcatgtagagagaactcaactaataatttatatattacttgtgataatcatattctaagcagggattaagataatccaagggtagagtgacacacaagcatttctactcatcctcataataaataatctaagctaggtggaaagaaaagagaaagagaatctattcctatacttctaatatacatagtatacatacattctagttaactgatatactagctaataccctctatccgatgccctcctggtacttcgagaagccacccctgactgccgagttccttacgacagcccgtcatgaccatccaaccggggctaaatacggaggaataccctccccaataaattaacttaggattatatataggcgcagagggaatacccgtactgagctgtcaccataagcggcccacctctcatccgcaatatataaccctaaataatgatatcccgtaatctagacaccacgcctaaactaccagatactactctaatatcatcgtcatgacatagagtaattgcataagcaaacattataccctcaccaaagcatctcccagataagctagcagtatattcagtataataagaacataatgtaaagttggtactcatatacttggaaagtatttcaataccagaaatgtatttaaaagagtattctaataaaagtacaaagcttacaaaagaggaaaggaaagctactagagccatacccgaactcttccggaggcttccggactcctgattcctattctaattctattccaccatctagatactactaaactaaacttgagaggaatgagagagctcttgcttgaggtgtgtgttgaagtgaagagagtgagcttcttatatagaggtaggtatgacggttgtggaaggggaattgtccgaagtgccctccaaccgtcattgggatgcaatcctggacgtccttgccaaaacctggatccatcggcgcctggattggttcggccgaacctggggctagcccaatccagcccaatttcggctggtggcctcctctattgctccactccacagacttgtgaattttggcccaattcatcgtgtcaattctgagttcttggcccattcatacataagtctggtcctcgacatcgtctgattgttttatcgttggtgttgatgtcgattctccttcactttattgttattctctgcaaaaaggttagtagacttaatactagtggaatattattgttctaacatatttatgcattgcaagcatcactagttctctcatgttttagtaatattgacggtcgaaactgatcgataacgaccgtcaacaacggcccaggcacgaccaggcctgggccaatgtcaatcgggttagcacggccaatctacacgtcggttgggttgtgcctagccacgggttgcacccatggcccatgaaccaggcatgaccatcgtgcttctccataaaataagtctacttctccttcctcgtctctttgggccgtgtattatatttggaataagtctattttgtatccctcttgtctttggcggtgcccgtagcaagaactctctattgcctagcctaaagcgtcactccatcaattggacacaatggtggtgaactagccttgattagcccatcattcattgcatcctaagatgaggatctagaaaatggatgtgcatcaaagacccctgcacagattactgcagaggatgaatgtgatgaggttggtttctttacttcacttttttcacactgatatcatgcacatctcacgtgctaaatgtccatgctatgaaaccggatgatgagcaccttagccttactcagaaagctcctgcttctgcaaccaacagtagcacttcaaaggcatacaggaaaaggtaaaaacattcctttctttatcaatctggttactagaggcatcttgatattatgatctaacttggagataaaaccaaatgtaggcccaggccatctcctggtacatgggcttctaagaaattgttcaaggacaactatgatggtactgctgatggcaggtattgctgactagctttgtttctgcctcaagtataatttttttgtagattccttataagttcttgcatatacttccaatgtcatcgacaaggcctaatgaatcaaggatataggcatgttgttttttgttgtgcaaagttgtggtggccttagcatgaaccttcattggttgaagtcaacatgactcctaccgtgtctacacaaggagaagaaacaaaatgacttagtgatgttaatctgttgccactacaaactatgttgtgatcatgttggatgcatgcatgtgagatgaactaagattgaattgttgcttttgtgaaaaagattggtagtgctaatcttacatcaattttgctatatatttgtcgacaaactttctcctaaaaatttgacagatgtaattacagtgcaatcatagtgtaattacactgtaacttgcatgtaactacaatgtaacttgcatgtaactttcacataattttgaactggttgatttgtttcaagatttgtgcaagtgaagaaggaaaaaagtcaccgcgtgcacatatgtgagaagatttgttcccacgacatccgttccaccgaaatagcatgttacagagagattttaaaaattacatacaagttacatgtaagttacaatgtacttacatcatgattgtactataattatacctgtcaaatttttaggagaaaatctgtcgacaaatgtatatgtgatccctcttacatccatatagataggattttgcatgatcatgatgtatcatgataatcctgaatgctagcaaacagcagcaagtactttcaatttggcatatgccaatgatgcctagacattgataaggcttacgatgcatgctattaggctattataagtgcaattttcaggtgttttcatatagttgttaccaaatttttacccaatgcatctacatcttgatcgtctgcaaacaatcctttgcataaacaagactctctattaaacctagctaatcaaactccttttatataccgtgcaaggaatccacaaaatcacttacaccgaaacaactatggatgttgcctatttaatatgtatacatatacataactccatgcctacctactacttctgaagactttgaaaagacacatgacaagctagcaatcagtatacatgccattcctctatctctttccccactaccaaacagttttcttccttctcgtaggtaaccatcctcttctttggtctctctcaggcagttgtcctcttctttgcacttcactcattctctgctcttctatacactaagcaaggaaacgtcagcttcttcaagctcttttcccaaccaggtaacagcatcgccgaacttcttactttctcattgatatccctctccatgttgtgcctgctcggtggttattactaggcagatct

SEQ ID NO: 67258 - DNA, 12748 bp, Oryza sativa
  unsure (1)..(12748): unsure at all n locations
agagaaacgattgcttaatcagggtgagaagaagacactggttgctgtccaacgacaacttcgcgttcagaacactgaatatatacacacggtcgtcgacagcaacttgccgtacgtacactggcctgaaaaaatatcagcaaattgaactcagagaaaaggttaactacacggnnnnnnnnnnnnnnnnnnnnnnnnaaattcgtgccacgcgctttaccccgcttactgcttcctgagcagagctcatacggttaagagttggcatcatggacagtaagtttatgcattattatcaaactcagtacaattttatttcaatttgttttacagtaaatacactgcacaagtacgatgtactctgctagtacaaagtaaaagactgtttgtttcgttgacgaaaccaacctcttattaataccaaattttatcaaggcaacaaacattcactcttggttacattctttgccttagtttggaggaaaaatttttgtaaacgcaaaatgagaaaactcattagcacatgattaattaaatattaattattataaacttaaaataaatttatttttttaaaagaacttttatacaatttttttaaaaaatattatttaatggtttgaaaagcgtgataacgaaaaacgagaaaattgaagtttggggttgaaaaaaaagaacagtgccttaaaaagctagtacaccaaatttttcatactgtctgtttagtactaactagcatggtggtccgcagattgcgcagatagtatcattatattttctcttatataatagcatatatgttttctcaatttattattaaaatatattaaaatgacaacataattttaaattttgtactaactttatgaaactactaatgtgtaatattcatattgtattttatatacgtgttacttattaattatttttatatcaaattttagttatttctaaaatatattcctatatggactctacacttagtctttcaatatttcttattttttaattccgaattttcgttatctgtaaattgaaattgtatttctatatagactatcggctcttcttccaatattatttatttttaattctgaaattttatattttttctaattgtatttatatgtactctaaactcatctttcaatattatttaatttttaatttcgaatttcaattacttctaagttctaaattgtattcctatattgactttagactcttcttcccatgtttttttatttcaaattttagttatttgtaaactgtatttttatatggactctaaactctacttttaattttattatgtttattccgaattttagtttgttttagattcctatatgaactctatactctacttctaatattctttatttttaattctaaatttctattatttcttaattgtatttctatatatactttatactattcttctaatatttttttattttttaattctaaatttcagttatttctaaattgtatttctatatggactctagtcttctcttacaatattccttattttttaattccgaatttcaactatttctaaattgtatttctatgtagactctgtttctttttctccgattaatatgagaatttctaagccgtgaaagcgaacgtggaagctctttttttctattcctttaataaattaatagattttccatactgattagtactccctccgtactcgtaaagaaagtcgtttaggataatgtttaagtcaaaccttgagaatataaatcatgaataactctcaagttgttgagtttaaaaatgtgaaaattaaatgaatagatttatcttgaaaaatactttcataaaattatacatatatcatttttcaataaatgtttttaagaaataataagttaaagttgtgttttgaaaaccgtgtcactgtccaaaacgacatcctaatacggagggaggacctgacaataccatgtgacaaaccgagagtagcatttttcttgtaaagcaagcactgtagcattattctgaccctaaattctggaggtgattagagcccctaaatggccggatccgattcgtccatctctgcatcgtgcggtgggcaatccctttcacatccagtcatcaacaacaccacacacaccctcacacacacgcacacgcagagaaaaagaaaaaaaaaagaagaaaaaaactaaagaactagtcgtagcggccacactacaatttacaggaaagaccttataaaatccaagagaacggtcaccgcttgcttccaagccgagcccagccagcgaagcccaccaccaccaccacccagatccccacctcgccgccaccaccaccatgcggggctccgcggcggcggcggcggcgaccgtgacgcgggtggctcagcgggtggtggccccatcggcggcgacgcctgggggcgcgctcccgctgtcctggctcgaccgctacccgacgcagcgcgcgctcatcgagtccctccatgtcttcaagggccgcgccgacgccgccgtggcgcccgccgcggcgatcgagcgcgcgctcgcggcggcgctcgtgagctactaccccatcgccggccggcttgcggagcgcggggatggtggggagctcgtcgtcgactgtaccggcgagggtgtgtggttcatcgaggccacggcgagctgctccctcgaggatgtggactacctcgagtacccgctcatggtggacaaggacgagctcctcccccaccccacctaccccgcctccgagtctcaccccgaagactcgctcatcctccttgtccaggtaagacaacaatggcgaggaaatttctcgagcgattcttgtggtcaacgggttggttggcaatgtcatggcaatggcgtgtgattgagctgtccgttccccaatgcaggtcacgcagttcgcgtgcggcggcttcgtggtcgggttccggttcagccacgccgtcgcggacggccctggcgcggcgcagttcatgacggcggtcggggagatcgcgcgcgggcgggcggcgccggcgctggcgccggcgtgggggcgcgacgcgatcccgtgcccgccgtccgccgccgtgggcccgctccccgtcccgacggagctccgcctccagtacctcgccatggacatctccaccgactacatcgaccacttcaaggcgaggttcctggagcagacgggccaccggtgcagcgcgttcgaggtgctcatcgccaaggcgtggcagtcgcggacgcgcgcggcggggttcgccccggggtcccccgtccacgtgtgcttcgccatgaacgcgcgccccgtgctccggcgcgcgctcccggacggcttctacggcaactgctactacatcatgcgggtgacggcggcggcgggggcggtggcggacgcgtcggtgaacgacgtggtgaggctgatccgggaggggaagaagcggctcccgggggagttcgcgcggtggagcggcggcggcggcggcggcgaggacgacccgtaccggatcacctccgactaccggacgctgctggtctccgactggtcgcggctggggttcgccgaggtggactacgggtggggcgcccccgtccacgtcgtgccgctcaccaacctcgactacatcgccacctgcatcctcgtccgcccctccgcccacaagcccggcgcccgcctcatcacccagtgcgtcgccgccgacgccgtcgacgccttccacaacgacatgatgcgcctcgactaataaccgagcgagctcaccgtccgccgccaccgacatcgccggcgcaatttgattcgttctttttttctttttttttttgggttttttctctcctctcgctgtacgcacgccatggcattcattcgccgtagtagactagaagaagaaaattatatatatatcagattaaaaaatacgataaatatatatgtatacgcgcctgtaatgcgaagcatttgtgcttattccttcgattaattattgagaccgggttcccctttgctgcgaatttgatgttcttttaaagaagatttcaataagtttcagaaatgaacgctcaggtaattaatttaaaccgttcggcagggccttccatgtcaccgtggcaaaaacaaattcgttcaaaaatcaaaatatggcatgacaaatctttggcaaaacattgttaccacgtcataaacagtgagctgtacaggtagcacgagcttgccacgttacgattaagaaattcagagagatatttataaggctctcaagcactatccaatttttggtttttgaacgaatcaaaaagaaaaagaaattaaagtagcagtaaaaattgttgtttatatatgattaagcgggaaatatgtaatgcaaatttagataagtatggataaattttagacgtttattttttattctatagtaatttttagatttgcacagtatatttttctcacattaaggccgagtttagttccattttttttctttaaacttttaacttttacatcacatcaaaacttttctacacatgcaaacttccaaattttccatcacatcgttttaatttcaaccaaacttttaattttcacgtgaactaaacacaccctaagcatacaaacatagtttgtatgtatgggggagaagttaacatttgtggtgttctgctggaacgactagtaggtggggagcaactgtctggaatctcctcttgcttaagcaaaggggttgcgagagggcaagcgaggtgtggtatatgcgtgatgatgcatctgttatttgtcgctgcatccatatgctaatgtgctcatgtcaagctcaagcgtcgtctacctgcctaaggggctaggcgtcgccatctcggtttgttgagctccggaatcgtgtgcgcttcgcatagattgcgttgcggacagggtttctcgctgctgctgctttctcttggcatgtcgtgcactggggtttgctttaccggggaagaggggttactgtaccccaaacgagggtaactccgactattgttatttaagaatggacgcacataaatcatatcaatatggtactacttcatagtatataaattggtcttatctgtggaagttttagcaaatgcagcttcttaagctcctcaaacaatttagatttttactactatcttcgtcctaatatacagcaacatgtgaatctgaagataattatattaagattcagggtctgttcactttgatgtcattttcaaccttaccaaattttggtaaagttgctaaaaagtgcatatatttagtttgctgccaaattttggtaactatataagaaatcatgtgccaaaattttggtaatgccaaaatttgataaggttgaaaatgtcattaaagtgaacatgccctcatagttatagaatgatctaatctcatcttaagttactgtattttaaaattgaggaagtataatctagaaaattaattagaaatgagaagttaataaacactggtctgcttctcataacgtcatgctcttctaatacaagacgtttatccatggctaaagttgcatttggaaacatggcagacatttaaaatagtagtgtaatgcttagatcgagtacgatgatcaatgggcttgtgttcgttggattggtaatttggatggtgggcaggtggttgaataaacaagtcgttgtgttcatgttctagaagctttagcctagcccccttgatcggtgcggtcctgcagagtcttggagcagcaaactcttcctctttccgactgtcggtgcagctgaactagttccatgaacaatgaccttgcaagatctggaccatccaatcaggatctaacgatgaacaccgggcaatcaaaactgtggcacgcgtaaagcaaggatagcacacggcatgggggagcagcagtccgttgcaagtcacgtcacatcacggttacgcaccatcgtcttgcgattttttttaattttttttgaacattttaatttttaattttaaaaataaacccgtccaaaaacttattttcaatatctaacctcttttgacattgacgtgacaacaatattgtcacgtggctcccgctaggatgacaacgtgatttgaccacgccagcctcgctagcgtgatttaaccacaccgctctcgctgacaagtgtcatgtcgtccactgcccatagcgtgctagtgttggtttgccacacaggcgggctagcgtgaccaaaaaaaagttcagattttggaaattaggttttgaaaaaggtaaaaaaaaaagtttcaagaaacaaaaatttctcgcttgaacctcaaaaagtttggagcgcactattgggcagctggatacggcagtgccaaaaaaccaaagtagcagcctagcaggcatatgctcatggcatcaagttcttgctactacatgtctactgctacaccatttgcatacaaccagcaactacctaagcggctagtagtaacacttgtatttttatctgggtggtgcagttcgcatgatatataattacatgaactgcatggtagacacaaagggagaatagggggccaaaaacatcggatgcttgctgactcgcacaaaggtaacgtagctactgtaggttccaaggcatggagccttggttcccagtagcgtagccttggccactaccgtcaggcgtcgcggaagtgcagtactgctgcacgacgttgttcgccggcaagccggaatgcgcggcgccggcggccagccactgggcggtggtctgccagccaggctgcaaatgagtcagctgctgcacgggcacggaatgctgctgtgagtgggactggacgtagtaagcctgggacaaggtgttctgcgattcctgtgttgcgtgatactgctgaatggattggtaatgctgctgctgttgctgatgctgctgatgatacgcgtgcatttgctgatgaacaggtccgggtggaggcaacggtggctgtggaatagcatgccgtgtttgctggagattcagattgctttggtttggatcccattctggtatgtcatcatcgtcatcatcctcccagggttgggctgcggcagcggatctgctaccatacttgcgaaccatctccctcacatggtctaccgggcggcgggacgcggcctgagaatgctgctgctggctcctgtgtgcttgtcgtgatggtactacgttggcagctgcgtttgggacggtaacaaaatcgtattcaggtaggtcatcgtcttccctaacaacaccagggccaaagcccggaggaacatcatcagttacaacatcctgaccgtggtgctgacgctcattggtaggcttggaagacaagggcactgcactggcaatcacggcatgctgcttcctcgagatggattggtttctggagccatcgttcctggcgggtatcctaggtgaaacatggggcctccgccacacgacgactccaatagctgatgttcctgtcacggttaagctgctcgactgctccttgggtaggtgctctgcaagtatctgtgctgccttcccttgagaagggcagaggtaaagctccactccatctgcaggcttcactagtcctactctctcgtctgcaatatatgagtcaatggtctgcaggaaaaattagaggtggttagcagatcaggagtcccacaatagcattacgctgagcccgtgcaaaaggtaacagatgacaagaattaagggagtaacccgcaagagatgctggcgcccactctcaagagagccctccttccaacgcaactcagttacctgtaaaacgagtaacaggttcttaatgaaataacatatgtttcaggagcagaaataatggaagattacccatctggatggcacaaggtaaatcattttccatcagatagcatctctatatgcacaaatcaacatttaatgcatgaacataacctatttatttgggctaatcaggtatatgaaatacttggggtgcagtcaggaactttaagaacaagaccttgtatgtgctaattgctaggctctaagcaaaagaaaagcaggttcaaatgaaaattgtggatttctcatagcgtggaatgtggaactacttcctccgtttcatattataagactttctagcattgcccacattcatatatatactaatgaatctagagttctatacatatatatgtatttagattcattagcatctatatgaatgtgggcaatgctagaaagtcttataatatgaaacggagggagtatatactaagcatagtgaataatcaaattcaagagcacaaaagtacatatgcaattccgaagtacataatatttctatcattcatgaatcagtgcgggaaccatagcacaatccaacattcaggctataatacggtcatagtcttcttattagggcattccctttttttctttcatttatttgtttctccaactaacacttaaagtgtaaaacattggcaaaggtccatgcctcaacataacattagtgcaactatgcaacccatttcaaaaacattaatacctagtggcctagtggaccaatacgagtaataaattgcataaaactccaggtacaaatacaaccctgtgtaccacaaaaccacgcgttttaaaaatattttcacataacacacgtcaattgaagctagtaaatgaaacccagagttgttgcaatccagaccgaaaaattcattgtggtatgatgttaggtttgccaacagggcacaacatgtgtccagtgcaaggttggggcacccgttccatgtatccagtggcttggccttgtagaccctttttctggaatgtggccttgtagaccttttttctagaacactggtctagtgtgggcctttatggaattcttaagccatatttgaatggctcacgtatcaggacagaaggttgtgttatggcggttgcctaactgcgtagcccaacagctgtccatcctgacaggctgacatgcgaacgtggttctagatttacaccaaggacccacacaagatggatgtagtgccacactacagccgtgtttagtttcccccctattcccaactttccattacatcatatcacatcaaaaactttcctacacacataaactttcaactttttttccaaactcccaactttcttcaaacttccaactttttcaggaacataccctacagcaaaaaggccacggttgggccgaatgtccacatcacaatgctatattcgactatggggttttctgtaactatcacccatctatctgcgattttgtgtcagaaggggccacaaacatgaggttttctcaaattcactcgcataatatctaaagcctaattgcatgtataacagtataaggtgttttacactgtatttggaaccacagtttcaacatattccacatgaactacccagttcctaacatagtattgaaccctctttgaacagagctttttttttaagtgtattctgatttttttcccttgattttgtggtattttttatgtgttcgaaaagagtcaaactgggagtgcaaaaagggttaatacagaaacacagtgtcattttggagcacaaagaaatagaatggaggttcgttcagtggtaaaaaaagaaatatctcgttagcagatgtatattatgtatattaacttttattaagcactcaaaacaggccctttctcaggatactagttattttcgtggctttcttctgttgatctgcgagggcaatttgcataggcaaatccatgtgcgcaacttgtttttgctaggtttgtgtaccgagtcccataaggaatcaatttgctgtaaggacaacagaggcgacagtccattccactgaaggtatagcactatatctgcagtgcacttcaatgcaatgtgtagaactcaattaaaacacaaccagaaaacagtgacattgaataacactctgcaaaaaaaaaaaaaggaaaggaattgccacagcatgtcatgttgacccagtatttcttttaagggaatggctaccatcattagatttatggaatcccctgaacacggagttcggaatatttatgcaaatgcctaacgttaacaacaaagattatcttacaaaacaaaaatgtgtttccgtagcatcttacaatcaatcattcagaagaagcagtagatgctactgctagcaagtcaataggtacaactgtacaacatcgatgtatttcacatttccatactgtggtaattgccaattttaattaaaaaatatagtcatccaactgagaatagcaaatgagaaataactattaccattatagcacggctcctggatttaggaagttgttcaagaaattcttgaaaagcactgagcctgactcttcccttgatatcaaggaaatggcgccactcgtttgtggatgtcttttcaccgctacagaacagacaaaacaataatcgactgaggatatataactgaaatattaatttgtcaagttgtgcactgttctataaaatggtaccatgtattgtgctcaagatatagaaactagcaagagaagtactttcaatagtgaattgtatatacaagagagataagcagtgcagaactgcggatgaaacaaaccttttgaagatcgcaacaacatttgtgagtgatgacaaggaaagttgaattgttccctcccatacactgtcatgtgtcagcaaagcatcaggagctgatttacaatccgtgatagattcagggatcgactgactgccagtatcaatgttttcagcattggccttttcaggggaggatttgactaacagatcttcctttatttgttcaactggaaacaaaattgagcctgcgtcttttttgggtgactgtaacttggactcaaacttatcttgaggagataatgtttgcggatcaagttgagaatctgatgcagaagcactatccacatttttggaagaatcttccgatttcaatgaaatgtcagttttctcaatagaattaggatcatctttcacagtttgagtggaatcatcttcgaaaggtggttcagaatcaagggtctccatgaattcgtccagtgacataattggtggaagattctctgtatctttcaggtcatctaccatcagttcctgcatcagatcagttttctcattttctgtatgttctaaattgcttggcatgttattgccgcctgtcacgataactccatcttgctcactattgtctgattctttttcttccgtgtgtacacttttatcatcggttttggtttgaccttcagtaggtcttgatggaacatgcgaaagcaaatcacccccaattccaacctccacagagataccgtcagtttcttccacctcaacttgaaattctcctttgtgtgttttcctcaccaagcgtctaacatccacttctttactaggaagaaccaccatctttgcaagctcttcagccttagccaaccgccagtctgaaagttcctttgaagcgagttcttcagtagtcattgaacataggcgtttgggtgttatatctccagacaagacacgtcccctcagtacaggattacttttatcttttaagttgaacagaagtgatcgacccttctccttgtatttcttgttaactcctcccaataaagtgaacagctcaccttcaatttcaaatgctaaaatttgggccttttgggttacactcttcttttcttctgctgccccatcatcagtctttattcttttagactcatgctcaatcagagatacatcaacaccttcatcaatatcagattttctgactctgtctggatcggattgagaaatagtttcagaagctccaacaacgtcagaagaccagcaaagtccatggccttgcagaagctcatctaaagtgcaagaattgttatccagtactttattttccaaaggaacatgtattgattgctgctgcatatcatcactcaccttgatcgacatgtttgatgccgaattgctacttaacatgttatgttgcccgcttttcaaagcactagtctctgtgacagaatcaataccagcaccatcggcttgcttgttctcgctagcagatccaacatgtgacacggtttcaacggattgcggggcacactgttggtcagaatccatattcagggcagcagccagagtctctctgaactttgatctcacggactcaaataattgcggctgtgccttgggcagcagttcctgcgcaggacgcttgctaccagcagaccgaaagggcacagacttcagcatctgaaccttcggcgacgctgccatcttcttacctgctatcatagacggcgatggcatcatcgcggccataccaggcaaagctgtctggacactcagcacctgttgcggcggcctaagcgacaccctactcaacggcctggccccggacccggagaggcccagcgcgttgggcctgggcacaccaacctgcgccggcggctcgctcatgggcacgatcaggtagctgctggccggcacctgcgcgccccagttgccattgtagaacacggccgggtacccaacctgcgtagtgtgggtaatcgccccaggcaatgtcggcggcgtccccgccacccgcggcggctgcccctgcttggggatctccatcacggcgccctgcccgttcccgcaccacgccacctagggggatccaaaactagggttacatcagcacacgttcgcacgcagataaaaccctacctactcgacgtcaaaccgcaatgcgggttcccgggggg

SEQ ID NO: 67259 - DNA, 5734 bp, Oryza sativa
  unsure (1)..(5734): unsure at all n locations
ctcgcggcgcacggcgatgacgacgcgacggcgacggcgtgcggcgcggcacgatggcgacggcgatggcgactcggggctcaaggtgatggaatggcgatggcgcgacgagacggcgacagcgcggcagcggcggcacggggcacaaggtgacgcgacgggcggcagtggcgacgcgacagcgggcggcgcagcgcggggtgcgatgacgcgacaacaacggtgatggcgacgcggcagcgacggcgatggcgcggcgcggcacggggctcggcgcgcggcgatggcgacagggcggcgcggggctcgagacgacggcgacatgacggacgcaacgcgcggcgtggggcgcatggcagcggcggcgcgcggcgcgaggcagagacggcgacggcaggcggcagagagagggggaaagaggagggctgggttaggggaccacgtcgagcacctagagtgcaatgaacagtgccattttctatttaacccgattttagtttatttcccatataaatttaattctataatttctaaatcttgcataaatgaagtttactcaatatttgtgttattctaaccaatggattcaccctagattaatattactcatattttatttttatataatttatttgagttttaattagggttaattcttattccatcgtacttaaatttaattgatccaaatatggtcgcgataatattttatttatttctatccacacctaagctttattttaatttgtatttactccttagcatttgggtgaccatattaagtgttcaaatgtgaatttgcccaaaatttaatattgtccaatatttaaggtttattaaagattctataattttctaatgagaccgttattaacacaatagcacattagctcaatttatttatatgttagtttattttatatggagaggtttaatatatcaaatttcaatccctaaatgcaattaggaacttggtgcaatatcgatctacatatcgaattaaatactcccgtaattctattatatatacagagagctcagtttatttgaatgatcatcatttcatgtgtacacctattatggcacccacctacattatttaaatattttaatatttgataaaataggttaataataactttttcttttatttgattttaatatcttgtgcataattatttgtaggattaaatatattcccgtaaatcatatctattgcttaaatgtagttcttttctttattttcttggtgatcatttacggtttggcaagcaatagcaatcataacaaccagcatgatgcaaaagttttaaaaagttcgaaattttcgtgattttcattgtcttgaattttcaggatgttacataacctatacagattctacatacacaaggaaaacacctatacagcatcggaaacgaatcagttatgcagtaacgtaagcagcagcatctctattgtttaacacacttaatctatacacatcaactccggcacatccatccatacacttacctctccctacctctagtgcgaggatgaggcacatcgggagtgaacctccactcttgggatggagctcgcctacgtcgtggtcgagacggcccagcctgtgacgatgactcccctcacttttaagttagttaatattctcaatcgtggcttggttaggccttgttcggttacacaaggattcattccgggccgagaatgataaggtataacaagaaatttataataggcacaacaaaagaccgggatttattccgggtcgagaaccaatttactcatattaggtacaacaaaacatccggattagttccacacttcttgactagtagattgattcccgatctcttattgtccctatcataagtaaaatagttcccggctcggaataaatcccggtgtcttgttgtatctatcataaatttcttactatacttgtcatttccggcccggattgaattcttgtgtanccaaacaaggcctcaggaagctctcgcaaatgttgatttgggtcgtgggggcggcgagtagaaggaaacaaccggtgacggtggcgatagctagtagtgaccgatggaacggctttgcatgggtaggtgtttctacgagagagggagaagagagaaaaggctcgtgctcactctggcgactcatagggctagtttgctttgtgacctaaattgaccttaccaatttttgttaatgtcaaattttggtaagttttggcatagctaatcttggcaaggtaaagttatttttggattgaagccaaaacagcctaatttcactaatgaaatggcctatttctttaggcatgccaaaatttagtttctaaccaaatagacactaaacactattaaaattgataaatattggtaagaccaatttaggccacgaaccaaaccagtccatagtggctactgtcctcctaaccttgaatgaccgatgaagccacagttaatatattgaccaggtttaatttgcacacgtacggcttgatcatgcatcggcagttgattttttagttctgatgggagtcgggccatgccgggttggcacggtctggcccattcttcgtgcctaatgggccgtgctagcctgtcacggcctgattgtctatgacattccagcacgccctcttcaatgaggaaaaagttcactccaagtcccccatctatggtcgagtgcgtccctcaaccgcaaaatcagatataggacgtttttcaactagaaaaacagtgtaaatcaagtcacaacagttttggatggtggttttatcatacgtggcacattggcctagtcttcgtccgacatggccttacgtgaaatttcagtcaatggaaaaaaaaacatatgtagtgggacccacacttagttgtaattctagaaaaaagatttaaaattgtgtacccacatgtcagtcaagaaaaaaacctctctctccgctctgttagtggctgaggcgtggggacggtgtggacgcatgccgaggatagcgactggcgaggttgaggcggatgcggttggtagcatcaaagaagagggagaggagtagggcatcgtgggagcttggacgttgtcgctagtgtttacaagggtgaggaggagggtgtagcggaagcaggcaggcagggcgagacgcgcaaggacgacccatgtagaccaggccgatgacggcatggccaacgagaacgaggtggatacatccaacaatgtcaaagacaaggacgaggaggatggggatcgtgggagctggcaaacgtgggtattggcgcaggaaaggaaagcccaaggacagcgtgtggaggtaggcttaggaaggagagagggcagagatatcaagggggtgatgacgtggcccccctgcatttttttttaatttttatgcaaacaccactgtattttatcttactccctctgttttttaatagatgacgccgttgactttttcttacatatttaattattcgtcttattcaaaaattttatgcaaatgtataagatataaatcacacttaaagtattatgaatgataaaacaactcataacaaaataaattataattacgtaaattttttgaataagacgaagggtcaaatatgtgagaaaaagtcaacggcgtcatctattaaaaaacggaggtggtatattcttactgtatgtgccgcataaatgttacgtgggacagaaatctaaaatctagtcagtacgtcagtacgtcacgttagtctaaaatagtctcgatattgccttggaattatatttgctcttgatttgaaaaataaggtacgtccaccattacatgagagatataaagtggaccttttccctcggtcacggaaattcccgatcaactgaccgccgtttccgtataaggggtactatttccgaccataccgtttttatctatttttaaattttattttttctaatttctttttcatcgtattaatatcggtactgagtagtttaaatgataaatataatctattaccggccgtttccgaagagatgctaccgattctgacatttttttaacgactcacacaagaaggtgcgaagttctattgatagggcaggaaaaaattacaagattacaaccctagagggtcgtaaccaggaaaaagaaaaaaaatataccgccacccacacaccgacagcgtcaacacacaaaaccgggagaaggttaacaccggactggccgccgctaagcgtgaccgaccgccgctagacgacaaaggaatatagacgagattgcccaaaagaacaccctcagaaccaatgcaaagccaactcctagagcatgcttgcaccgatcgagaggcttcggctaggggataccaaaacaacgtcttcaagaagagaagcgacggaaaacagccgccaccgtccgtcggggctcaaaggagccaagactgggttttcacccggcaaccacccgtgagggatgagacaacacgacaacgccctcaggagggggaattaaccatcgttgtcagtcaggccaaggccatgctaggttttcacccactgctcaccacctacgaatccatggctgaagcaccgatgctccaccaccactcaacctctgctgacatgtgggaccactgcaccggcgccccccgccggccagccttcgtgcgccgaagaccgcgccacatccaccggcagctcctcctcgcaccaaggacgcctcctttaccgccggccgcgcctctcgcgccaagacggcctccatctccgccgcccgcgcctctcacgccgagccggcctccgctgccatcggctgcgcctctctgcgccaagccggtctccgaccctcctccaaccgttgccgcgtcggccaaatgcagccgtctgccacgccctcgactagccgtctgaggccgccatgcctccttccaccgccgccgccaccactgccgtcctttcgcagccatcatcgcccgtttcgggtcgacgacaccgcgttcgtaccccggtcgcggcatccttccccgccgccatgcatgtttctccgcgctttccccgccgcggcatccaccacggtcgccagtcgcctccgccagacagggccgccaccgccgagacggtgcctcgccagctgccaccacagcagccatccggctgccaccacagctcgccagccgccgccttgtcaccagccagtgcatcagtagccgccaccaccgtcactgcctcagcagtcatcatagcagccgccgcctagccaccagccgcctcctcaccagcagccagccgcggtcggcagccgcagtccccaacgcggacgccatctatctccagtcgcctccagccgccgccgccaactccggctcagccacgtcgtctaccaccgccaccttccttccccgccgccggctgccgctcccccagatccgactagcaccgcgcggatctgggcgccgccaccgtcgagcggcgtccccagccgccacctcccacatcgcatcgtccaccgccgccaccttcattccccgccgccgactgccactcccccagatccggccagccatggcagatctgggcaccaccgtcgccgccgagcggcatccccagccgccgggcgtgaaggggagagaggctacacgtctgtcgtgtgattttttcttaggcatttcacgtttttttagtcgcaccatatgtgggccaagatttatgcaagaattggtggggctgcatgcatggataaggcagtgcgttg

SEQ ID NO: 67260 - DNA, 1200 bp, Oryza sativa
tttaatgcagtttctcttgcaaattgtcatgttactgtgatggggatgttcattgaatacccatgcttagatttcaaattttagctattgcaacatcgcttggtactgtagactgtagttggcattcatttttccatcttgcctgtactgccacatttgtactgatgaacctttattgaaagaaaaacgtgaacagcctgaactaactgaatgttgatagggtgaaatggacgttgtaacaaaatagaagtaaactcacgccactaaatgtacttcgagttgttcagtgctggttgttttgtatatttaatgttactatgcaatctgccttgatttttgttgcatgcagtttgtgagaagcatagtggattgaaagacaacaaccaggaaatttcaatcgggagtgagatacctgagaatgagcagggtgctgtaaaacaagaattgctttgcgtgctgacaaatccgagggggaatgaatttggtattgacaatttagaaggaaatactgagacagttcatcaggctgatctcaataatggatggaattcgatgccagtggaagctggagtgcatgcctctgaaacttcaactgagaacaatgaggagtggattcagccaggtgagctgagccagaaatcgaatctgatgccgatatactctagggagcatgctgatgaagaaattaaagaggacagaatttcactgactgagataaaacaaggattggactctgtgacaattgattcttgggaagaagttcatttgatttcaaatgatggcaccaaagagaatcaggctgaacagcctgagctgaatcatcaatcaacttttatgacagtacgtgctattgagtatgtaacagacttgtttgatgctaacatcagtgcaggcaacggtaagaaataagattttaatcatttggtttgtatcttttgttgacttctctagtgtgatcaactgatcatcttttttttttcaaattgatccagttaatccaacagaggctgctctaccaagcttacatcaattctcttatggaccatcaacaagcttaaacaaattatgtcctgactataatgatgttgaatcagagagtgctccggatacaccaattcacattgaagatatcgatggtttacatgagttggcaaaccataaagcaatgacttctgataccaagtcagttgatctggaaag

SEQ ID NO: 67261 - DNA, 6396 bp, Oryza sativa
ccaccacctgctgccgccggtcttcgccgaccgaggcgcgtgcgtgcgttcgcgggtgcgcgtcgagggaggggaagcacgccaccaccacgcgcgactcgctacttggcgacgacgacgccgaggccgaggaggcggacaagcgcggttcaccaggcgtacggcgccgccgaagggggtcgagaatcccgcgtcgctcgcgggcgggcgctgaggaagccaggaaggccgccgaaacatagcggccacacctgctgctctgctccctctgcgtgcggcgcccggtgaggtagtcggggtcgaagcgcgtcaagtcgagggaggcgaacctgcgcccgcggctgatcgatcgaggccctcgccgccgcgcgcccgcctcgatcgagagcccttctgcatttgatcgtctgaactcagctcaggtacgcactaatttggttccgcatctagcatggtgtccaccacccacgcacgcacgcacgcactccgctcgtccgcttgccgcggcgcacgcacgacacgataggcgccgccgcgcgcgtctcgccgccggccatttcgcgcagcttctgagtgtcgtgatgactgcgtgacgtgcaactgtgcgcttaccatgtcaatgcagtgccgcgtagagattggtggatggccatcgccaatacatggattaattagttagtgatgagttaaactaacacacgcacacaaactgcagccgcggcgcctacttctgagcactaaattaaccttgaaatccattttagccagcactaaacatggattagttagtgatgagtaaattgatgtagttaattttgcttacaaatcatcattaattagtcctctccaagtaattaaatgttggatgaaaaccgagcaggtgtgattaaggacaagacatactcaagctatttggaagacaaccgtgagtttcatgcatggccaaggtttcagataacgaaaggttagtgcctccaatacatctcaatttttcattgattgtatttttttttcatctctggtagctacttgtgcatttatatatcttctatagagtccttacgaatatttaattgctatgcactaccgtatataatttagtgattggtccatattactattgacccatagttccctggtagtagtttaaataaaacaaatataatgcccatagtttcctaaaaacgttataatgcccactatagactataaaccaaaaataataatgcacaccatagactaacatggtaccggccgacaagcaagattaaagttaaaagtttctctcttttttctagctctcctatataatcccagcagcttagtagtcactagacagtgatggttttgtcgttgccatcctttatctgctcttactactctgggttcaaacctttgatatagcaaaaaaacattaagagatcaaaattttagaaatacatcaaaatattgattgaaattgtcaaacaaaatttggaatgaaccttttttttttgtttcatttgactatttgagcctgcctgatgtatcttaaatgagccctcctctccaccttcctcaccactgcaagtgattgtgaatgctaggcctatttgcctgattacattgtggatttaaattaattttataattattctagtcaaaatattatttatactatattccctccgtttcatattatcagttgctttgacttctttctaagtcaaattcctataagtttgattaagtttatagagaaatgtagcaactcttgtaacaccaaattgaacataacattgaatatcttcttccccaatttcttcttcttttcctctctctcccttcctcctcgactggtcggctatagcagcggcactgacgccaccgtcattgcttcgatgcaatcggaatccggtggagccacctcaaatctagcctggatgatgggcctgtgccctccacagccaagtcccctgcctaggagaaaccatgggtgcagcttcccctctctctatatggtaccgacgaggaggaggcggtggtggcggttgatgaggagcctctatcttcctccaccactcaagcttccacccgccttgcctctagcgcgaggctacaatgaccgtcgtgtgtcgcaccaccgtcggccctgtcgaccaccaagagtggtcatggaagtcttgcaactgtggtattcaatcccacgcaagcttcgaccttgcctattccctccgcggctccacctactcaccgacatgtaggtcaccgggttgtgcgctagcagcgcggcctacatgcgcctcatccgggtgcttcccggtgccggccgcacactcgaggatgaggcgttcctccttgagatgtgctgcctcgagctccaccctgtcgctcgcgaaggcgggtaaggaggacatggtggcagaggatggtgacggatcctcgcggcctgccgcatatggatcaacgaggtggaagagagatggggaagacataagagatgatagaggaataagatggaactgtcatatgggtcccatgtttaggggtattttggtctatatgatgacggaaaatgtgacggcgatggcatgcttctaattttgtgcgtattcgaatggtatggatacgaatagatgaatagtaatgaatttatctaaaaaggcaaaattttcccaaaaaaaactaaaaaaatgtgtaattagctgcgacactgtaaagacgtgaatttgtccgaaaacactccaagtgtggtaatttgctacaggacaatggatacattaaaatataatattaactcaattgatgggagagaaaccacacaaaatgatagttttaccgttatgttattctcctttctcccaatcttcttccgccgctcactcacagcaagctccacccgcttgctcatggcggcacaaccactcgacgtagtcgatggcgcggtcggtcgacatgctgccggcaccggtgagattggacaccgtctagctagtgcgcaccgggggggggggtgtgctatggtgccgtcggcaaactccctaattatgaacacgttgccgaagtgggtgaccttggtgagccagctttcgccatcgtccatagagtgttccctgagacaatgtaggaaatccgccgggtcgtcaaccacctcgaggaggcggtgctcggggcgaggcggtacctagtggagagcacgatgtggttcatgtctctcacgtggtcgtccggttcaagtgccggccgcgacggtggcgcgagcacgagtggcaccggcgattgcaacgccaccacggtcaccgatgacatttggctgtaccttccgtcctcgtcgccaacagcctcgacatgctgtgcgaccgcaccattgactacaccgagcagctgtccgtcatgggtaagccggtggagctcactgcgaatgagcgttgcaagaaaaccgaaagaagggagaagaagggaaaaaatgtcattttatgtggtttcattctcatcaattgggtggatattatattttaatgcgtccagtgtcctgcagcaaattaccacacttctgaagtgtctttggacaaattcacgtctacggtgtctcatagctaattacacatttttgtgtgtcctgtagcaaaatggcacatttgtaatggcatggatcaattaatcctatattctaaacaatcttctgtttttcaggtatccagttgaagtaagcaatatttcaaaggagggggtaatcaatttctcatacaaactattaatattcttttgcattttttaaaaaaatattaaataaaattattggatctaattccaaattacacatgtttgtaggaggtggaggtcgttaacaacaatgtgaagttaatctgttatagggatcctgttccagggactacaaaattcaattacccattttattatgcttcagtttatgatctcttaaatcctaaaactgcgatagatcaaagcattaggcaatatgttgtccttcgaagaaagccacttcaagatgcatatgacacattcaacttcttgagcctttgtgaacacccgaacatccttaagccctatggattttgggaggataatgataacaaaggttttattgcatttccacgtgtcaaaggcacattaggtaaccttccaacagatgagttgttctctgtggagatcgatgcgaataaggttacctggctcaaaggcttttctccaagtggcatgcaaataatcaggtacaataatgggtaaccttgctaaacaaattctcaattattcatgtcatgtcattatgcgttaatttattaatcttcacatccttttgtatagataatatctattttacgatattgagcttagtctatttttgaaaaaaaaatgccattgactttgtttccttgagcaaaactgaaatattatgagttttttttgttgcttttatagagatattgtgagctcggttcactatgtgaacgagcggtatcctcaagctggcactagttctagtggaagtgccataccgccacttacgatgtttccactagaacttgcctctcacaaaattttatatgagaagattccaacaggagaatacaagatttttcttggagatatatccacgactaaccattggccaaaaacaatgaaaaagagtaagttatcgtttcatttagtattaagtgctatatttacctctatgatatttgtatgttctcatgaaattacgaaaataattacttgggtcattttgtacttgccaataaaaaaaaactcgtagaactaaatttctgaaattatgcacctttaaatgaaggtagctagactttatttatacccctagtgtaatactccatccatctcattttcatgattacctaagcaaaagtgtagcaaccaagtacaaaaaaacctttattattctaaaattaatccttatcagttaatatgcttcataactttgtattccatggattatgtcatattttaaatattacatgacattgcaccaatagaaattaatcttggttagttgcatgcagtgcattcgacgatgcacgtttactctttacacaaataaatgaatagacacttgttagatgatgattataatatattaattactaatttgctttatttttttaaaaatttgctttattttcttggcagtaggataactgtacacttcccgaaaaaaatattagctattgttcttttctttctagaccaaatatccaaatagcttctaacttcagttttggtatttctgtatatttagacttttcagttgaagatctcaagaggcacaactggaattgcctgggaaaatacatttcaactatcatggccggccataagcccaatactgaattgatacatcttgtagatgtcctgataaaggtaaattggttgttacagttttaatgactcaatgcaaggaagcctgacaactaactcatctgaactggagtaatatatttgttattaaaaaaataattacaaatttcttactgttgctggaagtagtttgaatcaaatgttgcatgggagggggagcgtggttaggaattatatcgaagttcacaaatattttcatgattattagtttgaataaaaaatatgctggaaaataatttaggggttaagtgctctggtgaaataattcgagacaatagaattgacttttcccatttgttaatacccgagaattccagtaggtagctaaagctatggaatgtacgttgtatatgtagaaactagctagtcctagtgtccaatgctcaatatttggttgggcctgtagcactaggccactggcctcaagctgttgtttacattggactaaggccttgtttgattcagcttaggattattataatttggattactagtagtaagctgaatcaacagatagcttattatgatagattattacaatctataagtcagattactataatatggtaatgcactctaaaggtgcttttttagattactaagtggctaacagctagtaaagctaatgatctagagaaacaaacaactaacaacttattttatgtcggcttattataatccagcttatagtaatctagctcaataatctagattacaataatcttaagctgaaacaaacagggcttatatgtcgactagagtttcctaagtaatttaccaataaaatgtatatatagcactcaatattgctcatatttattttgtctttacatgtgtcaaatagatttgaggatattctctgggaacctgcactatggggatcgaaaatcaaaatgcgttttgttagagagatagtttggtgcttagagaatgacaaaacaggaggaagaaagtcaacactctccaaactatctccattgggtctacaggattgtatcaccaagcttggacttaactacaacgaag

SEQ ID NO: 67262 - DNA, 12217 bp, Oryza sativa
ataacttaggtgtacggtgcaaatgtttttcggtaataaatagagctatattgttgccttacctgcctagggtgacttgtttcagggataatttttgggcgtacttgtcatggctggtgataatcttgttggcgtctcgccaaattgaggaggatcgtgatggatttgcttgggtagcagatgaagaacatgagaagtagaggatgaggcaattggggattaatttctttcttctttcttttcggatggaataaatgggttatgcccgatttattctaagtacatcccataggcccacaattaacgttaagaggattaataccacattggaaactttgtgaggtgatctcaatttaaatagggagctattagagagcccctgttgaccggttgaggtgttggtaggattgccacacgcacgggctgaacgtgcagtgatgtagcctagggggagtgaataggctttcctgaaattttctgaacaatcgcagcggttaaattgacagggcccggaacttccgggtggttaaattgacagggcccggaacttccgggtaggatgtagtatcccggaacttccgaagttcttaagccaagaacttccttaagaacttccgggcagcagagataatttgtaaactgagaagaaaagtcctagctaggaagatcaggcacacagatgcacaagaaaaagatcacaggatatcagcagattcaaacaaagaacatgcacaagagagacaaagacgatttttttcccgaagttcggatcacacggctcctactctccgttgaggtgctccaaagagccgggtctcgattaaccccttgcctcacttatgtaaagatcccagaagagatccacagccttcaactcaacacttctaggtcattttctagaattgagtgatcaccaagatctaacttaaaattccttctagaaaagaccacaagtgcaagttgctctacctaagataacctctgaaaactcagcacaagaatctttactcacttacctcgtttccttgcggaggtgaggaaaaccttcacgaactttcccgggacatccacaagatctttggaagctcatgggcgacacctaaccgtctaggagaagatctccaagagtaataagcccaagtgacagcccacaaggtatccaaagtgctcaatcaaacctaatcttcaagccatctccaaaacactcctacactctcatctaatctctcaatctcacaagataggctttagatttaagtggaggaagcaaaggaagcttgggagtggctagaaaaccctagaacatgaaagaactgaagtggaatggccaaagggtgacctggggacgaaatccatatatataacggctaggtgacgtcatatagccgctactcacaagtttgaactggaaacttgctaggaggttccgggcaaaagtgccaggaacttccaggcagcacttaggaaaatttttgcaatgaaacggcgcccggaagtttcggccagaacctccgggtagccctctctgtcccgaggagaaaatcatttttcaaaaatgattccaaaaatcttttgactcatggatatgactaagagcactttgtataccctagaaccacacttgaaacccctcttaatagtacggtttttcctaaactcaatttcgaaagtgaaaattctagtctaatcaccttcggtcctttccgctcttaggaacattcaaattggggggtctccttgtattcttagccatcacaacatgctttgggactaaactcctgtgaataaacttgatagacatgttagtcccctttaaccaccttgtcattaatcaccaaaacccactagggggtttaagtgcaccttcaatctccccctttttggtgattgatgacaacatggttaaagcatacaaaaagataatagaatttaaatttggtatgatgagagaagtgtgaagctccccctgaagatatgcatataatgaaatgagaaatgaatacattatgcataagacgaaggaaagctcaaaagaaacttcacactaccctcgtcaatcaagagatgcagatgaaagtgcttgaatgatgagtgatgcaaaaataaagattagatgacatggcaatcactcaaaaaaaatgaaaggaacacaacatcacatcaaaatgcaacatccatatggtctaacttactgacataaagggataataaagcatctaacagtcaatgcatccaaccaaaatagaaaacgaatacatgtccatatagagagagataaaagagaggaaatcggcctggccggaacctcctgatcacaggacccggaacttctggtcaaatgaccagacaatagtgacccccttcaattcacaattgtaatgacccccttcaattcacaatttctccccctttggcatcaaggcaccaaaaagcaagaaaccatgaagagaagaagatgatcactcatctccatctccattagagggaacaatctcggtatcgccagcgagatgagattcatcggactgtgcagcggtgtcgccctcatcaacatcagtgggagcatcctcagcagctgcctctgtgtcaccctcatcatcatcatcaacatcatcatcggagtaggtggatggaccttctccgacaatgttgcgggctgcctcatacgcctcaaatggatcaacatagacctcatcttcagaatcatctgacacttctttcccagcttctctactatcttccttctaacgcctttcgatcttcttcactttcttggcagtcttagcacacatacaaaaaattgcctgaagtgccttcttgatgggagaagaacttgaggaactcggttgggcactagaagaaggaccagctgaagtagaaggaacagatcgaggtaccactggagaagaggaaggtggagcacgagggcgaaaaggactgtggcgcccatctttaatgtagaacaccccggtgactgtctcaatcatcttcataatgaaaggggcatagatacaaccccgcttaggctcaagaatggtgttggctatctcataccaaatcaacttcatcacactgaagggaggctgattgtagcgcatgcgactgagaagatgtgcatgcttggatagcaaagcagtaacatctccaacctttggaagcaaagaccaacgaaagatggagtacaacaccttgtagttaggatgcaaaccatgagtagattccatgcaagtcctaggagcatcctttgcatacatgaacttggttttgatcatggggaggggtgcttcactatgaatgttgggcctattgagatcctcatcatctaaccccaacatctcagtaaactgtgccatggaaatcttgtgcctaacaccctcagtcaaccacttcacataaggggttcctttccttgtagtaccaaagaatgctgtcgcatagaactgtgcaatgacctcctcattccaaccatactccaaggcaagaatatctccaagattcttgttgtggcacacttgcatcacttggttgaacacttcattgtttttctttctcatgtaagcccaatcaatccacttcatctcaaccactggattttctctagccataatcactgagttataccaatccaattgagtgaaagtcctgaagcgtggatcctgtgactcctcaggctgtgtctctggatcaatcaaacgatctcttctgcacttggcaagttgatgaaggtagttggacttgggtcttccaatgtggtgcataggagtggtgtcaaatccaagagtcttgtagagccgaacgggattctcacgagatcctacagggaaatcatgagatgcccttccagccccagaactacgaccaccacctctcccacgacctcttgtattaggtgcatcacttccttaaccactgtcaccatccctaatctgaacaggacggttgctggattgccttgtaaacctgggagaagtacgagtgccactgccactgccgccctcaaccactttttctttatccaaatgaccacgaggaaaccgaataggaggactctcatcacaggacacatcctgagatgctttctgtcttttctcacgagtcatagtgcttactgcaacaggaatcaataaatttgagtgcagtagttaggccaaaattgagagaatcaagaattgcaggctgactggacagcgcccagaggttctgggtgcaagaacaccggaacttccggccggcaaaaatgaagaaaagaggtctcaaaaatagccagtgcatgtgaacaaatcctatagatcggtgatctacaaggtagcagaaacaagactatccaagtggttttctccctaggttcacagatttagagatcgggataaaaacacaatgaaccgagagagggaatcaaaaagtgctaccttgagagaagaaactgcgaatcgatcacagaaagaagctcccagccaccaatgtggatgaatccacggagaataaacgaatttgattggtggaaagagaaaatcgccacttggggcactgtagcagcgactaggactggcatcggggagggagaagaataaggagagagaatagggtttctaactccccctgagtatatatactcaccgacacccggaggttccggacagggaggcccgaaacttccggcctgacagataaagggcagccacgcccaaaaacaaggtagagagaagaattcaacgagtggaattagagaaactatggacaagcagagacttatgatacatatgaccagccaacaatcaacactacataacaatggtcaatattcatcacaagaaggggataaaaatcaaattttcgcaataaaaggcacacaaaggattttgcaaaaaaattcacaaaagggtttttggatatagggggaatgtttgagctttattcctggtatcaagaccatcttctaccaagaagtgatcttcaagacagaagcactttttttttaatttacatgttagtgatacatgtttgactataaattagccaaccacccatcacctaatgttgcgagaatctaagatattgagctcactcctaagctcgcaaaatcttttctcatctaaaggcttggtgaatatgtcggctaattggctctcggttctcacatgggtaaggcatatgtctcctttggtctcatgatctctcaaaaagtggtggcgaatatctatgtgtttggttcgtgagtgttgaacgtgattattggctattttgatgacattctcattgtcacataggagtgggatcttggtgaagttgtagccaaagtcttttagagtttgtttcatccaaatgagttgggcacaacaagaaccggcggcgacatattcggcttcggcggtggataatgcaatgaaattttgcttcttggaggaccaagaaacaagggactgcccaagaaattggcaagtcccggttgtgctttttctatcaaccttacacccggcataatctgaatcggaatagcccaaaagctcaaagtcacaacccttatgataccacaagccaagattaggagtatgaactaaatatcttagaattctcttgacggcaatcaaatgacactctttaggctccacttgaaagcgagcacacatgcaaaacactaagcatgatatcgggacgagatgcacataagtaaagcaaggatcctatcatagagcgatataccttttggtccacacatttaccattttcatcaagatcaaggtgaccattggtaggtataggagtcttgatgggtttggtatcttccatcccaaacttcttgagaatgtccttcacgtacttggtttgagagatgaaagtaccatcttgtgcttgcttgacttgtagcccgaggaagaaggttagctcacccatcatagacatctcgaaccttttagtcatgatactactaaattcttcaaaaaagaggcattagtagaaccaaatattatgtcatcgacataaatttggcaaatgaataaatcattttcaaactttttagtgaagagagtagtgtccgccttcccaatttcaaaaccatttttcaaaagaaaatctcggagacattcataccaagctctaggggcttgtttgagcccgtagagcgccttgtggagcttgtacacatggtttggcaactttggatcctcgaaccccggtggttgctccacatagaccaactccgagatgggtccattgagaaaggcgctcttgacatccatttgatataacctgaaatcatggtgagcggcataggctaaaagcattcggattgactcaaggcgagcaacgggtgcgaaggtttcaccaaaatcgagaccctcgacttgggtgaacacttgcgcaactaaccgggctttgttccttacaaccactccatgttcatcttgcttgttgcggaagatccacttggtgccgatgacattttggtcgggtctctccaccaatgtccacacttggttgcgagtgaagttattcaactactcttgcatagccatcacccaatccggatcaccaagtgcatcttcaaccctgattggttccaaagaagagacaaacgaatggtgttgacaaaagttagcgacatgagaacgagtagttaccccctttcttatgtcatcaagtaagttgtcgacggggtgatctctttggacagtgtgatgtattcttggatggtgcaccgaggggacctgagcctgatcaggatgctctatagtgccctcggcatcaatcccatccacttgtgccgtaggcacgccttgactgtcctctgcccggaacttcctagcagatggacccagaacttcctggcctggggaggtccggaggttccgatcatctgatcccggaacttccgggtcaactgactcttgactttttgtagggctattggatgttgatgatgaaggttgatccctatcttcttggtcatcctacgtctcgactggtcgtatgtctccaatagccttagaaccaattgcttgtctaggattcgcattatctacaacatgtacaacaacttgctctccttgggagccattagattcgtcaaatgtcacatcccttctaacttcaacaataccggaggttttgttgaagacacgataggcatgtgcatttgactcatagccaagtaagaatctctcgtccaccttaggtgagaacttagatgaacgaggcctcttactcaaaaatgaagcatttactcccgaagacacgaaaataggaaacatttggcttcttaccactcaagagctcatatgaagttttctttaggattttgtggaggtagaggcgattgatggcatggcatgcggcgctcacggcctccgcctaaaagatatccgaagtcttgtactcatcaagcattgctcttgcggcttcaataagagttcggttcttcctctcaacgatgccattttgaggaggatcataggaggcggagaactcgtgcttgattccctctccatcaaggaattcctccacttgagtgttctttaattctcctccattgttacttcgtaccctcttgatggtgagatcatagaggttttgggcttgcttggcgaagcgcttgaagacatcttgagcctcacttttgtcatggagaaaatacacccaagtgaagcgggaaaaatcatcaacaatgacaaaaccatacttgttacctccaatacttatgtaggccacgggcctaaataaatccatatgtagaagctcgagagggcgtgttgtagtcatgatgttcttgataggatgcagattcccaacttgtttcctggcttggcaagcactacacacacgatctttctcaaatgtgacattagtgagcccgatgatgtgttccccctttagaagagttgccaaattccgcattccaacatgggctagtttacgatgccatagcaaacccatgaaggatttagcaatcaaacaagcttcaggattcactctatccacatcaaaatcgacaagatagatatcacccttcaacttgcctttgaatgcaacggaggagtcatcccttctaaagacggtcacatcctcatcggtaaacaagcaattgtaacccaacttacacaattgagaaacagataataaattatagcttaataaattgacaagaagaacattagagagagattgattattggagatggcaattttacctagaccaattacctttcctttaccatcatctccaaacacaatattctcacgagtttcgttctccttatcaagacttgtaaacatactcctctctcccgtcatatgattggtgcaaccactatccacaacccaacttgaaccaccggaggagtatgcctacaaaagaaatcaagcttgggatttaggaacccaaacttgtctaagtttgggtcccttgatgttagttaccaaagcctttggcacccacacacaagtgcggtactcatcattgtaattcccattaaaattggcaaccactttgctctctgaatttttgaagattacatatgaatcatagtaaagaccctctggccggaaccttctggcattgtgcccggaacttccggtcatgtcttgtgcacggccattggcccggaacttcctggtgggaatttttgagagacagatactcccacccggaggtttttcccggtctgtccggatgttccgggtccctggcagttcacaagcctagtcacctcacttgcttgtggtgctttaccttctctcacaaacatcaagcattctttcccatttaccatcacgcgcttagacacaggacttccacccaaaaacccgagcccgtgtccatccttgttaggatgagcggtgatggtcttgtaaagggcatcttttaaatggtatgtcttcatgcatccatatttcaccaatgtgcccaacctttcattctctttcttaagagcttgcatagcatcaatattagtagcataagatttcaaatcaatattgtaacacctagcacaactattgctagtagaagggttagaagaattagaaaccacatttggttgagaggtgctattccaaagagtatcaaattgaacttgatctttatgacttttgtctgaattagcaaatttttcttgaagggtttcattgacatccctaaggctagctaaagaaccattagccaaattaagatcattagcaagttgttcatttttgtcacattctttagctaagctctcctctaaggcaaggtttcttttcttctcaagaataagcaattcttcttgcctttcgagtgattgttctttactatccaaagctctcattaacttagccaaatgttgcatagcaggtttgctaaagctcttaagcacatcatctaattcattatcactttcctcatcactagaatcaacatcaagagaagtgtgggagggcttttgagtcatcaccttgcggccttgggccatgaagtaagagtagtggtaggagtcgtcgtcgtcatcactcaagttattgaagagacgctccttacttgaagaggatgacttgaaggcgacggtagcaacaccaccttctccttcaaccttgtcttttgacttgggcttgggctcgacctcgtgatcaggatcttcttactcatactcgtagcagtagcactggcaacagccttcgaggatgaggccgtcgaaaaggagacgccgtctgggccggaggggaaggcggccccctccccatcacggacgaggtgccaacgttcatccccaacactaccgaggttggggagcagcaacagcaaagtaaagtcgtgcttatttaccagcaatcgctgcagcagccctaccaaagctagaagaaaccaagattttcgttttgaacccaaccaaataaaacatatctgaaatcactaaatttttgcaaatatggtaacaacatactggcattcggctagtactaacattagtattactaatccatgcactacctcgacagagcacacggtttgcctctcatttttcgccgaacgctgatcaatatggtaacaaggcaaccatcctaaaattctagctgtatatgtacgataacgctttatatcggtcgaccggcacgggagcgtcaaggattggttgctcgcgcgtcgccacccacgtgtccctgtccccaccttccacttccacacacacataactcaattgcaacaaatcacccacgtgtcccctgcccccacctgccacttccacacacacataactccattgcaacaaatcacccacatattttggaaaccctctataaagggaatttggtttactttttgttccataaaaaatatttatctagtacactcacaacgtttcactatatatagatctaatgttgcagtgaactaaaatattccattgcaacaaatcacccacatattttagaaatcctctgttaaggaaatttgttttattttttgttccacaaaaaatatttcacctaatgtacttacaatgttttacaatgtttcactatgtatggatcaaatgttgcagtgaactgaaacattctttcgctatttgctgaaacattatttttatataaggtgaaacaacgtctgatttaaacgagtgaaacattttcgatctaatcagtgaaacaattccgatatacctagtggaacatcgtgcaacatttaaaaataattcaataataagctaaattttgttttcgtcggaatatatccacgtgtgatcttgtttcgaatatttaattacaacgaatttaatggtgcaatcggatcattatttggataagtaatttaagagaaaaatcagtttaaaatagttttgcacgtaaatcaggcgccgattttaacctcctcccatcgggcgcccgagccggagtcacatccggatatatatcaaaatatggcattgttgccctggtgagggctccttgacaggctacactcatctgcagggcgatcttcactttttagctgctaacggcgagattctattgatggaagaaacgaggaaaaaacctgctcaataaacaactagaagacatcaacatactggcagcaaggtagaataacccaaaaaaagaaaaagaaaaaaaggggagagcagctagccaactaataaaatgaacttcccaattaataataaactaataatactaacctcttgcaagggtcgtctaacaatgtcatagtagtggtgctcatagtatcttgaatccatccaatattgggcataacatacaagaaaacaaataaacaagtgaagagacaacaatcgaaatttttgcatttatgcacttctcgaacacttttcgtggcttccacacaatgacaaaaactaccagtaagaagtgagaaaatagctaaagttttccaatttgtatatctagagtgaatctcttttctgggccgattgggagttttgctactccctccatctaagtttatagcacattatttaagttctatccatcgatacgagatacattgcagatatcaatgtaaataagtgagcttttcactatatttttaatagatatacagatttatttcctatgtcatgtacgcatgcattgaatccagtccttgaaagaaaataacgacactttttttagtttagcaactttcaatcaccttggtctacatacaaaatagaagacaatttttttgtcagtacactgacattatgttctatttgtacaaaaatatcagtctgacatattttttacatcctgaattttagtaacacttctagatgtataaaaaaatactgtcactgttcaatcaacctaaataaataaacaaatactaaatcatgataagacaatccagaattcaataccttctcacgattttcagtccacctttcacatgcttcaacaaccacctaatagaagacaccaataagtttgatatatcatcaaggatgcaccataaaaatgaaacattgactagtaaaagactcagtatactacctcttcgaaagtatcttgccaagagttacccttccgcgtgaagattaaccaacaatcctgacattatttacagattgcatttgaaatattaatttggaatagatgagaataacaaaattagaactacagaagacctacaatgattcctctgatcatgtaatgcttaggaagggaatgcccagaaaaaactctctcattgaattcatctacaagatctgaaaagcatttcttgtcctaaaatccaaggggtgcagga

SEQ ID NO: 67263 - DNA, 11845 bp, Oryza sativa
ccgctccgtcgcgccggaggtcaccaccggcgaccatcggggcgcgggcgcgtcgcctccagtcggctgtgccggcgaggccgccttcgggcgcgccccgcggctgccatgtggggcccggccgtcagccgcccgcgccctcgggtgcggctgacgcgtgggacccacggcgccggccggcgcaagccgcgtgcacccggtccaccgtggaccgtgaggctgccgcgtgggccccactcccgtggacccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccgtttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttaatttaaattaatgcattaccgctttatttaaattcccacgtgatcactattttatttagccatgcctatttacctttgttatgaccttattattgtgattgttattattaccttgttcaccccaggaaaataaaaccccaactagtgggtactctattcatggttccactagtatgaattagggtagatgcttcgctgattaataggacaacattaggtggttttataactttagactttgggaattctcatatcatttgaacactatggaattgttggattatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggctggtgtcctgctgctaggggctcaatcctgcctacctgtcccggaggttccgatcgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctcggttggcttgggacgagctgtgacccagggtcgggttgccagttcggtctgaatcatcgtaggccttgggttaaggcaggttcgtgagggttcacgaccttgattaataatactgtgtagctctaggatcgtctttataaaatggctttgggcaactaagtgacttttaaatgctgtttactgcaaaacttaacccctatattattatccccttgtactcccttgcattaattatgcatctccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgaaattttcccggtcgcgacatcgagcttttcaaaaagtttgcaaaaagggcccaaaatgaatttaattgcactcttgtgaaaattagaagtgacaatggttccgagtttaagaataccaatatcgaggactattgtgataatcttggtataaaacacgaactttccgctacctactcacctcaacaatatggtgtagtggagaggaaaaatcgtacattgattgagatggcaaggactatgcttgatgaatatggtgtttccgattccttttgggcagaagccataaacgtatacacaccgctctttccaagagtcactcaattgaccaagtgttgggtgacattactaagggtgttcaaactcgatctcatgtcgatttgatttgtgaacatgacttgtttgtttcttgtcttgagccaaaacatgtagttgaagctctttgtgatccggattggatgaatgctatgcatgaagagctcaacaactttgcaagaaacaaggtgtggactttggttgaaagacctagaggccacaatgtcatagggacaaagtgggtctataggaacaaacaagatgagaacgggttggtggtgagaaaaaggcaaggttggtggcacaaggtttcacacaagttgaaggtttggacttcggtgaaaattttgccctcgtggcaagacttgaggctattcgcatccttcttaaatttgcatcatgctttgatataaaactatttcaaatggatgtgaaaagtgcttttctaaatggtgaaattgccgaacttgtctttgttgaacaacctcccggttttgaagatcctaaaaatcctaaccatgtttataaactctcaaaagctctttatggtttaaaacaagctcctagggcttggtatgaaatattgagagattttcttttgtcaaaggatttcaaaattggaaaagttgacaccacccttttcacaaaaattattggtgctgatttctttatgtgtcaaatttatgttgatgatatcatattcggttctactaatgaggtattttgcagggaatttggtgatatgatgtctagggaatttgagatgtccatgattggagagttgagcttcttccttggacttcaaatcaagcaactcaaggatgggacgttcgtgagccaaaccaagtacatcaaggatctactcaagaggtttggtttggatgatgcgaagcccatcaagacacctatggcaaccaacgggcatctcgaccttgatgagggaggtaaaccggtagacttaatgctttatcattccacgataggtagcttgctttaccttaccgcatataggccggatatcatgtttagtgtttgcatgtgtgctcggtttcaagccgctcctaaggagtgtcacttagtggccgtgaaaaggattctaagatatttaaagtattcctctactattggcttgtggtacccaaaaggtgctaagtttaagcttgttggctatttcgattcggattatgccggttgcaaattggatagaaagagcacatccggtagttgacaaatgcttggtagatcccttgtgtcatggtcatccatgaaataaaactccgtagccctctctaccgccgaggtggaatatgtttcgaggggtagttgttgtgcccaattgctttgggaaacaaaccttgttggactatggcatatccttcaccaaaaccccactcctatgtgacaatgatagtgccataaagatagcccataacccggtccaacattcaagaaccaagcatattgacattcgccatcacttcctaagagaccatgtttccaagtgtgacatagtcattagccacataagaaccaaggatcaactagccgaaatctctaccaagcctcttgatgaaacccgcttttgcaagttgaggaatgagttaaatgtcatagatttctctaatgtggcttgagatggtgcaccatggttgcttcttttgcagtgtgtatatttgctctcattcgcgcttatgctttggaattattgccatttggttcttcattgcaaaaatggagcatgtcacattaagggggagttttgcactcttgcatgtgctctacttccttttatatgtgagcaaatcaactagtgctgctagtagtatttccaacatgcccaagtcaacataagtcaaaacttttgcaaaatcaaagtaatttgaaaactatctcttggaaaatgtttcaaaaggttccctatatgttttccaagcctcacattgcaagaaaaattatttttgaatgaaaatgccattttggccctcttttgaagacactagattcttagttctggccaaaatgaaatttatcccccaaattgagattgagaaggaatttgagaaaagtttcaaaaaaaaattggtagagaggaggttttgaaatgtttttggtattcaaacctatttcaaaaaccaaatcaatcaaaagttatttgaaaaccaatttggcgcaaaatcccctatagaccataaaaggtcacctcctagcacttaagtgagttttgttgcaaatcatcataatcttcaaatattatggatggttcacaatatttaaactcacacatttcaaaatttgctccaaaaatcaaatttttattaaatttcattgtgtgggggttgccggcttgtgcaagggctgtgcacagccagctgggggcctggcagtctgaccggcgctatatgcgcggtctgaccggccagctgtggtggtctgaccggccacatagggccagtctgaccggccgaggtgggcccagggaatttttattccccctcttcttctacccgcacctacctctctccttctcatcccctcacttccccatctcgaaatttctaactctctctcacctcccctcaaaccctaactccttcctccaccaaatcccctcggtttgaccgtggatttctctccggttacactgtaagtgactctcctccgcttccactctctattccatggattggtttgtatttttgttgagtttttgatccatggcatggaaccctaggtgaagcacgaggtgttcttcgatttgcaccaatagagggtagtttcttggtgtgattcaactcctccaaccggtaaatctctctccctctggtgcattgctctcaaatcggtctatttcaatctctagggtttagggtactttcccattgttccaatcttgatgaaataggttcaaccctttgatgttcatgttccaatcctgtgctatattgttctagcaaattttagactcaaatgtgtagatatgaaaatatttggatgcttaaacttgtgggaggaggtctgcctggagacacaagcggtttgaccatgggtcagccgccggtctgaccggccggcagccgtcggtctgactggccaccatgggcggtctgaccggcctgatgccttcggtctgaccaccctactggctgcggtctgaccacccctccacaggatgtaggcaaatttttacctctccaaattgtttctagaattattgctaatatcctatcatcctttgttctttgacagtgatgcctccccgcactcgccatggtcaccgtacgcccactccggatcccgtgagtgagactgaggaatcgagcggagaggattacgctcaaagtgatgaagaggttgaagcaaatattgagggggctagtgaggtggcaagtggagatgatgtcagtggaagtggagaggatgaggatgaaggaaatgatgatatgcacattgatcccttcatccagtttgtggtgaacatgaggaatccatcgcagtataccatcttgaggcatcatgatcagttcttgaggcctcgagacaccctggatccccgttttcacaccgctttccagaagactgtgtatgaacaggtttatgcagggaaagcatttgcaaagcataagtggatttcttggagagacatcaatgagactccagagtttgagagcttgcaggatctcttcaagactgttggtattgaccggattgtgaccctcaagcaagactacaatgaatatttgatccggcagttctatgctacagtgtgggtggctggagactatagtgagatgaagtggatgtccaacaccctccagtgttctatctctcggaggcaattccggcggctcctcaatattcgcttggactttggagatgatttgcatgaggagcacactcacaattcactctccatagactatctctctcagttttatgaagattgagtgtggtacacacatgggaaggttgccggcttgaggactatcccagtgtggttaacaggattgtgagagctaccatccttcctcgccttggcaacaatgatgacattaggggggtggcttggcacgtcatcgatgcaatcattcagggtcgtcagttcgacattgtgtctctcatgatgcaagagattgccatctccaaggggaccttcactcagggaatctattatgccccttacatcatgaggttgattcaagacaagcttggggctgctgggcaaaatttgaagaagcacaagcagtacaagccccgccttcagcttggagctccccgtgctcctaggacggtgccctcttctcatcctggagctagctcaagctcagcacctcctcctcctcctgagtatgatccaaatgctttcttccatccacagtttgcttactttggaacgcaacccaatgaatacttcaacccggtacttggggctattaataccctaagtgaaagcattcaacgcttgtctaccgggcaagaagcattgcatgaggatgtttgtggcttgcgcaccgatgttggagacttgaatgcttccatggggagattgcacactagagtgggtgcattggattctcgagtccaaatgttggagagcacccaagcttttctatatcatcgtcttcctgatgctcctcatccttcctcttcggcgcgtcctccttctcctccacaagaatgaagacctttttggtacatgatgccaaaaggaggagaaagatgtccttaggtgtgctttatgtcttgtgggttgggactagtgctagtaaggttagtcacctcatatttaataggttaaggtagtttgtgctatattatgtatggatatgggctattactctatattgtgtgttctttatcgttttgttggactctatgtcatttggacccttcgtggtcttgtaatagcctatgtttttttgtgagcccttttaggatgatttgtgacttatctgatttgaatggttaagtgatgtgaacttgtgtgatgatggatggtgtatgtgatattgatatatatgtgaccatcttatgctcatggatgaatatttcttgaagttcacattgaaatattgcttatgtgtttgtgcttgttgaaatgtgatattgaagtgtgcattggctccatatttgttgtctatgattgatatgcacacgtttagggggagcttttgattgtcattgcaatatatgtccatgtgttctatgtttgattatatatatttgtggtgtttgtcatcaattaccaaaaagggggagattgaagcatgtaggcccccgttgtaaattttggtaattaataacaagcactaattgtggactaaccgttgtctttgagctatatattttaagttaggtccacgtcatatgtgcgcatggatgattatcgatggattaaaattgacggcgcaaagcaaagggaaagaagacggtaaaactagtgctttaatttttgaattgatcgaggtgtagggcgattaaatttgctagtttatttttagtttcgccgtaggggtaatgacctagcaaagggatgattttaattgccacattaggtcattatgcatttagacttgtgctcacatttcatctcacacactcaatcacttttcatttcactgggttcggcctgacaggggcggtcagaccggccacacagtgccagtctgacaggtgtgccctggccgatctgaccggccatactacggaggtctaaccggcggcacatgcgcggtcagaccagcccgctggaggccgggatggtgctactcggggtggctgatacagagccgacggagccgtattcggtcagaccgagctgatggcggtctgaccgagccgaggccggtctgactagccactcaatgtcggtctgactggccaggccgatgggccctctgacagggctacaacggctagttttctagccgttgtagagtagcacggtctgaccggccacatacctccggtcagaccggcagagcacagagttgggggatttcgcccccaacggctagttttggttggtaggaatataaatactccccctccagcagcaagggggctctcttggcacctaattcaattgcatacatcccttgcacctctctcacacacccttgagcttagtgttcatccattgtagtggttgaggttgttctagccaagagtcaagtgcatttgcttccattgtagagctagtgtggcacttgattgatcatctccacgccgggtcattgcttgttactcttggaggttgccgcctcctagacggcttgtggaggagttgcccggtgacctctccgagaagattgtggaggaggcccggcgccgatttgtgagtggtctggagtacaccaccttcggagtgaaggaagaactaccctagtgatcgaggcttgggtagtcctctccatgggccggctcccgccttgcccaccccttgacgaagggggcgtgcggtggcttcgaggttgagcactggagttgggatcgcctcaacggggagtaggaaaccggcaagttgccgaacctcggtgaaaaatctcttgtctccttgtctcatttacttgttgcatttacatttgtgcaatttacatttctagagatcatttcaccctaggattgctaaacattgacataggagtgtgatttactttcctagagatataatagagccactatcaccctaggattgcaaaacataacttagttacttagttagagttgaccctcaccaagcctagcaacttaggttagtttcgattaggtgtcatttagttttaaatcgcctattcacccccctctagtcaacatctcgatcctacaataattacgaccatgaaacatgggtagatgtctcgagcacgcagctcgtcaagaaactaaatgtctaatgatgtaattatcccattttgtgagctagtggtaattaagcaaggctaagcatacatataattctagcaagatcaacataagtatcacgagctagataaattatcacccaaggttgacaaaggacagataacaagtaaacatggcacaagcgagcagataggtaaaccctattcccatgtaattggcaaaacatgcatatttatttgcaaacggtaaaacatttataaattgggatcaacatgctcaaggggaatgtgtgacttgccttgcttcttcactttgatcttccgaacacttatcctagcgaccgcggacttccgaaatggcgaaagctacacgctggcacgcaaaacaaggaaaaacactaataaacaccaagaaaacagtacataaaaagtaaacaaacatgtagatctatattttagatgaattttgcaagttgaatggctcaattcggagttcgtatgaattagaaatgaagtttagatgttttgagccatttaaatgaatttatagaattattaatgatttattgcgcaattattatttattttctcaaaggacaagttaagcgctgacgtcagcaaagggccggcgtcgacaggcgggcccacacatcagcggctccaaggggaggacacacggtggaccaagcccaccgcggcctaggcggcaccgtggacccggaccacgggactggtccatgggaccgacggctcggatcggccaagagccgatccaacggccaagggcggcccggctagggcacggcacggctcaaagccggccggcgagtggccaccggtgacgtgggacgacgcgcggagggcggcaaaagggagaggaggaggaggcggttctcaccgtgcgaacggggcggcgagacgaagacgaggaggcggccagcggcaaggattaggcggccgcgggctccccggggtggtggcgatggcggtgcttcaacgacggcccgcggcggatggaggccgggatttcctggggaagaagatggagtggttaggaaggaaaataggcaaccggagcggcgagaataccacgccggagagttgaggaatggtggggctcaccggtggccgagagataccgagctccggtgggtttccggcgatgaacaacggtgaccgaggtgctgcacggcgctgtgaggcaagaggtgagggcggagcaacgcggcgatggctaaggcgaggacggcacgcggctggaggcggcgtatggtggagctcgggtgatgcggtggaatggttgttccagcggcggtttgagggagaggagcggttgccggggtgctacgcgatgcggcgaagctgatggtggcagtggcgcggcttagcagtggctatggcaggggtggcgcgctgtcggagtcggcaaaggcggtggagagaggtggtgcgcgtggcggcattgtttcggatgctaacagaggaaatggagtaggggacggggcgtggaggagcgcggtgatgccagtggtggtggcgtgtggatggaaggtcgccagcgaggggcggcgatggggatcggcgcggggagagcgagggagggcgtggcgggcttgggaaaaatgggggaaacggataaggagagcacggggaggccggggagtggcgaatttggggcggcaacggccggcgacgcggagctcaacgtgggcggagtggggctcgatttgcgcgagggggagtcgatcgggccgagaagggagttgtcggcccgagagggaggagggaaggagagaggtgcgagcgggccaaggagggagaaaagatcatgggccaaaaatggcccaaggaggaaggggagatttatttaattgattaaatgaactttgtgacttttaaaattagatattgagctccgaaaattccgaaaattagtatatcagggcacaaaaaatattgcaaaatattctcggccaatgatttttaaaggaaagtttaattccctcaatatttcacttgattaaattgatttaacttttatttaatttctagaaaatacattattaattgattttaaatcccgaacgaaaatcggggcgttacaattattgttcaccataatcaactaaaatatagtgattgctttggtgaattataaacactaaagtagatattaattgctgagacatggtgtttagtttattgttatctagtaattgctgtgtatcccacagtacgtttgaggtaggttgttgacagctgttaagtgcacaaataacgccgtcaatacctacataaaaccataaatgtgaaacatccaacatagtggtaggatttatttctaacaatttccacgagtgttggtgcatattagtatgcaagtgatcaaccaccaaaattgggagagaatgagcataaagaatggaaatatattttgctctgatgaactcacatggttttaagctacaatatataaaatgtgcaatcatttgaagccaaaacatggagcatcatgaagtggggcccacatgtcagcatccggaagaaagatgtgggccatgggagccaaccagggt

SEQ ID NO: 67264 - DNA, 4568 bp, Oryza sativa
  unsure (1)..(4568): unsure at all n locations
taagtggcagcagatgagagtgctatcatttattaaagatcagtttaattcagatacaagagtcactaatttataagaccaaattagagtggttaggtttatgaattatgaagtacaggaagaagcttgtagccgtaggaattgtctgtgcattaacagcaccctgtcaatctgccacatgctgaaatactgaccattcgtattgcttatgaaacaaaccattgacttttaatatacacctaagctttgtcaattgaaacatactggcttaaaagttagaatgtggttatgtgaaacttaggcttcctattaccgatgcagtgttgtttaaagaagggttagataatcggatgtaaatccaatatgaaactattggttctatcttattcaaaatgccctcttctttagttaaattgtgatgtaggctgtctttcatacgttgacacaaatctgtttcgttaggtcattttgtttcaatctcagtaatattctcacagtaacatgtacaacattgctgattgtctatccacattataacgtgaatttgtttgcacaatggactttcagcatttaagcgaacaaagtaactgatttgataatctacacttgcaggttgatttttttgacctggaagttctatataagaacttgaggcctgaatttagatccaagtatgctattgacagtagcaagcacccccatctaaggatcatgtcaaatatgcgagaagtatgcgcttgttatgatttctgataatcagcttgtacatatgttcatatatgctaattaattatttcttctttttttgaagcggaaatattattcaatgatcagtgcaaaacatcacaaacaaatatgtgaaattcttggagaactcattactttgaaaccatatatcaaggtatctccttagtttgaactacgtagttaagttgaaacgtcatgacctacatttatttcatttgcagggctctgaccattattatgaaattgttgaacgtattggagaaaaaattgagataccatccaggatctttgaccgtgatgatgcgaaaaagtccatccgtgtgagtatttgctattgatttaggaatattgtattgaaagactcgcatacttaccctaattcttaactaaatcttcttgctaggtcctccttcaaatcttacatttctgggaacctcagtttcatcctctaatacgggaggtaatttctggaatttgtgagagcacttttcttcttttttttcattgtttgtatataatgttttcatcatatagggtcacaaggacttccttttagacatagccaggcggttggccaaggcaaaagcaacagaatattctgaggtttgttctttttttctttttctgctgtaatcttagaatactacttaaatatgtttcctttttcagccattgataccacaaatggaggatttcttgccacatttacaaccttatgcattcgcatttattgtggctacgctaaaagatccaatggtatgacattgaatatttcatgcccacgcctagggctaccacagtcccactacggcggagtagcgtcgccgcgcgcctcccacacccacncacccacaccccccccccccccgcccaaaacctaacctgccccgatcgagcccttccttctcccagagccgccgctcgatcagccgcccctggagggagcgcccatggacgccgccacaacgtccgtccgcgccgtcgactgcaatcccgtgccggtgagggatttctctgtactgcctgatcggtggcggtgccccggtcatcgtgatggttcggggctacgcaaattttatctcgctttggcggggctctgtccgatgagttgtgcaacagaatttgatcattttttttatttctttttgcttgcttgatttgacgctgcaggtgagggatgaagggtatgtcgatgcgttggtgagggcgtcgcttcattttatcaggaaggatttccctcatgaggtccggggacatggcgtcagattgctacaggtcgtttaatttaattcctgctgtgctgacattatgtgctttgtcgtggacttgatcggaggataaccttttcgttgtgtgcttccatttatctgcaatttttgcccatcctattgcgtctaaaatattgggttgcacggtttagtgggaaggggaagtggatgaagttctcaatatttgcctaatgatcaaatactttagtgaattgcaactaaatggcagcatatagcagatgatattctccacaatgacattgcagatagaaatttaaaaggagttgggtatatatgtttcgtatcaaatttaggaagaataatcgtgtgatgaatcttggatctgattcattggattttactaccaacatgtcctttgaatcagttttatgattcattgtattatgctatcatcataattatatcattcaccagccaccttttgatttgtcttatcacataaggtactaactgtgacaagttctgatttgcatcgcataaattcattttggtttttgatacttgatgatcggcatgaaggaaaacctagtcaaatctgtcaaactaaacagaccagttatttctctatattgtttctataaactttaccacaatttaattgtttttccctttggtcatttcttactttgaactcccatgatgattagtagtaaaccccccttcaactatgtctgagagagctagttcctgcaactgttcctggtgatgccaggatgaccaccgagcaggtctcaactgatgttagtcttcacctcgtggagcactctaatggtagaagtgaacatgggatttgttagtcttcacctcatggagcactctaacggtagaagtgaacatgggatttgcagtttctggagagaattaatgttgtggcaggtggatgggagattcagagcggcggacaactccgggaatagacaggaaggaagggtagctggatgggttgctagttgtgagcttgtgtgtgcggtgtggaagacaatgtgagcagtgttatggtcatacataatgggagaagacgaaaatgtcaaataacttaactttgtaaactgtcaattgcattaaaatgtaccagttacttttggtggtataaatctaactctagatctttcagtggcacaaaaccaattttgcctttcagttactttcaagtttggatgtgtcctgaaaatttgtactacaacataggattttactaatcatgtacgtattttagtctaattcttgccattctgtttgacatatgctccagaaatgcttcaagtgataaccattatcgtcctttaattatgtgtcatgcagggaagaaatgttaaggttgatgtctagaattgcactaacaagtttgctaaattttggttatatctagttggctgcccccatgtttccgaaagaatagttggagagaccttggaaagggattctgatgaaattccaaatctagtaaaaatagttgccaaatttttttatccacttccatgggcctcagaacaaaatccccctaggcacttaagtaatgctacacctacgttggatgtgatgtgagctgcagcagccaattccatctatagggttgtgccaactcttaatggatctgactgggggaacaatggtcagatgatggttattgtggaccgattaatttattgatctcatacctttcattattttgttgctatctaattctcgccatttcggaattactctattcaagactcacacttgcagtatttactataatgaagaattatgagcacaacctttcacatcctgttttcctttatattagatgcagataaggcatccgtagttgggatttcgtccatgagttcttatgtcaggcctgcagttgtttccaatgtttatgctatagaactgtgtattcatcaccttctgtattgttattttgcagcatttgatgagattcaggtgggaggaagttagcatcataaattgaagcaaatttgctcatgtttttagtttattaggagttgagttgggagttcccgatgatctggtttggaagaatgcagcagctgatttagttgcagaggttatgatttaatcttattttattgtttgcgttggtaccgattcatttcttatgtattatgttgaaaattcatactatttctcaataacaatttaatgtagcaggtggtttggagccatggaatttctctcttgcatgacctaatcccatgccttgtgtgtctatcagcaaagggtgctactgaggtaagtttgtctattttaaccaccactttgacctatttgtactgacatttgtgtgactaatattattttgttttgtcgtgtgaattgttagaccgaattagtttgctttattctgaagtcaatttctgataatcgaattgctcatgtttcacattctggaggtaagaatcataattcttttatgggtagtagttcaactaacaggtaaattgacaccgttggttttaatcggtgataaaggcgaaccgctttccttatctgagttccttcagcagattttgccattcatttcct

SEQ ID NO: 67265 - DNA, 1246 bp, Oryza sativa
cgaacccctagctggcccagtccagcccatattcggtatgacgattgtactcctcatcccaatgatggttgtggccgtttctaccggtggaagccgtcatagagaggacacttgtcaagagaagataaagctagagggaatattctcataggatgcttggagcatctccactcccccaaggcaactctccacctataaatatccctctcctctccctcattcacacacaccaaagcatgagctgaattataagaggctctagtgtactttattgcatattagaatagggagagagtaaggtagaaggaatcggaggaatcccgaagttgtcggtaatctcctcctacttttgtatcttgttaattactctgctttaatagaaatatcattctgagtatttaagatttgcttagtcataattactttttggttagttcctaattagcatacaggatcattgttcactatagtccatttatttgtagtgattgctttagtgtttgatcggcactagagtagttattaattgcgtagacgtggtgtctgggtaattaatctctagtggttgctatgtatcccacagtacgtttgaggtgggtgtagaggtggtgatagccctcaagagcacttatgtcctccctgtccacgtacgtagtagagcgatatctgggaacagcggattgccagtgcctgaagtattgtgttaggattaaacttaagctttccctagacactgtttctcattaggaaatcctctctgccctctgcccacattagctttgtgtccttggatgaaccggaggaagagataatcacacacgttcccttggattcgatacccttggaatactctgtaagggaagtgctacatcggtatatctgtgcgcttgtggattctatctgtgatcgtaagaaataccaacaagcatttctggtgccgttgctagggaacggttgctgtttatttccgaaccttgttcatccttatcctttttacctttttattcaacctctacccctgctatcccatagaagtattcctgttcaatccttctcgaccatggagcaacctctcttcgagttgtgcgctcctcgggacgaattttacgagccacctccttcatcggagccaattttaacacctagctatgaaattcgtatcgaattcatcagtatggttagggagaaatctttctctggtttaggccaggaaaaccccttccaccatcttcaggaattcgaaaag

SEQ ID NO: 67266 - DNA, 9365 bp, Oryza sativa
  unsure (1)..(9365): unsure at all n locations
attgacatgtttgatactgatgagtattatgatagttattggggaatgatgggcatgacaatgatagtagagataacatgctggatgccgcagacccaagaatggtagtaactgcgttgccatctaatccaataatatatttatttgctgtttggtgttctaaatcagctcatgaagaacacagcagattctaacagttcgaatttcccatataaaactataccttccataagaagtgtcacaatttgctaagtttcgttttgattttccatggtaattaggtatttcatttattgtaacaccccagcctctgtattgttccctgtctcttccatggggtcaggttcacatgcggatagcactcgagtactcgactttctcttttgtcctttcttcatgtgaaaaaagttgttaacccagaagtgctattgttggaggcttgcagcactctccgtatggcactaatcccatcatgtagcacataagttttcactctaatgggcgatgatactacatgttaatgaaagtgtttacccttcaactctttctagagtagcaatcattttcactaggtattagatgcacatgcttttaaagatgcacactactatgttgtatatgtattctattgttctattatgtttcagggtaatgatggagctagacgagcaaactctttccaccacttgggctgtctactccttgctgagcataatattatatctgaagcattccttactgcgtcatcctggtctagatgtgtcatcatgtaatttgttattatctaacattaattgggtggagctactatgtgcaaccgtagtaggcttcatgtagtagaaataattacttgcatcatattcttttctcttttaggattcagcgatacaaggaagttcttgtatactcagtcctcttagcaaaatttgaacccagccagagtgggaaagcaaatacacacattatgcatggtgcctcacacgtctattttctaatagacagtttgtgaagaatgttcatgatgtggcgaagacatgggaagggcagctcaaaaggagagcagaagagtctcatgcaatccaaatgcctgataaatactcaggtagtctcttagggttgatccttccattgctcctaagggtatatctccacataaaagttcacattatcataagattatatacataatgatgttgaattcttgctttatttctagttacttttgaatcttgtgaattatttgtatatctgttgacttgaaattattgtctttcagttccttcaatgtgtacatgccctctggaatcgagatattacttatgatctatcaaaaaagtttgcaaaagctaaaagacttgggatcgatgaggaggaaggtttccaagaaattgagatgagacaatggctacaggatatccgagagattgggtatgtaccatgcttgctcagatactcatgcagattctacttgctgtgttttcctctattatatgtatttcatgggtacaagagtttttgactttttattttgtcctgtgacaaatgatatttttcttcagaaaatgtattaaattgcagcaggcgcacaagggcaagatttgtacatggaattgggaggtatgttctcatatttccttgttttcgatgatctcaactacaatttagtggaaccatgatttttggattttatcatctattaaaacatattttttgttttatgcagtttgaagatgaatttgaagatatcttccagtttattttgagatgatgcaagaagtggatacaatggttgggtgttttgaggtaatttttccgtgagcaacaatagtgcaatgcaaagaatgcttattatacgtttatttaaagagtactacagaatgcttgagtgttcaatagtttagctaggtattagatagttttatccattagtgtttagggctttaatgtgattgggaggtgggacatgggcgataactgtggcaacagatctgtgcatctactatgtagtgagcatctattaacatccttacgaactgcagtagttctagaaaccaaatatgatattgacaaggttcgagacctgctcccatatcttctatggttacccctacactcgggaggtctgggggctggtcaggggtcgtgtcggccttctttacgcagcaccggatgatgtcttctcatcctggtggtgtaaagtgcgaaaggcaatcgccaaaaaggataggagatctttcgatgcgggcgacattttggtgacctggctgatttggaaggagcgcaatgcgcgtgtatttgagggtcgagcctgttcgcctgtcaacctttctgcagccatagaagatgaatggagaacttggattgcagcgggcttgattgtagcttcgtaagcggcagaggcggccgtgtgctgtagccttttctcttttctgtcttctcgccctcagattgccggcccggcaaaaaaatattgacaaggttaaaaaatcaatatagttggaatagccagctccatgtgctatgatgcatggacacagatgcgtatctctgaaatattctattgcatgctgccttcaatctagtgtagctactgaatccaacatgctgaacttaggaaagaacaagatatcagaacaactcatgagagaggggcttgtgtgcaacttttctgcagtgtcagtgcatgtgttattggaaactatgttcattcatcttagtgccgggggccactaactctactggcagttggtaaatcagaaactactctgtgttctccatgcctagttatttatgctctagtctgctagctattaactctcanagctaatagtgcctagagaagacagccattaggagtctgcagaactattcagtagggattaggtcttttgtgctgtctttcctgactcctgtttgttcagtgggtctcaatattcacatatgcatgattcagtatgtcatttgttctgaaatgttgtttactggaccaccaatttagtgtggtaaggttggcgttttagatatgtgaaaacttaggcttcctattaccgatgcagagttgtttaaagaagggttagataatcgtatgtaaatccaatatgaaactattggttctatcttattcaaaatgccctgttttttagttaaattgtgatgtaggctgtctttcatatgttgacacaaatctgttttgttaggacattttgtttcaagctcagtaatattctcacagtaacatggacaacaatggtgattttccatccacattataacgtgaatttgtttgcacaatggactttcaggatttaagtgaacaaagtaaccgatttgataatctatacttgcaggttgatttttttggaccgggaagttctatataagaaattgaggcctgaatttagatccatgtatgccattgacagtagcaagtaccctcatctaaggatcatctcaaatatgtgagaagtatgcacttgctatgatttctaataatcagcttgtagggttccccgtaaggaaaaaagagtacaacaactattttacattttagcatcaattacttcggatcgactattttacccctattttgatcttcaattttgattttgcccctgtatttttttaggttttcttttttgcctctacttttttgaaatgaaagccaactttgcccctacttttttttagaattacatagtacaacgtagacacttacaatgcacgcgcactcacccatatgaacgcacacacataaaccctatccctatgagcatcttcgaagactggactgtcaaatccttgagattgacgaagtcatcacagacgtctcgctgtcgacgggtacgttgactaccactaaaagcacaacgacgttaaatcctggaaaatccgctcccatgaggagtcgaacccatggatggacacgttgacggagttaaatctttggtgaaaagacgattatgctcttatttgatattgcatatttgtctcaatgtttattcaataatatctgcccccattttacatgaaacttgcattttggacaaacttttacaaatttgacaattttgatagaatattaaaaatgaattggaataattttgccacaaattttttgaaaaaaaaaggacagaatttgggcacaattttgacatgtttttacatagctaacaaaaggcatgtagcaatcacaaaatcaagcaaatccaaatccaaatcgcctgctctctgcatcaagccgtcgccgcctcccgcatgaagccgccgatgcctaattaagtcgagacgccgccgtcgcttgctcctcgcgtcaagccgctaccgtctggacaagagcctaccgtcgtctcgtcccctcgtcgagccgctgtcgcttggcttgcgtcgacacgcgcagccttctgcttgtcaccattgtttggttatcggctcaccaggggtataaaggtccatcaacgaattaaaaaaccattattacttctttatttctctacttctttagctccataatcccatgtcgactaattacgtctattccattaaaaaaggaaaaaaaattaaaaaccctaatttttagggtaaaattaatattggacatcaaatagggataagaacgaaattttcccatatataaaatacgtttttcaaaagtagtaaaatgtggcaaaaaaaaatccagccgtctattgggacacctcctaaagctaggaggaggggccccacggtgcagtttctcaggtgaccgcgaacgacgcgaaagcgcaggccaaattagggatggcaatttaacccgtttgcatgtttacccgtgggtaaaagccctaatagtgttggatttgttctctatgtaccaataggcatacgggcacgggcatgggtagtcactacctacccatgcccgtttcacccgtttacccgaaaaaaccaactaacatgtgatccctcggtcaaattagtatagatgccaccatctagtattgatgaacttatgtttgtggcaatattctttctctttttggactcaaccgcaaaggattcatctaaactaattagcaaagtcttgctttgattttctggggtacttttcaagtgtaccaataaattgtttgttagtaaggaatcaaatgctggagaattcatttctaatagatactcaaatgaaaaatttcgataccaaagtccctgttacttctctcattgaatctttagcaaaagctcaattttgttctgcaatgcttgtattgttaaatttggtacaactataccttttctttaaactatgataatgtctctctgcttgtggagatttgtgattaaagaaagtgttgaactgtgagtatgtggcgggtaaacgggcatgtccgcgggcacatagcgccggcgtgcaatggacgtgggtagtgtttcttacccgttatgtagtaacgggcatgaattatctcgcgggtacggcgtcatgcccgactgccatcaaccgggttccggatccggtgcgatcgcgccccgtcggagtcgggagcgggagcgggtcggcctccgcctccgataagtgcacgcatctctgcgcagcgcgaggccgccattctgtttttcgcctcggggagctaagccgccgccaacccgctacaaaaccctcgccctcatcgtcgtcgcctccggcggcggccgcggccccacgcaccgcccgctaccccaccgtgcgcgccgcgcttggccagcccggccgcggcccccctcaccgtcaccgaccaggtagggagggctggagcgcagccattccggagagtcgtcgcctcctcgcaccgagcgagcaggaaggtagcgggggcgccgtgcgcggcgaccaggcagggacggacgcgggcatccatcgcctcgtcgggcccctccactccctccccacctcgcgccgccggttgacgcggcgcagccggagcccccccagagcgcgcgctgcatcaccttcgccggcgttcgtttcgcccgtacctgcggaggcgggtcgccgacaccgagcgcctccgtcgacgcgacgccgcggcctgtctgcgactcctcctccttttgccccaaggtacaaaatagcaaacatatgctcagcatttcaccttcatatgcttctatttttgggaatccttttgatttctttaagataaaccaagttttatccatgttaaacagttacatcaagataatacaattactatggaggcaattacgcttttgactctgttataaagtctaagccaatctaaccttgttttctcaactttgctcatttcaccctatggacatgaccttattatgtgagacaaacgtaatggtgttaacttggggccataatgcatgccattaccttattctctcggaatttggcacgtcgtattggagaggcatacttgctgtgcgctgtgtgtcgagacttgagagtgatagctgcacattgcattagccaagaggctcggcggccttcacaccaaagagactaggtctggtcatcctcaacggtttgacggtaggggtgagcatcctcgggtgttgggcgtcgaaacgggcgtaggggatctctgtggtggcaatgggctgtgggcgtaagcatcgatcaggtgctccaaacactagaccctcttgtggaagccgggacataattggggaacgatgcaaattctttatgttttgtgtgatgaagagcgcttgccttactgccgacaaccttcaacgcaggggctggcatcttgccccaatttgccacctctgctcaaacggcggcgagtcatgccaccacatctttagtagctgctccttcactcaggaggtctggggccttgtcagaggtcgccttggtcaccttcaaacaacaccgtctgttgatctctcctggtggtgtgatgctcgtaagtttattgctaagaaggagagaaaggtatttgatgcgggtgttattttggtgacttggttaatttggaaagaacgcaatgcgcgtgtgtatgaagggaaaacaagctcccctgttaatctatgtgcgaccatcatggatgaatgggagacctggacagctgcggggttgattccagctggctgatctgtggttggggcggccctgtttgaggaggggtttttagtagcttttctttgccttgcccttttctcttttctgctccctgagttctgttcctggggtgataggataatttacattctcgcattctttcttaatatactctggccggcaaagttttgccggcccggcgaaaaaataattggggcaacatgttgcaccacgcatgatagtcgctcgggagaattataggatctctaggagaaaactacttttaatcatgaacattggcttgcgctactccgacggtttggaaacatctagatgcacttccactgtgtaactgtagttctgataccttatattagtacagatgaatagagtccctaaaatcaagcctaaagaagctgattatcacgttcaacaattgtagcatatatgttggcattaaataaaggtacataaacctggccacacccaaactagtccactattgtctgttcatttatagtttgctttagaacagcccattttactcaaatgctcgctattcttattgcaggatacaacatggacacgatgtcagataatacaagccacaacattttgtcccaggtaaaattttgtctcaaatctcactcatccattgatcaatggtaaagctagacatacaagcattttatagatggcaagttaactaaagtgatgttaaaggtagaatattccattgaaatttaatattttcttggcacattccaatacgcaaatatattcactcaattgtccataaactgcacatatatactcaattgcatgtttctttgttgtgctgttcgtgtagacataaggttcaaaaaactacatggttcaataggaactttgacagtgcaaatcaactgaaatatattatatgtactctcctatgtgtttccaatgaaatatgaaattttgtcaaaactgtttgagtatatattgatcaatctatatgaaattctcctaaaacacatatatgattgttttgtagctttttcatgtcattgtgctgctttcttttacttctaaccacttccttgatctatcgggttaccatcttcttaggtcaatggaagttctcaaatagtcataacagacagcaaggtccaaaaacttgggagttcagcaaactatgtgaaatattataagggtactgttaagtttggtaaaggacttagaatacaaaccaaagcatctgtgcttgcatttacctcatgtgatggagaagctgcagatgccttgtatgtgcgacttgttgcagttaatagcccattcacagtcaaaccattgtcatatggcagaggtattcgaaggtacagggaatacaccttcttagctgttccaccgccaagttgtttgctgtctaactacactgatggattcaatgataaaactgtcagtatgaagagattcactgaagaattcatcaagataactgggtatgtcgttaatgttttggcttatctgactgaatttatttatgcttgttgatgcatttactaattgttttgtgtttggttagggatattgttcgagcaattatcacccttcattgccaaggttactggtgttctggtttgaaagggaaacacatatgcatctacaaaatggagaagtgtactgatgcaaagatttggagtttttgctttgcaggtatgaatttggcaaaaaaaaagaagtgtttcgacttatatagtcagtataaattgctatgttcatagaaagcctctaataattttataattactggagaaaatgcatgattaattgtgtcaacctagagttgatatttcaaccttgaactattgcctcaatcttaaaacttatcatctctaaattctataaccataattcatgcctttatccaatatgaaggggttttaaggtttaatggtatcctagttatcgtgaagtttatatacaagttgaccttttagttatatatcagttgtaaaccaatgaaattatagaaatcactctataggttacgtgcagaagttgtgaagaattctctcataattaaaatatataggtgaggtactactattatacatcctaatgaccatgtaaaatacgtatgaaacttacaaactacaaagtaatgttgacatagtgcaaattcattgtttctgatttcatactttttatgaacgaaatcaaattgattcttaaattttatatggttgtaaaatactaccctgccctacatatccctcacatttaccttctgtcaaatatttgctaacccgttatacatacagggggaaatgaggca

SEQ ID NO: 67267 - DNA, 2085 bp, Oryza sativa
gaacgaacatgagtgttagtgaacgaatgcaaacgaaggtgaacgaacgcgaacgaacgcttaacgaatgcgaacgaacgtgaacgaacgcgaacgaaacgttaaagaaacgtgaacgaacgcgaacgaaacgtgaacgaacgcgaacgaacgcgaacgagcgtgactgaaacatgaacgagcgtgagtgttagtgaacgaacgccaacaaaggtgaacgaatgcgaacgaacgcttaacgaacgcgatcgaacgtgaacgaacgcgaacgaaacgttaaagaaacgcgaacgaaacagcgaacaaaacgtgaacgaacgtgaacgaacgcaaacgaacgtgactgaaacgtgaacgaatgcgaacgaacgtgaatgaaacgcaaacgaacgtgattgaaacgttaacgaacgtgaatgcacttgaactaaaagtgtgagaacgaacgcgagcgaaatgtgtacgaacgagataattaaactattgttgaacttagcatatatatatatgattatatatacttgaaaacgtgaaatacattatatgttcctttgcatttagactagtacattttttttgcatgttgcagagaagacgtcgctgtcgttgtccctcaagccgaagtggtagctagccctcgaaggaattcgtgcaggcaagtgatgtaaagatgtgattgttacagatataatataagattgttagatttctaatataagattattagattattagagttagcatatgtgagtgttagagattattagattattagacttagcatatttgagtgttagagatagttagagatttaatataagattattagaggtttaatatacgaaacttaattagacttagcatatgtgagtgttagagatttaatataagattattagagatgtaatattcgaaacttaattagacttagcatatatgattatctatcgtacaaatacacgacacttagacatagcatatttgagtgttagagatagttagagatttaatataagattattagaggtttaatatacgaaacttaattagacttagcatatgtgagtgttagagatttaatataagattattagagatgtaatattcaaaacatatttgattgttagagatttaatataagattattagagatgtaatattcgaaacttaattagacttagcatatatgattatctaccgtacaaatacacgacacttagacttagcatatatgattatttgagttttaatacaagattagtagagtgttaatattacgcttagcaaatatttcttctatgaacagatggctgatcacgatgaggaacatatactgtacgatacaatcgcatcgggaagcagccagtgctggaacgaagaagacgggaacgaggatccaaaccagtacttgaacaaggagggaaacgcagagagggatgcagaggggaacgaggaggggaatggggagagggatgcagaggggaacgaggaggaggctagtggaagtcatccctccgctagacagaagagggcacgcgaacaacgagatgccgcgaagaagatagagggtcggcacatcataactgaggtggacgcagacggccgacctagtgccccggcacaagcagccaagaattttgtacgccacagcggttgggttgtgagggataacgtgcctgtcagcaaggtgtactagcgcagaacaaaggcacgcgggggtgatgacagctttgtcccggaatcagagaaagagatgctgtggaccacaatgctcaagatgttcacgctccctacaggtacagagaacatagtgaaacagtggactcttaagaaaatggcagaacggttccagaccttcaagggagatctgtaccggaaatacatcctgaaggggcagacaccgaacttcgacgtattcccgaagctaagggatcactgggacaagttcgttgcttacaagacaggtcaacaagggcaggcgatgatggaaagaaacaaagaaaatgctgccaagaagaagtaccatcaccacttggggtcaagcggctatagcgtcgcgatgccgaagtgggaggagatggaggc

SEQ ID NO: 67268 - DNA, 8031 bp, Oryza sativa
ttaattaacaagtgctatataatatatactagtaattgtatatctaccctgacttagaacttacgctgctgatctatctcacctctctccatccttgcactggaatttttaattttctgcatactagcatattgcccatacattaaaacggatatttaacagaaaattttaacccattttttaccactttctatatatatcttctcttaattcattcatatcctctcaactgataagtgggcactttgaactcatattctacgttctttaattcacaaaagtagggagctagttaggggtgcatggtggcagatttaccatcgccccactactgtttattttaaagtaccatatatatagattaatttcttcatccttccatactggatgctaatcaagcagagtttttttctagataattaatggataactcgactactgctgcgtcatcagaaacgcgcaaattaagcacaattattggcagagttatataggaagagtgatttcttggatcattaagcacatcagtttgtaggagtatcagcaatgatcagccattcagcctgatgaatgttcacaataatggttcctattttttttgggtacattctaaaactctaaattgttaatattttactgaccaccaagcctgcaagcatacatgatcagtcatgtggcagtggtccttaattacataaggaagccaggttttattttattgtattttttctatatatgcaagcaagtggagcatatactagtacagttcatgttcatggctggcttctagacaagtaaagctgtaactgcactatgcaagttgcatatctaagctagtagccccacatatctgatctactgatggttgcatcatggggagtagttagctaagctatctggtgatagttttgcatgtgtgatccacttgccaaccaccttccattggcagaagaaatcactttaattttccttttaaaaaagcggtagaaacttcaatggaaaaagtgtgatcctaatcgtttaatgccacacatccaacggctgatataatgtgtgaatgctgcattcatacaggaatgaaacaaaatcttaaataaatattgctaacaccctgaataggacctagtcatagttgtttctggttaatcaggaggaactaggtcaaagatgatatctttaatttctcctgaaagaaccaaagagcagtgtactttcaaataatgaccctagttggggcatgcacatggatgcatgtcatgagcaaacctttgtgtaaccgtgttgctcttgttttctatgttttggaaagatagcttttctccaagtggttttcaactggactaggagatttgtaaacaatatgcatggtatcatattgttgatcttgtttgtcaacatccaacattttctatctttttggataatttccacccttttctattgggaatatgtacatatcactggtggagaagtgctttttactcccggttcgtaacccctatatagtctcggttttccaaccgggactacgaagccgggattaaagatcgctatctttagttccgggtgaaataaccgggagtaaaaatacatttttagtcccggttggtaacgataaagcatttttagtcctgactaaagagactagatccggttgcttctttattcttttattttcttcattgtttttaatatattgatttcaccccatcccatccccaaaatcccaaatcaatcatcctcaaattgcctccaaatccacaaatcgatcatctcaaatacatcacaaaatcttaaaaaaaattacatcacaacttctacaaaattcatcacatattcacatcacacacaaatcaaatacatcacacaccaatctcatatccaaatcacaagttctcccaaaaaaaaaagaaagaaaaaaacgttggcgcagaccgccgcctcgtcgtgcgccgtgccggccggctggccctccacgccctgccgccgcgaggccgccagccgccggccctccgcgccctgccgctgcactagagaggagaaggagaggaatagataaggagaggaatagataaggagaggaggagataaggttgaggagaggaggagaggagttaacgaagaggagaagatacctcgatccgatcgcgcacgcctctccaatctccgcgtcgatctttttttcccggttggtgttaccaaccgggactacaaatagatctttagtcccggttggtaacatcaaccaagagtaaagcatatggcgatcttttttcccggttggtgttatcaactgggactacaaatagatcttttactcccgtttggtaacaccttaccaaccggtagtaaagattgaaaagtaccctggagcttttaaatcgggactaaagatgtttttagtcctagtttttaatacaaccgggactattgtgaaatctgatggaccaaccaaagatggtttctccacccgtgaatggaatccttataaaccccattggtcatgcacatatgccttttcactttacactttcgttcattcacaaccccatgtgtaaaatattgtcccaaaaaaaggccctggcaacacaagtgtttcatgccacatcttctcactacttttatgccagacgcaagatatatagctaccagcctaccacccacgcatatatatagatatatataatagctttacacataagaaaaattaattgctactaattaaattacgaagtgagcttaacattcaactgattgattacattggaacctgtctacccagattagttaagtcctaaattgacataggtgcttgcatttatgactaattagtattattttagtgataagcgatatgatcaacaaggcgcctgtgatgattttcatttttgaatcttaagacatatatatgacggtctccccagtcttcaagatgctcataggggtaaggtgcacacgtgtttatatgagcatccgcgtctacactgtgtttcgaaaaataatgtatatcaaattcaatgtacaacaattgcttgcatggatcttaggttaattagattaactcttttggatttttaacccgatttatggcatgacaagtaaaattaaacatctgccttgacaaggcataacggtctgtttggttggagggagttggtgatggggaataggagtttatgatatctaggagtttaagtctgtagtttggttggaggacttgggaattcgagggggtttgggatggggaattaaggggtccaattcccacccatctcttacctagggaaggcctgttaattcgtgagacttggagggaattcgatgtgaaaccaaacaagggatgaggagtaaaaaagtaactcccatgaccaatcccaccatcaactccctccttcaagctcccattcctcttcccttctcttgccaaacaggccgtaaaggaaaatgaggcggacacgtgggattcatgtggaattttcggacaacattttcacttgggtgcatttatgtattattcttttcttccttttttgatcaaaagttgtgtactgaagaatttatactcctttgatcaagatttggtgcaagggtgtggtttccaaaacagattttatctaggactaatttcaagaaacattgagtactatgtcctcaaaacaaataatgtattccagaaagcattgcataattataatatttctacaataatttgaaatggaagtactacaactaccatttaattatggagtatatcacaaagcaccattgactccatctactatgattcaaatcctgttgttggtcgtgtgcatccttagttggtacagagaccgaaggctatatcttttttaaaaaaaaataatttattatatccaaatgaatactgtagacagtttgatggctgaaattacaattttctttcctgtaaatgaatactccaattttatttactgccttgcaacagataacacaatttctctttttcacaccaaacgtgccaatgtgcctatttaaccatctttgacgaagatagtgagaaacacgtctttaacgaagcgtgaaatgagtaaaacctatttaaccatgaatatttattttttgagaattaaccacgaataaactaaccatgcatgtctcacactaaaacgaacaaacctatatatttaaccatgctgaattcttgtgtcaggtagaactccacgtcaatcctaaactccagggaaactttcagagatcgatcactcttttctgttactccagggagtatatttttcttcatccgagcatgattcctgagcataaaataatgtcagcagttaattgcactggcacccatgcacccacgacggtgaccatcatactttagttcctgtcagtacacccctcttaatcttccacctgtgatgtgctcctcgccatgtgatcctcgccccctcctcctcctcctcctcctcggtatctacacgccaagatctctctctctctctctttcttggagagttgcagtgtgatctgaacaaaagcttcagttttcagtgccatcttgcgttgcatctcctcctcgctttgccgcttgtttcgccaagtataaagcctggtccagtgaccctttttgtttcgatgtgcagggtcaaaacaaacacacacacacacatctgtctcttcttcaggtttcaggtctcctggctgctttgcttctgctgcctctgtgtggggctccagccttgctcagattgtaagtgtgtggggattagtatgattggttgagttcttggtggttcttggatgtgttgattattggtttgctgatctgtatgcccatctgtgtgtgtgtgtgtactgttgcctgcatctgttgagttgatgcattattggtttcagagcttcagagttgcgtgtatgtatgtgtggagattcagagcatgctgatgccccatctggataactaatcagatggttaaatttgtatcattaatttagttagaacaaaaaactagtatgccaaatgctgggtttttttttttggtgtgttatgttctggttcccctctgctagtgtcaagatccagcatttgttgatcacttcttggatctctgattcagaggccaatagctttcacttcattgatccagttatctgcacattaatgttagtgttagttactagtttcatatgttgcttctagatattttgtctggtaaatctcttgccagagatgaacaaccaatttttattttctacaagtaaattgcaagctgctatgatatctgatctctgctttttctctgcaaaaggatgattggtgatccaaccatcttcatcacttacagagatggggtgtggtgcatcaatccctaagaaatgcaaggtaggagggaaggggaagaagcgccggagcgtcatacaggaggttgccatattcgtgccgacaattcgcattccggtggacagtgatgttgcccatccactcagaggactagtatccaaggagctcgtcgaccgcctctcaaagttcagagaccgcgttgtcgcgctctctgaagatatctgtatgtcactgcctctctggctactggattctgaacattttgtaatgctaggatactgacaattgttctttgattttgttgtgttcggttgctgactacatatgaagattgcgcggatgtttcggatgtttcagagttacagcatgcccttgaggagtacttgccagttgttcttggtttaacaatgaaaggtctggccttttgcttcctaaaatttgtgttaatttcaggatcaagcttgatgttgacagtgaaattgttatgatttcaacagaaagccgtcttgaatcatcggtggaattcagatggaggaccttggatgatgacgaagtgagtattctggataagcgccaactgtaattccagttgtctgatgtttttcattgctttattgaaagatgatattttgaattcaggagtgttgtctttcaagtgcatggtatgaagttctgtcagtcatccacatgatggcgatgcttgcattgtttgaagccaacctgatacttattccgaagaacggtcaagttggaggtgaaaggaaggtatcagaaggtctgttcatctttttgctgtaaatatctctataatttttatgaatattcatacattggtgatatgtgcttagtttttaatcttaattgtaacatagttgaattgtctgaacaatattatagaatgcattttgatatctatacaaggaaattctatcacttgaagaatacattacttactaaatttagtgatattgatgaaaaatgaaacattgactgatttatttctgtagatgcaaagaaggatgtcgtcgattcgttgctcagagcatcaggatgtttagattactgcgtgcaccgtatacttgtacagatgccggcacaagtcaagtatgcctgaaacctgaaatgcacaaatccttgactatatatcaccttttatcaatccctttatggataccttttcagacttgctttgtactattgcaggaaaagttttcctagttattttcaggaaggtatgcttgaggccatttcaattcaagcattggctcaggtagtaaaatgtctcctttatataaatcctatgaataaaattttattttgaagaaactataatgaaattttgaggcatgcatttctttatgtttgtctccactatgaaaacagtgtgtagaaatacaacttggattggcttcagagtgtgagaaggcaactctgtcagtaaagaggaggctagcctgtgagctagtcagttatttctcacaggtaatgcaacttttttatttcagaactatatctgatcatgcatactgaacattgtctgtgaaatttctgatatatctcactattttcaggctcactattgcttatcgggatgcgacacgagcgactcgtttgggaagaagctcctgctgtttctgaagtggaaatgcatggaagccaaggttgcctgaacaaacaaaacaaacacagatcctgaaatctgcaagaaggccttgaattctgatatttaactcaatgttgcatcttgtcatcaggcagtagcatactactaccatggccttgtgcttgacaaaggcaatgaagccagcagccacatcagtgcagtgtgctgcctctctgcagctgatgatctagttgcagatagcaagagggcttgtttgagcttctgcttggcaaaccccatcacaaggtctgaattttctctgagaagaatgtatttttatgtgtgatgctaatcggaatatgcggtgataggaattttgtttctgaactgaattcagggtacctcctccttggggtatcatgaggaatatgcacaagaaaatcccagattctgcgtgcaagagattccaaatgtatggatatctttttgaacaagacaataacaggtaatactctgatctcaagagaaattccatgaaaatgattcaaaagctggaaattgaagcgaaatgctttttcgtgtttgttgatatgataattttctttggatttggctcaagaacatgcttgaacaatctgttcctcatctttattatgatcatactcaaactcttatttcctggagcagtgcacttcaatccttaccagatctaccagaatttgcgctgtcgctgagacccgaagggtatgaactgcctagcactgattcaatctgggataatgttgatagccagcctcagattcagagcctcaaggagcatctggatgatgaagacgaagtggaaacaaaatgatacttcagacatccaaaacgcttcatttcattgtgccatgaaaagtagcattagtactagcaaagacatcggaatgctcaattcagaagtgtttggattcagcatatggcattgagccaaaaagaaatcagaatatgtaccttctgtgtagttgaaagtatctatcactgattataaacagaatcaacaataataggaaagaagggtgtttcttatttttcatcttcttgctgctgggctgcaggaatt

SEQ ID NO: 67269 - DNA, 2292 bp, Oryza sativa
gaggagctatctacctatgtaatgacagtttattcgcttataaattagagtaatagattgtactctattatcgatttgttattgtgtgcctcggctgattcctggacgagggttcacgcacatgtaagcgtttggaattttggatagaaattccgggcgtgacaagttggtatcagagcccccttgaccctaggttatgccaaatggttatccatagaagccctctaaaaatattggaaaagtagaactgttctcctccccttctcttttaattaaaccgaactaatggcacatgcacttcataatctcttttaatggttctcattcaaaatttattccagtgttattagtactgtacatccattactgtactaatggctcattttaccagcaaaagttttacaatattgttttatttaatcttgctgcaataaaataaatttagcatgatgattttataactttcttttatttcttttgaaacctgttgttcaaaagtacaaaaattgtaactttgtttccaactgtttcaacttattttgcaagcttggtttattttatttacttacctatttactttgattttctaactttattcaaattaatccaaaaacttgtgctattaattggataaatgtcttaactccctcctttcacttgtctttagatgccgcgctacaagcctgagtacttgtttggtgttgagggttttgtctaggagttgcgtacgatgtcctttgtcattggatttgggactgcccctttttatgctcagattcctcatgatcgtcatgaagagaagtgccgagtcaaagtcaccttgaacagtaatagcgaagatatcccctcagtgatgttcgaagctggaggaagaaactacatccatgcatgtcaggaagtggcaaggatcgccataggagagctccgcgatcgctacagtgatcagttggccgacactgagtatcgctaccatcctcgccaaccccagggaagtgaccgtggcaactaccttgagactgaaggaattgagaatgatgctactacaagacatttggttgagatgctgtgggctatggatgaaagtcgtgcggagactgtgttagcagctcaggatcatgaagattggaatcgtggtaagatttgcaagctagaagacaaggtggatcgtttggagaaggagctagccgcgttgaagggagaagcaccgccgcagaaggccaggattcgtcttaccgcaagaaagagagctctatttgtccctcgctatcaattggcgccaaaggttcgtgtggtggagaaagaagttgccccaaccctagcagatcctccggtcatcatcataagtgatgatgatgaagaagaatccaagcgcaaccattccaagattgagtgggtagcaactcaagatgatgaagacgagccgaacgagccttcaatcgacctccgatgctcggaagaactagagtgacttgttaagtcgttgtcatagatcgttgtgttagtttgcttgttttaagtttgcttgtgtgtgtctcgcatgtgatttacatcagtggtgggatgtaagtgcatgcgtttatttgcttttgagtgttaggaagttggtgagtttagtggtgtgagagttttcagtttgtaataatgaaactcagttaagatcaataaaagttaaagtaattccctgtcctaagtagtttcccccggtttcccttcttgtgccctgtccatgccagatggtgaacactcgcagcaacgggaatggccccaacaaccccaataacaacaacaatggagagaatcccactcttgctcaagttcttgctcaacagacacagctaatgaacatgatgatgcagcaactccagaaccagcaaaaccaaggaaataaccatgcacctccccagaacaagttagcagaatttcttcgtgtgaggccgcctattttctctagtaccactaatcctgttgaagctggtgattggttgcatgccatagagaagaagttggatttgcttcagtgcactgattaggagaaggtctcatttgcatcacatcagttgcatggtcctgcctccgaatggtgggatcactttcgccttaacaggactactgctgaacctatcacttggcttgaattcaccgctgctttccggaagacgcatataccatcgggagtggtgtctctcaagaagaaggaattcaggtcgctcactcagggatctcgctctgttacggagtatttgcacgagttcaatcgtctggctcgttatgctccggaagatgtgcgcaatg

SEQ ID NO: 67270 - DNA, 7749 bp, Oryza sativa
ctgagtatcgctatcatcctcgtcaaccacagggaagtgaccgtggcagctaccttgagactgaaggaattgagaatgatgctaccacaaggcatttggttgagatgctgtgggctatggatgaaagtcgtgcggagactgtgttagcagctcaagatcgtgaagaccagaatcgtggtaagatttgcaagctcgaagacaaggtggatcgtttggagaaggaattagccgcgttaaagggagaagcaccgccgcagaaggccaggattcgtctcaccgcaaggaagagagctttatttgtcccacgctatcaattggtgccaaaggttcgtgtggtggagaaagaagttgccccagctcaagcggatcctccggtcatcatcataagtgatgaagaagaagaatccaagcgcaaccattccaagattgagtgggtagcaacccaagatgatgaagacgagccgaacgagccttcaatcgacctccgatgcttggaagaactagagtgacttgttaagtagttgtcttagatcattgtgttagtttgtttgctttaagtttgcttgtgtgtggctcgcatgtgatttacatcagtggtgggatgtaattgtgtcacgtcctgataaattcatcccgaaataaaaatcattccctaaaaggaataatagaattaattaaaattcgaaaagaaattggcaaacactaaaatacgtgcaagaaaaattcaaatgtagcccggagaatttttgttaaattctccttggtctaaaaggagccctcaaattttacttgaatttttagagcaccggaaataattattaagcaaaaaaaacaattaacaaagtttattaaaaagaaaaaaacctaaaaataaccccacaatcaacttattgggccaagtcaggcccaaagtcctaccctctctcccctcggcccgcggccgaagtctccctttcctccctgtctttctctccctctccttctctccctcctcttgggccccccttcccctcggcccagctccctcctccctctctctcccgggctgcctctcccccccccctctcccctcccggcctgcccggcccaggccgcctccccctcctctcctcctgggccggccgcccggcccaacccgagcggcgccctcccgcccgtgccgcgcgcgtgcgcgcgctgacgccgccgcctgaccgcgtggggcccacgcgccaggccgagtcatcgtcctcctcccgcccggccgtcctctctccctctcccgtgaaccctagcaccattcctcccttaaatccgcgcgaatcaagcttgggattcccaaattgattggggggaattaatcccctttcctcctctctctttcccccttaatttccccgtgaatggcgcccccaatcgccgggaacggccgcgccattcccggccgccttccattgccgccggccgtggttcccgccgccgttcccgctcctcccgtggccggctctctcccccatcctataaaatgggatcctcatcccccgttctctcgttttagccccctcccgagcctccccgtggtccctagccatctccccgccgccctcctctctctcccacgccgccggccgcctccagccgcctgtgccgcctcgaccgtgcgccggccggtcgcgccgtcgcctcctccagcgtcgccgccacctcctccaccccggcctgccctccgtttcgcgcggtgaccaccggaggcgcgttcccgccatcgcccttctctttcctccgcgccggccgcctccagccgcctctccctcctcgccggagcaccgtccggccgcaccgtcttctccctcggcctcgcagccacctcctctccctcggtcagccctccgtttcgcgggggaagcaccggagacgcatcctcgccggcaaaacagtggcgttgccgccactgttccaccttcggccgccactgtcgcgtttcccgtgcaccggccgacgtcgccaccacctccctcggctccgcgacgccgccctcatccccggcatcacctcctcctcgcccgaagttcgccggaacgccgccgccgcgccaaccacccattcctcctcgtcggctcgtcgccccgctgcaccaccaccttctccaacatcgcagcagcgcgttccacgccgtcccctcctccgctcagccgctgctgcctgccatcatcgttttcctcgtcaccgttcgtcctcgccgatcgacgtcccgtcggtcgcccggctcgtcgtctcgcggcgccgcctccgtcatcgtcatcgctgcggcgtgttccacgccgtcctcgtctccgtgcagccgctgccggctgccctcgtcgcctcctcgccggttccggtcgtcgtcgtcgtcgtcctctcgtcgttcccggtttcgctcgtcgtggcgttcgtccctccgtcaagccgttctcgtccgtcgtccgcgttcgtccagtgtgccgctgcagcccccgtcgtcgtcttcgtcctcggctccgtgtcgtcaagcctagtgccggccgcgtctcgccttcgttcaaggatcgccgccgaagtcgttccctcgccgtccgtctccgccgcgcccgttcgtcgttgtcgttcccacgcctcgtcgcgtggtggtaaggtttcctcctctcgctgccccgtcctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtttagtggagtccgtttgtcggccactcgcctcggttgacacacgggatccgcttccgtcgaaccgtggaccgactctgtgtactcggtctaccgcggtcctttaggttgacatgtggggtccgcatgtcaacggcgcagccttcctgtcttttccaggctagcgcttacacatgttttataattgcaaagcttaattataataatccgcaaatctccatataacagcattaaacttcggatgatcatatcctggtcatacgagctccgaatcgacccgttcaagtctcctaatgtttgttataacctaaagaaccctgtgctttctttttatgtattgttattgcttctttataggcttgtagctttgcttgtgtgctttgcgtagcttctgtcgttccggaggttcccgaagcgtggttcgcggtcgccgccgaaggttcggaaggccgttctctctgagcaaggcaagtcacatcatccttgagcatattgaatcccagtttataaaattattttgatttaaattaatgcattatcgctttatttaaattcccgcgttatcactgtcttatttagccatgcctatttacctttgttaagacattattattgctattgttattattatcttgttcaccctaggaagataaaaccccagctagtgggtactctattcaaagttccactagtatgaatttaggtagatgcttcgctgattaattaggcaacagtaggtggttttataactttagactttgggaattttcatatcacttggatactttggaatggttggcttttgttggaattggacacacacctccccctctattcaaaacccccaaaatggttttaggctgggctcgaggtgcgtggttgggttttgttagtcgtacctcgggtactataaggattaagctcgggcctctgttgcaaagcactaccgtacttccacatgtctagtggtaaggcttagtttgtggctcagtctggttataaacaaaagtacacggattagagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcatgtggttgcacgtgaggaagatgtgtcttgtgggtaaagttgtacacctctgatcagagtataatctattcgaatagccgcgccctcggttatgggcatgccgagcaatgtacccaggtcagtgttttaattcttaaatttgctcaacaactaaaaggtggaatggttggtctgggttggcttgggacgagctgggacccagggtcgggttgccagctcggtctgaatcatcgtaggccttgggtaaggcaggttcgtggggttcacggccttgattaataatactgtgtagctctaggatcgtctttataaaatggctttgggcaactaaggtgacttttaaatgctgtttactgcaaaacttaacccctatattattaccccttgtacccccttgcattaatcatgcatctgccggtgtggcttgctgagtactgtggttgtactcattcttgctcaatctttccccccttcagtaagagaagctttggagaagtagtcttaggtggagtcctggcttataccccagttgagcgcctgtgaagatggagccgtaggcccgctagtccgctgctgtttattttttattgtcaggcctgaagcgcctttgtaataatgtaaatattatcgatataataaagatgtgctttttgtatcatgtttgtttggtgtaccccggcttttcctgggacggggattaatacactagcgttcgggaaaaggcaattttctcggtcgcgacaaattgcatgtgtttgtttgcttttgagtgttaggaagttggtgagtttagtggtgtgagagtcttcagtttgtaataatgaaactcagttaagatcaataaaagctaaagtaattctctatcctaagtagtttcccccgttttctcttcttatcctgtccataccagatggtgaacactcgcagcaatgggaatggccctaacaaccccaataacaataacaatggagagaacccaactctggcccaagttcttgctcaacagacacaactcatgaacttgatgaataaggtgtttatggaatacctagacaagtttgtggtggtctttattgatgacattcttatctactctcgaaccaaagaagagcatgaagaacatcttcgccttacattggagaagctacgagaacatcaactgtatgctaagtttagcaagtgtgaattttggttgtctgaagtgaaattccttggtcacgtcatctcagccggaggagttgccgttgatcctagtaatgtggaatccgtaaccaactggaaacaaccaaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaaaagtcgcttagtatcagctcctattttgattttgcctgatccaaagaagggtttccaagtgtattgcgatgcatccaaacttgggttaggttgtgttctaatgcaagatgggaaggtggttgcctatgcatctcgtcagttatgtccgcatgagaagaactaccctactcatgatcttgagttagccgcagtagttcatgcgttgaaaatctggcgtcattatcttttcggtactcgtacggagatgtacaccgatcacaagagtttaaagtatatttttactcagccggatctgaacatgagacaacggagatggttggaattaattaaggattatgacatgggaattcattatcacccaggaaaggctaatgttgtagcagatgctcttagcaggaaaggttattgcaatgctacagaaggacgacagttgccattggcgttatgcaaggaatttgaaagattaaatttgggaattgtcaatagaggtttcgttgcagctttagaagcgaagcccactctaattgatcaagttagagaagcccaaattaatgatcctgatattcaagaaatcaagaagaatatgagaagaggaaaagctatcggtttcttggaggatgagcaaggaactgtatggttgggtgaaagaatctgtgtccccgataacaaagatttgaaagatgcaattctgaaagaagctcatgatactttatactccattcaccctggtagtaccaagatgtaccaggatctcaaggaaagattttggtgggcaagtatgaggcgtgaaatcgcagagtacgtagcagtatgtgatgtttgtcagcgagtcaaggcggaacatcagaaacccgccggtttgttgcagcctttgaagattcctgaatggaaatgggaagaaattggtatggattttattactggtttacctagaacgtcatcaggccatgactctatttgggtaatagtcgacagacttaccaaagtggctcatttcattccggtaaagacaacctattctggaagtcgattggcggaattgtatatggcaaggattgtgtgtttgcatggcgtccctaagaagatagtgtttgatcgaggcagtcaatttacttcaaatttttggaagaaacttcaggaagagatgggttctaagctgaattttagtactgcttatcatccgcagacagacggacaaaccgaaagggtaaatcagattttggaagacatgttgagagcttgtgctttagacttcggtggaagttgggataagaatctaccctatgcagaattttcatacaacaacagttatcaagctagtctacagatggctccttacgaagcgctgtatggtcggaagtgccgcactccgcttttgtgggatcaaacgggagaacggcaggttttcgggacggatatcctaagagaagcagaagaaaaggtaaagatcattcaggaaagattgcgagtggctcaatctcgtcataagagttatgccgacaatcgccgtagggatttgagttttgaagaaggagattatgtgtatcttcgtgtcacgccttttcgaggagttcatcgttttcgtaccaaaggaaaattggcaccgcgttttgtgggaccttataagattgtcagtagaagaggagaggtcgcttatcagttggagttacctcaatctttggcaggagtccataatgtgttccatgtgtcgcaattgaagaagtgtttaagggtacctaccgaagaagctaatcttgaacagatagaagtccaagaggatctgacctatgttgagaaaccaatccgtatcttggaaacaagtgagagaagaaccaggaatcgagttatccgtttttgtaaagtccaatggagtaatcactcggaagaagaatcaacttgggaacgagaagatgaattgaagtcagctcatccgcatttgttcgccagttcttccgaatctcgaggacgagattctgtttaaggggggtaggtttgtcacaccctgaaaattcaaaatatataaattgttgttcaattggaatttttagaaataattttaaaaagtcttgaaaagaaaatctaattttaattaataaattccaatataaaatgggcccagataaaatttcattaaatacattgcttaattctataattcctagatttttctgggatttatttgagctaagaaagtatttttaataaatggaattg

SEQ ID NO: 67271 - DNA, 646 bp, Oryza sativa
ggcgaattcgagctcggtacccacgggagaaacgcccaccaaacaaccacaaattcttccagaaaaaaaataaacgaggagcagtgacgttctcgcgaccatcatccgaacgtgccaagcatcttctctcaaacaaaatcgtgtcttaaaaagttaaattaaactacttttatactgagccgtttatttactgtgcgacaatgcgatattatattatcgtaatcctagtcgtgatcgcgatcctgacacgaacaaaaaaacgggccgtgtctaggattgtgacgctgacgacgttttgccaagggcgacaccagtaacagcactgtactagcagcggctatcagctcacatgggcatggccgctcgctccgttcaacgccggggaccgttcgtttcaactgcttctgccttgccgaccgccagtgacgaagcggaggtccgctgaaacaggttggcagttggtggcaactctgctgcagaattatttgcagcatgacaggtgaagttctaggcatctagctgcaagtcgtattccctttgtctaaaaaaaaaaatctagaacttaatatgacaacgaatctgaatagaattatatccagattcataatattacgatgtgatttttcatggaacagagggtgtatca

SEQ ID NO: 67272 - DNA, 13788 bp, Oryza sativa
acggcgccataagcgggatcgctgccgccgccgcctctttcgccgctgcttgcgcttgcaccatgttaactactcctagcttgattcttgctggtttttcggtgtggatctcgcgatgccaaaaacgcccaaaatgctctggatttctctcggtttgtttcttcctgctgctctgtttttagtttttgctgtgtttccaaccgggttggtgcccgatagtacttataggtgtcggaatgggagcatggtacgggcggcggcggcggccaagatggccaattatggcaagtgtacgcacgcaagttcgtcagctcttgactgcactggtgactggtcacgctttctgtttatgctgtcgtcaccctctctgtcatcgacttggtggtcagaaaaggtttctgtctgctcccgtcggaacagattcaggccttgtttaggccgtgtttagtagttttggcaaaaaaaaaattaacgtatacatacatatatatatatatatatatatatatatatatatatatatatttaaagtattaaacgtagactaataacgaaacaaattacagatttcgtctgtaaactgcaagataaatctattaattctaattaattcgtcattagtaaatatttattgtagaaccatattgtcaaatcatggtgtaattaggctcagaagattcgtctggcaatttacatgcaaactatgcaattatttttttttgtccatatttaatgctccatgcatgtgttcaaacatttgatgtgacggaaaagttggaagtttgaatggaactaaacacagccttaatttttttttccaaaaacgccacatcgaattttgatcacatgcatagagcattaaatatagatactacctccgtttcaggttataagactttctagcattgcccacatttatatagatgttaatgaatctacacacatatatgtctagattcattaacatatatatgaatgtgggcaatgatagaagtcttataatatgaaacggaggaagtagaaaaaaactaattgcacagtttgtatggaaatcgcgagacgaatcttttgagcctaattaatccatgattagccataaatgttacagtaacccacatgtgctaatgatggattaattacgcttaataaattcgtctcgcgattttcaggcgagttatgaaattagttttttcattcgtgttccaaaaccccttccgacatccggtcaaacatccgatttgacacctaaaaattttcttttcgcgaactaaacagggtctgagaaaataatagaaaaagaagcctctacgtttgctctcatagcctagaaaatcccacattaattggtgaaaaataataaaaaaattaaaaaacaatttgagacaatatcacattaacagcataaaaaaaaagaaaaacaaaaagaatcaatcggacaccctgcttacgtagtaaaatcaggactctttattcaatttggaaacactattttaatttagaaaacaacagtcatacatggtctatcaaagtgaaaccaatcagaaacagaaatagaataatgcatgtatttgtttcatattgtactcactgcattaatggcaaaaaaatacacagacttagcaaccaaagcaaaatacaaatacacaaaacaatcatagctggtacgcgggaaatcatctcgccaaaattagcttcgtcaacaaattagataatagaaaaacaaatcaccacgtttgctctcataacctaaaaattcacacattaattaaaaataaaaaacagagtcatatttttaaaatttatgttattcagataaaaaagtaaaacaaataaaaggtgagtccatataaaaaacaattttcaaaaatatgaaatttggattaaatgtataaaaaataaatattgaaataagagtaaatgtaaaaatataatttataaaaagaaaatctaaaatcggattaaattagaaaataattaatatcgataaaatactccatgtagaaatacagtttatgttgccatttttaatacattttataataaaatataaaaacatatatgctactataatgaaatataaaagaattttataataatactagccgcgcaatctgcgtgggcaaataattattggagtaagcaatgcatgggaacaaggaagatagactgatgttatagtacaactaaacccaccttctttacatcaacatgtgatgcacgtagatattgcgacatgaattacagcacagagacaaattcccccggcaaatagtcttagctggaaggaactggggcggcagtattgcagcttccatccgcgccgtgagaaacaagctgttgtataaactcgtcaatgtacctctcatggagttccttgtcagctacaagctcttgcagcctgatggcgtttgctacaaacaccctcctggtttcttcctcaaccatgacggcccggaccgcggcggcgacgccatggcggtcgaatgacccgtccatgtcatcccgcctcacctgcgatcctaccttgttaccctccatgagccgcgcgttcggcccttggtccccgaagatgggcaacatgatgagagggttcccaaacagaagcccctcgacgagcgagttgcggccacagtgcgtcaagaaggcgcccaccgcggcgtgcgccagtatggtgatctgcggaacccaccccatggcaacatgtccatggctcttcgtccgttcttggtaacccggaggaaggacatctgaaagatcgacgccatggggctttctcagcgcccacagaaatcgtgtcccggcgagctccagcccgagagccagctcgtgcacctgctccaatggtagaggcacctcgctccccagcgccacgtacaccaccgacttcgccggctgcacgtccagccaccgcatcgtcgagttgtccgtcatgccggcgcggcggcggcctccgtcgggcgacggtggcacgaggccgagggggatgagcggcttgttcttcaggcccgccgccacctgctggaaggcgtcgggctcccactccgggcagctccgcatggccgccagcgtgcacctctccatcgccaaggagcagcgcttcgcgacggacatgcccgacgcgccatggtcgacgaagaagcttgccttctgcgcccactcttaacatggcacgccctcccggcgttcttctaccacgccgagcacttggaagatggaagcgccggctggctccgacgaccgggtggcccatccggccatcatggaggcgctcgggagaagcatcgcgcatggcaccttgtgctggagggcgaccaggggtgcccagtggtggaacgtgtcggcgatgatccaatcaggcctctcgccggcggcgtcgcacgcggcgcccaggaactccgcgaacggcgcggcgagggcgtcgaaggccttccagaggagctcgaacttgccggagggaacgtcgttggtgcactcggtgccgtccgggaggcgcgcgaggttgcgtggcgtggagacgaaggacacgcggtggccacgcgacgccacgcgctccgcgagctcgaggtaagggagcaggtggccgaacgcgagccatgggaagatcacaaggtgcagcctcgacgaggatttggaccggccggtgtccatggcgatgttgccagatacagaggagctaaaccttaatctctcgctgtctcatgaataataaacaccggtagagataagaaatcagcaagaaaccatatgcattagctagttgttctttatataaccagtcttcaaataatgattgattttattggtgaaacaatggtcttacctatcgatcgattttttatgtgaaacaggactcaatagctagtggttcttaaatttttattattttctgtaggtacttgttgacagtgaaatttggtaagcccaaagtcatcatcggcttagagtcaatatcggcttcagagtcctgaaatcagccgatgggagtcgacaaatcgccaacaaccgtgttctcgatggaatcggatcaattaaagggaatttatccagaagagtccgagttcaagaagaatgcggcatggcagtttatctattaattaggaatagtttgttagtttcctttttatttttaggaaagtgtgtttagtgtcctataaggactttatgttttccttttatctttagtaaagtttctttcttgtcccataaggactagtatctacccatgggtataaatatgtacactcggggtcattgtaatctatctctacgatcaacacaattcggcgcatcgccaccctttttacttttacttttgtttctacgttccggtggaacttggcacccgacgcggggctgcatcggtgttcgatctccggctaaggggtaagtccaatgttccatcggcccaggcaattgtcttatctacatcggcgtcgttcaaggctgcatcagtacatttgacctcttggattgcactggtttggatgatatatttgcctacctacttatcatatgtctctgttaatctagtcgtagcatatcgatttagctctatcggctgtctctcgctttagagtttctgccggtatcggctaaatcgcgttgctagattagattagtttagacatctaccaccctgaaaactcagtcaacggcttgattgtctagatattatgtttcttttcatacttagtgctgcatcagttaagtttgatctactaagtcgtgcttagaaccataatccctagcctgcttcttgattgccaataagggtttcatcggggtttcagccggtgagttatctggacgttgcatcggcttgtaaggattgcatatacatacatattggatttagccgatgacaacaaaggtttcactgtttaatctaatcttgtagatttcatggcatcggaccgctagccgatgtgtgctttaaccttcggatcagtgcttgttctactatatcatattgttagccgattggtttctactggatattattgttatattttattaccatcagccgattgcctttatatcattatctacattggacatatagccgattgcttaaaccctatcgctatcggctggtaccggcatcggctattatcggctatcggctggaactgctccatcggcttgtcagccgatcggttgttttgatctactatttacatatcttgtcagtggcaggatcaaactgactggcatgcctgtatctcatcatatttggacctgcactggagctaagcagatctcctaggccgacgtgttcaattttttcgtcaacggtattgcaggtctcgatggttcttaattataatatatatatcgtatgcgtgcaacacatgttgtgaataataaataaataatctcaacccaataaagtctgtttctgccatttcactttcgatagattttaggtctatgtctttcatttttctttcgtaagatcttgcatcaaaatttgtgtttatttagatctaacatgtagttacactagttacagtaaacttactaggttacgttgcaccaaaattagattcttttttttacaactgttttgtttctatatttacgatttttggcatgtttgttcctttttatttcatttaaaacgggttgtatatattggatgaaaattatgtaagatttgaagctccaagtctatcaatctattgataggtagtaccataacagtttacttcggaagatcatcagtggacgacactttctactgatatgaattaagagccatagtgctccaaacaccaacaagtagtagacaagcagctcttttacaacatatgtgggaaaaagaatttatttcttaatttaatttgatagttcgtgtacaacaccattgttattcatgcttggcgcccaattcagggaatgacaaggataagatagaagtgataatttctttttaagttttgaatcgatttatggtatagagttgacacaatttgcttatggcgttaattggtctactaaattttagcggtacagatagatacactagcgaggagggaaggaggattggggaggagagggatgccaggaaggagggagagaggtaggggagaagaggagcactgagagaagagggctgccgagctgggaggagggccagcatgaacgaggggcgctaacatgaattttcttagtccgccactagctacaatatctcagcgccagtaagtttggcgttgagctcttattcaaggtggcgcaaatttgccaagatgtcgaagcgcagtaccactccactgacactgagctctctactgctaaaaacagtgtgcattccctcttttatagcaaagcaaggctagtgcagtggtggaggtcttcagtctcgagacgacggtttgattctgccatccttcatgcttgcttttttttttcccatttcactcaacactttttaatcagtagagtgcctagcgccaatgatattgatgctaaactctgatgatatggtatactcatgccactactagtagagagctcaacacaatggcattggcactaaactccgatgacatcacaaactcgtgccaccttggacaatgtgctcatcttcgatgacattgtaaacttgtgccaccttggacaagagctcagcactaggcattggtattgagatgttatacctcaacacagtggcgaatatagaatataaactatgaagatgcgggtgtaaaaatatagtatgactgaaacaacccagtgtgatcataggtgctccatgataggtgtgttgagctgcattagataatgcaataggattttgatagtattagcactataatgatcataggaaagggaatacatatttctcgaacaatattattacattagctcgttaatttcgaaccaccagctacaaactttcaagaaaaaaaatgtattcatgcttgtccgtatcacatgagaagcgttactccctccgtattttaatgtatgacgctgttaactttttaaccaacgtttgatcattcgttttattcaattttttttgcaaatatgaaaatagttatgtcatgcttaaagaatatttgatggtgaatcaagtcacaataaaataaatgataattatataaattttttgaataagacgaatggttaaacgttggataaaaagtcaacggcgtcatacattaaaatatggaggtagtacattattaatccaaataataggctaaaattggattatttaggtgccaattaagcataggtagttgttgactcctcatcaatctcctcaagaaaagggtaatctgtataaccaacaacgggatcctgtgtataaaaggtagacctgtcatacctgttcaatggtgcgtcaagctcaaacctcctcggcaagtcagggttagccaagaagagcctcccataggcgacgagatcggcatagccatcagccaccaccttgttcccttcctcccggtcatacccgccagcagcgatgaaagtgccattgaactgcttcctgaatggtaggagaccatgggcgatcttccttcgtccttcgattatggccattcttggctccaccatgtggcagtagagaaaccctgggtgcttgttgagttgctgcaccatgtatgagccgagagccaccgggtcggagtcgaagcagtccatgaagtcgacgaacggcgataatctgattccgacacggtgagctcccacctcggcgacgacggcgtcgatcacctcgacggcgaagcggcaccggttctcgaggctgccaccgtactcgtcggtgcggtcgttggcgctgtccttcatgaactgctccaggaggtagccgtgcgcgccatgaatctccacgccgtcgaaccccgcctcgatggcgttccgcgcggctcgcctgaagtcgtcgatgatctgagggatctcatccgtccggagccgccggggcttggagtacaccatgcctgaatcgtccggtgtgatctgcttgtcggtgcttgagatcggcgcctgtccattcggctggaaatctgtcgatttcatttggaaatttaatcaatcaaagagcacaatgacctttgattcttcgaatcaatcagtaaccaagtagtaacaactagcaagtaaataatctggcagatggacgaacctgtggtggagaccctgccgacgtgccatatctgcaggaagaagagggcgcccttgcggtggacggcgtcgacgatgggcttccacgcctcgatctgctgctgcgtgtagatgccgggggtctccgggtagccctgcgcggtgggggagatgtcggtggcctccgcgatgaggaggccgcccctggtcgcccgctgcgagtagtacaccgccgcgtgcggctgcggcacgttgccgtaggagcggcaccgcgtgagcggcgcgagcaccacacggtgggagagctccagctgccccatcttgtacggcgtcagcagcgggatcgccgccgcagctgccactttcgccggtgcgtgcaccatctttggcttaggagtagctttggttcttctcgatcgaaattgctctgcttctctctctgtttcttgctgctgctgctctgctctgctctgttctttgttgctctacttccatttttgttggtgcctgcctctacttataggtgttggtggtcgccgagacgccaagtgttcccaactgctgttgtcaccctctccgtcatcacaacttgtcgttagaaaaaaggtttccatttgttcccgtgggaacagattcattgcatgtggccgttttttagttcgcgtactcctgtggttctgatcaagacatcgaggtagcaggagtttggtgccgaggacggtgccaatcaacgcgatggtgtgtttggtgtgtacgtttgattctgaattcaaacatgaccctatttgtttatggttccgatttccattgcttgttctagtgcgtgtggattcccggagtgctttgagtaaataaacaacttgtttgtagttactctgtatactactactagtattttacgtttcaatactgacgcggttgacaatgccaggtatttataaaatttaaaacaaccaagttgagataagtaggagtatgattttaaaggaacactctatatctttcgaattgcatgttactgtagtattttgtggttaaatttatcatgtgcccgccaaggataaagtgaaatgtttagctcttaaaacataaagttcgaaatacgtaggattctcaaacactacaaacagaccaaacataaacagaataaggcgaattctggtaagtcaacaaaaggggattgttgcatcgaaagaaagcgacgcgaacgttgggccgcacgcgtgcttacgtcctgcgacgtcattgcaaacgacagcacgttagaaatcagtggctacgcgtttgatactaggccctatttaaatttcaactttttttttcttcaaactttcaacttttccgtcacatcgaactttcctacacgtacaaatgtcaaatttttttgttatatcgttccaatttcttcaaacttctaattttagcgtggaactaaacacagcctagacaccttgatactaagattaaaaatataattaaaaaaacttaaattctaagcatgaatctagatatccctagtatttttatttctttgagacggaggaagtaataacttttagaggaaggctgccgatggatgcagtgcggtctaaaacgcacgaaggctagccggcagggggcgatggtgcagtggacccacatgtcggcagaggttggactgtggtggagcatcggggcgagtggcgggtgaaaacccaacccggcctcagctgggccggcaatgatgacgctcaaagcgtcattcccctcctaagggcattgccgtgccgtctcatccctcatgtgtggatgccgggcaaaagcaaagtcttagttctctttgggaccttgacggacggcggcggcagtgttttccgttgcttctctccttagagatgtcgtttaggtatcccctagccaaaaccccaaaccaattggtgcaagctccctctagatttcatcctcttgtagcggcatcctagtctctacaagttggccacgttggagggcctaagggggagaggtgttctattattctctctcaccctctctcccttactcctaaagacttggatagataagggctttgtgttgattgtaagggttgggttttgggtgatctcggccgtgtttctttgttgacctagcggtagccggtcacgcttagcgacgaccggtccaatgctagccttctccttgttctatgtgttggcactgtcgatgtatgggtgtgatggtatactttttttttctttttcctggttacgaccttctaggtttgtaatcttataatttttcttctgctctatcaatataacttcgcaccgtcttatgtgagtcgttccagaaaaaaaaaacttttagggcccctttgaaacgcataggaaaaacacaggaatagaaaaaacgtaggaattgaagtggcatgttttcctaatcctacaggaatggaaaacacaggatgaagagggtccctttgatagcaccataggaaacaaacaaagcaaaagatagtttccaagaggttgaatctcttgcttattttcctatgaaattgagctataggaatgcaatcctaagaaaaatttcatatactttcctatgaatcaaagggtttgataggaaaaaatccttaggaaattaaatcctccaaaattcctatgcaaatcctccaattcaaaggggcccttagaggaaaatcgaatacctgtacatagctaccaggtacatcattgacagcaattgacgacaattgtcatcaatcccaggctagcaataatcttcagttcttgcagcctgctagatcatgcagctgctctgaccaggctgcttatggcgcaccgccgcgttcaccttgatccggtgcatctccacatgatcccacctctgcaacgaggcgtacatgttggacaggccataggcagcgccgtcgtccaggtccagctccgatatccggtccgccacccactcgcccaccctgacgccgtcctcctccgacgccgacgacaagcggcgggcgtgaagcaggagacacccgagaatcttggcgttcggcctgacgggcatcgcccgcacgacgcgcacggcgtcgccgaggagtccggcgcggcagaggaggtcgaccatgcagccgtagtgctcctcccggggctcgacgccatggaccggcaccatctcggcgaagaacctccggccctccgctaccaggccggagtggctgcacgccgacaggagcgccacgaacgtcaccccgtcgggccggatgatcccgcggcacgttcgactcctcccgaccatgtcgtggaacgccctgacggcgtcctcgccgcggccgttcatgcctagccccgcgatcaccgtgttccagcagaagaggttggggccgtcgggcatggtggcgaagacgtcgagcgcgcggtccacgctcccgcacttgaagtacatgtcgatgagggcgttgcttagcacggcgtcgatccttgtcccgagctgacggatgtagtgatggactcgccggccaaaggcaaagtcccctgcctgcgtgcacgcggtcaccacggtggctatggtgaccgtggtgggcatcatgagcgtctgttgctgcactgtctgtcgcatcaaccggcggaacatggcgatggcggtagcggggtcacctcggcgcaaatacccggccatcatcgtgttccatgtgacaacgtccggcgacggggaagaggagaaagagcagcccatacaatcgaaaagctcctgcgcagcgtccattctcccggccttgcagtacccatcgatcatcgtgttccacgacacgacattgctcgccgtcgccccgaggctcgcctcgaacacctccctggcggagccgaggtcgccggccttgcagtaacacgtaaccatggtgttccacgaggcgggggtcctgtccggcatccgctcgaacagctcccgtgcgtcggccatcctccgggacgcgacgagcgcggccagcatggcgttgaacgcgaccgcatccctgcgaggcatttcgtcgaacagcctccgggcgggatccaggaggccgcgcctggcgtagcgggtgagcagtgcggtggccagcaccgcatcgccggcgaggcccagcttgcaggcgaggcagtggagggcctgctcctcgcggcggccgggggcatccgccaccgcgcggatgagggccgcgcgggcgttcgggagcacccgaagctgcatcagatcagataggcggcgcctgtgaacaactcgttgctcctccgaacggctgctcctcggcgccccgagcgctgatggtggtggccttcctcccaacgtggtctccgtccatgggggtgggtgctcgtgtggccgtgcctcaccggctcacccgtagagctcggctttagcagcagacaatgccgcggggtgggctcgtcggggtggagctccaccgccggccgccgggtgcccgggtgtagggagaggaatgagatcccctcctcaggtcaggtgactttacagcatatggttcatgtaaagatggctactatacgtcagtgactcaaagttatcatgtgacttaatatactttaattttgtgctgtcggtataattcacgtatcagtgcgacagctacaaattacataaagttactgcacaaagttaagggacttgtttctgagaaggggatataagaagatttttcttttgggcacatagaagatttggaggtgaagaaagtggaaatgggaagggttaattggaccataccattataaataaatttgctcttttttaaaatatcattagtcccttcgtttcaggttataagactttctagcattacccatattcatatagatgttagtaaatctaggcatacatatatatctagatttattaacatatatatgaatgtggcaatgctagaaagtcttgtaatatgaaacggaggaagtactgtttatctaaccgatatcatatcatcatctacatcggcatccacatccaccaaatagctataccaatatccttggacggattcaaagtgaagcggattacataatatcatatccgttttcatctctgaagcgattggttgaaacgatacaggtagtaaattttatttttacttttaaatataagtaacataattgtattaatccaatacaacacgcaatgtcatacaacaatttgttattccccatcgtttcaaaagaaaaccaacccttttggcctctcaccaaaagcaaaaccaagttattcccttcatctcacaatattactacctaatatataattggatattttctagtacaatgatatattaggtggcaaaattttaaaacagaacagtatactacttataactgtcgtagtggtcgccgttgccatcgcgaccgaacgcgatttgaatcagttggagagcaggaggcggcgcacgtccccgttcgggggtttggccagctggcggcagcaacagatggggtaatattgtcccggcttgcagtacgtggtatacgggtacacgtagcccctcttctggcagtactccgggcatgtcaccgaatcacatggcacgatcgcatggcaccaatcatctgtgcacaaatattcgattaagggtcagaacgtttggttgaaaaaaccgataataaatatacaaagaaaaaaaattcgataaattttgataggaatacaaacaca

SEQ ID NO: 67273 - DNA, 1517 bp, Oryza sativa
tttaacatatttttggtgtttcttagttcattctctttatctccttctctctttgtttagcttaaatggatttatttttcttggccgcaaaaagtgttacataataatcgtaccgactcaaatatatgtattttctggaaacattgtgaatgtgcatttcaagcattgaagtttttttttagagtgggttttataaaactccaccagttatggacaaagttgtacaaaacaaaagggattttagcacgtaactcatagccatgaatattattgctcaaaagtttcacatgaccacaccattaaccaatttaacatacttctatatcaaaatttaaaaaggctatacttgcatggatataacatctttatgatggataaataaaaactcatgaatttgatataataaatctaaaactcagaagttgttgacgagggatactcgtggaccggatgagttgagtattggggtacgttggaacgagggtctacgtagtacgacatcacgcagacagaagacaaggattatactgattcagaccccttatcaggtaatagccctagtccagtttatatgagattgatgatgatgagaacaaattacaaagagaatagtcgaaacagatggtaccgatgagatcgtagtcgagggattcgacgagatctcccggcgacttggctctgtgcactctggcttcgtaaactttagtgggtatgtggatgatgagatgcgatgcccttcacctccccctaggggccccttttataccgtggaataccttgaccctaagtaagacttagggataccttgaccccaagtaagacttagggatatgtaaactggcacgatataacaaaaggctttaccccttccgagtaggactccggcaattacttaactcatagagatattttccataatttgagataaattcctaacgacgtatacgaaaacgatccgtacacgtgaaggtataccttatcggtatattctataagtcgtatgatagatgatatgccttatctgtaaccctgacagaagtatattagatcaaagttcaaatgatcaatagtgtggttttatgaaacattatgaccataatacatgggactatccgcaacgtacgaaaatccctatagttttgtgcaacttagaccataatacgcgtggttaggtgaaatttactttacaaaagttcacttactaagtaaaaatgaaccacctagttaacatgcatttcttctttccagtttctatttaggcaaaatgcttgagttcctactacatagccatgctcatctaatttggtatcattgccatagtgattatttatagacaagcaccatatatgtaccagtgagtgcaccctcttaccaaacaatcaaagggaaaaaaacaaatgacatatctctaactcgctataaccattaaccccagcaattcacgtatgtgtaatataatccttttgtgaggttggaagatatgaaatagaaaaactatgtgattttcaccataggtt

SEQ ID NO: 67274 - DNA, 2872 bp, Oryza sativa
tttcccctttgtctacaccaatagttcaccagcgtgatcaccaagttttcatcttcatcattatagtttgaggggccatgaattgaacaactgtacgtctatgtattcatctcttatcatcaaatcagttgatatcatcacttagattaaattgcttactctttggttttcgcgtgtttccccatatagatgtgagaccagtacgtccggagtcctttcggccaaagttttgtaaatattatccatcatgggtttggatatcaaatgagcattagcgattacaatgaccagctagcaataagatcgaggtttgtacggttgtatcaattccatataatcgtaatttaatcataatatatctcatatgccctcttgtcaaaaatatttgacttttaacacaagatttagtcaaaattttaaaacttttaaaattaattttgtgttataataaatttgtaaaaacctatagaatttatagtatcatgataatacttttcaagacaaatctacctgcactctttgcgtgttttctaaacttgccctctctagttataaatatttgatgtttaggataaaattcaatcaaattgttaaaactattacccccaataatttctcaggtgcttagttaaagaaaatgtatgtgcaattctgttttgaaatttattactagattttacaaacacgagattatggtttctttcaatggtggagaaatgtttttttactcccagttggtaacccccgtagtccggttttccaaccaggactaaagataaaaaagtagctctaaccttttgaactccccattttttttacaactgggaccattgtggaatttggtcgaccatggctaccatggatacaaccgttgctcacatcatggatcaagaagaacacttcaagatcaagccgtccaaattctggaatccaattcggtcacctgctaccgtgctgaattcaaatggccgccaaatgtgcatacgagctccgttttgggtccgtgagtacttgatggaaagctctcggagtcctctttccaacgaatctagcctcgtatacaaattccatctcatttggctgcaatcgcataaacaaggtgctgcgtcacctatattgggccaatgggtttgtaacttcgtttgggaccttggcctaagtggggcccatgtggggtgcgccccaaccaggtggagcacgaccctaggcaccactattaaagtttagctttgctactttgccgtgtaatcctgtgatcggttagatcgccggtttactcgttacgtaaccccaacttatcatttgtactcaattcctatttgcaattcagattgtttttatcttgttcttacttgtttcttcgatttgcttgcaggaataaggttgatttgcatcggcaagatcaacagcccacggagaggtgtattgatcgctaaggcgcaacgcaacgtcttgtacggttgtagtcgaatcatcaacgtttctctcaaatcgtagttatcatcaactcaccgaaagatcgggccaaacaactgtcttgagtgtcaaaatgaactcaggggttcatcatggtttctccggtagttttttattattattttaactaaggtttctccagcagtggttatatctaatcgatcttcccggtcacatgaacgttcaaacactacagctagaaactcagcctgctgcatataccttgctagatatggtttccacatccaaagtgcaaactgcaatctcgcatgcatggattcgtctttcagcaaactaagcttttggcgatcagacaggcgccattcgatatctcagccatgactcaatcatgttcgtcactgtcatgtctcggagggaaccgaacgctagctaacacggcacatggagaataattgtcgaaaaacgacatggcacacgagcaatcaaccgacgatggctactcacggaattatatatatcatcgttatcgtgtactcttatgtagtatcaaatttatgaactgccccttcccttttttaatagatgaagccatctccttttacactactactttctttttaagaatcggaaactacctactaagcgcatatattctgccgtaacgtgctcatcgtcctctaacccagtacatatgctgattgtaatccataatagcttatcaattatccaaaatagttaatgagtatatatatcattaacgaattaaaaaccaatataaaaaactacaataaaaactaaaataaactatgagctgtgataaacacaacagaattttaaagcttgtttagagagtttaaaattttgagaagctagtaagaatctgaaaaggttgaattttccagtatgacttttacttcattttctaaattctagcttgtaacaatctaaaaaaattggaattttcagcttctaacttttactttgttttttaaattctacaactatatattactagaaaaaatacccgtgcgttgcaacgggtgaagtctattttaatcttattattgttatatggtttagttaagatgaaattcactgtgagaattcgcttggatatatatatatatatatatatatatatatatatatatatatatatatatatatatatagagagagagagagagagagagaatcatgggctgtagttaggacttcggtcgtctcaagttagcatgcgagtttttttaaacatattttttatatgattacttctgtattatcaaaagtgaacgatcttaaaaacctacccatacacggataacgtatcaaaataccagcaaaaatatcttcaatttttataatagataatatttcagagactgaatgacaatctaaactattgagtaaagtccatcaccagtccctaaacttg

SEQ ID NO: 67275 - DNA, 4988 bp, Oryza sativa
cctattaacttaacattttaagtcagttttttatatgatttataaattaatggatttaaagttttaagttaattggtgaagtcatatctctatcttacataaacaaaaataattttttcaacccagtttttggcttaatagtgtataagagtgacttatagctttagaagaccaaacaaaaagctattatttgtttagatttggagttttcgactcataagttgatttataagcataaataagagggatttgtttaaactggatctaaaaatacaccacgattacaagcggcgtcccggtaggcaaaacaacctaaaaaggcgcctgcgcacattgccttgctggacgacgctggtgcatgcacgcacgcacggcattgcagagcccgtgacgtgagggcgagctagccaacaacgctcacgagccgaatacaaccaaacgccgctccgtccggccacctccccttcctcctccatcatctcaccgggtgcgcttcccctccccttcgtacaacgaagatttgctattcgccagggcccaaccacagttatagctcacgtagccgctacaggcttcttcgccgcctcgtctcctcctcgatctcccttcctccctagaaaatctctcggatctcgccgagagctagcggctggctggcggcggtggcgcggtggcagcaaagtgtacgctttgcagttgctgccggcgcggcgcggcagcggtgacgacgaagagggaggaggagagaggctgtgtcgggtttgtgttgtgtttgtgtgtgtagtgtgagatctggagacggccgggaggatggcgcgcggcgggagcttctcgcggctgcggctgcgcgcgggggtcgttgtcgccgccgccgccgccgccctgctcctcttcgccgtcgtcgcgccgcccgccgcggcgctcaacatcggcctccagtccgccggcgacggcgcggtacgtacactatatacgtcactacccactctctctctctcctaatctgctcgtactcgttggctaacaaagttgattaatcattatgactgggggagcgacgccccagagcaaggccgggttgtgcaaccgcacgtgcgagtccgaccactgcacgagtaagtggctatgttattcgtcgtcgtcgtcgatcctaaatttgattgtgatatttgctctgacgacggtgatctcgattgggtgcgtgtgcagcgccgccgttgctgcgctacggcaagtactgcggcatcctgtacagcggctgccccggcgagcagccgtgcgacgagctcgacgcctgctgcatgcaccacgacaactgcgtccaggccaagagtacgtcacagaactaatccatcataattaccaactactgtcccgtatttgcatagcatatgctgcttagttttctatgtgtatatatatttttttttctttcgctcatatcatcagatgactacctgagcaccgcgtgcaacgaggagttgctggagtgcctggcgaggctgcgggagggctcgtcgacgttccaggggaacaagtgcatgatcgacgaggtcatcgacgtgatctcgctcgtcatcgaggccgccgtcgtcgccggcaggctgctgcacaagccttagcttacatagcctcagccgtgctgcaggcaccacccctgccggcggcgaacggcggccggatcgacggcatgggcggcgcgaaggatgagcagtattgtcctctaacttcgaatcactgacgtgtaggtccagtagatgtggggcctacatgtcagtcagtcacagtcaataatgaccgtactacagaggataaagtgcttgtgcgttattgggtgggtggtacatgttttgcttgcttggtgtgtgtcagtgtgtgtgtgtgtgtgcagcttagctagcaccgggctggcggctgcgtgcgtcgccttcaacttcacagttcacgtgggctcccccttgacagaggcccagacttacgacaaatatatgcagatcacaaatattactacatggttttggacttcggttttgtgccacttgctgctttatttatcgtgcacatctggtgtgataatgttatcaataaacgtatacatgtcccacataggtatgacaagacaattcgtctgccggtttggattatgtgatggcagatggtatcataagcttttcctttccttcagatggatctttgtaagatttgtacttggacggttggcgagtctctatgacgggatatttaggacatccatgatatagtagaaaagtaaatattagtaactaaaaaaatcttattatcaggtaagatatattgtgaaaaatagtaaatagttactaccaaattataggcttactttcaagatataaacactttgtgacgtgtcctacctattttttagttgtgccattgcttatgtttgtggttttttcagttcaccttgttacccgtactcttcacatatagacattgtgatgtaggctgtgtttagatccaagggtgaaaaattttagcgtatcacatcgaatattcggacacacatttaaagtattaaacctagattaataacaaaacaaattacatattcctcctgtaaactacgagacgaatttattaagcctaattaattcgtcattagtaaatgtttactgtagcaccacattgtcaaatcatagagtaattaggcttaaaagattcatctcgcaatttacacgcaatctgtgtaattaattttttttatctatatttaatactccgcgcatgtgtccaaacattcgatgtgacggggtgaaaaagtttttacgagggaactaaacatggccgtattttcaatttagagtaaattacacccacggtgtatcaacttggtaggtgggtgtaatttagtacaagaacttgataaatgagtattctagtgcaacaacttggtagatatgtacaatttagtacatgaactttataagtgactgtataaatgcaacaacttgcaagatatgtacgattttgatacaataagttcagaagttatgcgacaatttaattatttggagcacttttttatacatattcaatttttaagtacttattttaacaatatactagtgtggttttgtatataagcatatttatatttttatcctaataactaataactgaaagtcaattaaactggatgtaaaaattattatatttcagttgagatttgagaaggtgaagaaaacaaaaatttttaaaggtaattggatgtgcagtataattcttaaagattaaattcaatattataaggtattaaggtaatatccgtacgattgctatgtaaaggcatattgacatcgcgagaaaaactcacatagcatatgcttagctaagttgatgtaccaaaatactaaattgtcaagttcttgtactagaacgtacctacttgtcaagttgttgcactcgaacgttcaattctcaagttcttatactatatcgtatccacctatcaagttgttgtatatgggtgtaacttgttctttaattcaccattaacatttgacatgggtttatcttaccatccacttttgtaataaacattgaggatgctctaggatctgcgtaactataaagtactactgaacagtgggctaatcagacaacttaagaacacatggtcataactatgcaggatgcaaccgtgttcttaaacagagtcgttgagctgtgtttattaaggaaactgcaataatacatgctatgaccgtgtgattagttaacagcctaacttacaatactgtttattagtcccgttgaactgtatcaaccatacggcagatactcccggagttgtaccgcttgctcctaggatcagctactgaccacatggtaaaaatcaggcaagaacagcagttgaaacaaatatttttttttttgaggggatagaagcaaatctaaagaaatgttgctccgcttccacgattcatcgaacagtgggctaatcagacaatcagcgtctgtttgaaaatatgacgagcattgctgatttgctgtcggcatttggtaacattaagaactggagatagattttattaagcataaatatcacccctggaaacagagtagcagcgtagttgtgtgacttgtgtctgaagacggggaaaaaagcacagctactctacatcgtacatcaaatttattgccataaaattcatccatgaaaacagagtagcaaggtatttacactgtctgaagacgggagaagaaagcacagctactcaacatcgtactgcagatttattgcgacgaggataggtaatcagcatcatcaccattgcttctaggtcatcactcgtttatttgacatataggtaactgcttcaactaattttcataaagtggctgaggtgggattttcctttgtaacctgagaaagcataaaaaagcatgctagcaaattttaaaaaaaggtggaaaagtttatgaaacatcgatagctataattttacgatgttgtatgaggtgtactggtgtagtatccacttcagcattgcaagcaagccggtaagtttaagatggagtacttgttatgtataaacaggaccaaattacctacaaaatttctgctaacagtgacttaaacaaggacactaataaatttctgccttcggagttttcaagtgattgacatgaaagataaagtaaaacatcattcccatttgtaaaaatacaaacagcggcacaataccttgtttcaatatatacaggtacaagtaaccaatatgtgtcctgtgttacaggctacggcaaaactatacagtatcaagtacaagattatgcagtataagattatacagtctaaaacaagtacttcctccgtttcgcaatgtaagactttctagtattgtctatattcatataaatattaataaatctagacatatatgtatctagattcattaacatctatatgaatgtgggtaatgctagaaagtcttacattgtgaaatgga

SEQ ID NO: 67276 - DNA, 27737 bp, Oryza sativa
  unsure (1)..(27737): unsure at all n locations
gctggtttttcggtgtggatctcgcgatgccaaaaacgcccaaaatgctctggatttctctcggtttgtttcttcctgctgctctgtttttagtttttgctgtgtttccaaccgggttggtgcccgatagtacttataggtgtcggaatgggccatggtacgggcggcggcggcggccaagatggccaattatggcaagtgtacgcacgcaagttcgtcagctcttgactgcactggtgactggtcacgctttctgtttatgctgtcgtcaccctctctgtcatcgacttggtggtcagaaaaggtttctgtctgctcccgtcggaacagattcaggccttgtttaggccgtgtttagtagttttggcaaaaaaaaaattaacgtatacatacatatatatatatatatatatatatatatatatatatatatatttaaagtattaaacgtagactaataacgaaacaaattacagatttcgtctgtaaactgcaagataaatctattaattctaattaattcgtcattagtaaatatttattgtagaaccatattgtcaaatcatggtgtaattaggctcagaagattcgtctggcaatttacatgcaaactatgcaattatttttttttgtccatatttaatgctccatgcatgtgttcaaacatttgatgtgacggaaaagttggaagtttgaatggaactaaacacagccttaatttttttttccaaaaacgccacatcgaattttgatcacatgcatagagcattaaatatagatactacctccgtttcaggttataagactttctagcattgcccacatttatatagatgttaatgaatctacacacatatatgtctagattcattaacatatatatgaatgtgggcaatgatagaagtcttataatatgaaacggaggaagtagaaaaaaactaattgcacagtttgtatggaaatcgcgagacgaatcttttgagcctaattaatccatgattagccataaatgttacagtaacccacatgtgctaatgatggattaattacgcttaataaattcgtctcgcgattttcaggcgagttatgaaattagttttttcattcgtgttccaaaaccccttccgacatccggtcaaacatccgatttgacacctaaaaattttcttttcgcgaactaaacagggtctgagaaaataatagaaaaagaagcctctacgtttgctctcatagcctagaaaatcccacattaattggtgaaaaataataaaaaaattaaaaaacaatttgagacaatatcacattaacagcataaaaaaaaagaaaaacaaaaagaatcaatcggacaccctgcttacgtagtaaaatcaggactctttattcaatttggaaacactattttaatttagaaaacaacagtcatacatggtctatcaaagtgaaaccaatcagaaacagaaatagaataatgcatgtatttgtttcatattgtactcactgcattaatggcaaaaaaatacacagacttagcaaccaaagcaaaatacaaatacacaaaacaatcatagctggtacgcgggaaatcatctcgccaaaattagcttcgtcaacaaattagataatagaaaaacaaatcaccacgtttgctctcataacctaaaaattcacacattaattaaaaataaaaaacagagtcatatttttaaaatttatgttattcagataaaaaagtaaaacaaataaaaggtgagtccatataaaaaacaattttcaaaaatatgaaatttggattaaatgtataaaaaataaatattgaaataagagtaaatgtaaaaatataatttataaaaagaaaatctaaaatcggattaaattagaaaataattaatatcgataaaatactccatgtagaaatacagtttatgttgccatttttaatacattttataataaaatataaaaacatatatgctactataatgaaatataaaagaattttataataatactagccgcgcaatctgcgtgggcaaataattattggagtaagcaatgcatgggaacaaggaagatagactgatgttatagtacaactaaacccaccttctttacatcaacatgtgatgcacgtagatattgcgacatgaattacagcacagagacaaattcccccggcaaatagtcttagctggaaggaactggggcggcagtattgcagcttccatccgcgccgtgagaaacaagctgttgtataaactcgtcaatgtacctctcatggagttccttgtcagctacaagctcttgcagcctgatggcgtttgctacaaacaccctcctggtttcttcctcaaccatgacggcccggaccgcggcggcgacgccatggcggtcgaatgacccgtccatgtcatcccgcctcacctgcgatcctaccttgttaccctccatgagccgcgcgttcggcccttggtccccgaagatgggcaacatgatgagagggttcccaaacagaagcccctcgacgagcgagttgcgcccacagtgcgtcaagaaagcgcccaccgcggcgtgcgccagtatggtgatctgcgaaacccaccccatgcaaacatgtccatggctcttcgtcgtttcttggtaaccggaagaaagnacatctgagagatcgacgccatggggctttctcagcgcccacagaaatcgtgtcccggcgagctccagcccgagagccagctcgtgcacctgctccaatggtagaggcacctcgctccccagcgccacgtacaccaccgacttcgccggctgcacgtccagccaccgcatcgtcgagttgtccgtcatgccggcgcgacggcggcctccgtcgggcgacggtggcacgaggccgagggggatgagcggcttgttcttcaggcccgccgccacctgctggaaggcgtcgggctcccactccgggcagctccgcatggccgccagcgtgcacctctccatcgccaaggagcagcgcttcgcgacggacatgcccgacgcgccatggtcgacgaagaagcttgccttctgcgcccactcttaacatggcacgccctcccggcgttcttctaccacgccgagcacttggaagatggaagcgccggctggctccgacgaccgggtggcccatccggccatcatggaggcgctcgggagaagcatcgcgcatggcaccttgtgctggagggcgaccaggggtgcccagtggtggaacgtgtcggcgatgatccaatcaggcctctcgccggcggcgtcgcacgcggcgcccaggaactccgcgaacggcgcggcgagggcgtcgaaggccttccagaggagctcgaacttgccggagggaacgtcgttggtgcactcggtgccgtccgggaggcgcgcgaggttgcgtggcgtggagacgaaggacacgcggtggccacgcgacgccacgcgctccgcgagctcgaggtaagggagcaggtggccgaacgcgagccatgggaagatcacaaggtgcagcctcgacgaggatttggaccggccggtgtccatggcgatgttgccagatacagaggagctaaaccttaatctctcgctgtctcatgaataataaacaccggtagagataagaaatcagcaagaaaccatatgcattagctagttgttctttatataaccagtcttcaaataatgattgattttattggtgaaacaatggtcttacctatcgatcgattttttatgtgaaacaggactcaatagctagtggttcttaaatttttattattttctgtaggtacttgttgacagtgaaatttggtaagcccaaagtcatcatcggcttagagtcaatatcggcttcagagtcctgaaatcagccgatgggagtcgacaaatcgccaacaaccgtgttctcgatggaatcggatcaattaaagggaatttatccagaagagtccgagttcaagaagaatgcggcatggcagtttatctattaattaggaatagtttgttagtttcctttttatttttaggaaagtgtgtttagtgtcctataaggactttatgttttccttttatctttagtaaagtttctttcttgtcccataaggactagtatctacccatgggtataaatatgtacactcggggtcattgtaatctatctctacgatcaacacaattcggcgcatcgccaccctttttacttttacttttgtttctacgttccggtggaacttggcacccgacgcggggctgcatcggtgttcgatctccggctaaggggtaagtccaatgttccatcggcccaggcaattgtcttatctacatcggcgtcgttcaaggctgcatcagtacatttgacctcttggattgcactggtttggatgatatatttgcctacctacttatcatatgtctctgttaatctagtcgtagcatatcgatttagctctatcggctgtctctcgctttagagtttctgccggtatcggctaaatcgcgttgctagattagattagtttagacatctaccaccctgaaaactcagtcaacggcttgattgtctagatattatgtttcttttcatacttagtgctgcatcagttaagtttgatctactaagtcgtgcttagaaccataatccctagcctgcttcttgattgccaataagggtttcatcggggtttcagccggtgagttatctggacgttgcatcggcttgtaaggattgcatatacatacatattggatttagccgatgacaacaaaggtttcactgtttaatctaatcttgtagatttcatggcatcggaccgctagccgatgtgtgctttaaccttcggatcagtgcttgttctactatatcatattgttagccgattggtttctactggatattattgttatattttattaccatcagccgattgcctttatatcattatctacattggacatatagccgattgcttaaaccctatcgctatcggctggtaccggcatcggctattatcggctatcggctggaactgctccatcggcttgtcagccgatcggttgttttgatctactatttacatatcttgtcagtggcaggatcaaactgactggcatgcctgtatctcatcatatttggacctgcactggagctaagcagatctcctaggccgacgtgttcaattttttcgtcaacggtattgcaggtctcgatggttcttaattataatatatatatcgtatgcgtgcaacacatgttgtgaataataaataaataatctcaacccaataaagtctgtttctgccatttcactttcgatagattttaggtctatgtctttcatttttctttcgtaagatcttgcatcaaaatttgtgtttatttagatctaacatgtagttacactagttacagtaaacttactaggttacgttgcaccaaaattagattcttttttttacaactgttttgtttctatatttacgatttttggcatgtttgttcctttttatttcatttaaaacgggttgtatatattggatgaaaattatgtaagatttgaagctccaagtctatcaatctattgataggtagtaccataacagtttacttcggaagatcatcagtggacgacactttctactgatatgaattaagagccatagtgctccaaacaccaacaagtagtagacaagcagctcttttacaacatatgtgggaaaaagaatttatttcttaatttaatttgatagttcgtgtacaacaccattgttattcatgcttggcgcccaattcagggaatgacaaggataagatagaagtgataatttctttttaagttttgaatcgatttatggtatagagttgacacaatttgcttatggcgttaattggtctactaaattttagcggtacagatagatacactagcgaggagggaaggaggattggggaggagagggatgccaggaaggagggagagaggtaggggagaagaggagcactgagagaagagggctgccgagctgggaggagggccagcatgaacgaggggcgctaacatgaattttcttagtccgccactagctacaatatctcagcgccagtaagtttggcgttgagctcttattcaaggtggcgcaaatttgccaagatgtcgaagcgcagtaccactccactgacactgagctctctactgctaaaaacagtgtgcattccctcttttatagcaaagcaaggctagtgcagtggtggaggtcttcagtctcgagacgacggtttgattctgccatccttcatgcttgcttttttttttcccatttcactcaacactttttaatcagtagagtgcctagcgccaatgatattgatgctaaactctgatgatatggtatactcatgccactactagtagagagctcaacacaatggcattggcactaaactccgatgacatcacaaactcgtgccaccttggacaatgtgctcatcttcgatgacattgtaaacttgtgccaccttggacaagagctcagcactaggcattggtattgagatgttatacctcaacacagtggcgaatatagaatataaactatgaagatgcgggtgtaaaaatatagtatgactgaaacaacccagtgtgatcataggtgctccatgataggtgtgttgagctgcattagataatgcaataggattttgatagtattagcactataatgatcataggaaagggaatacatatttctcgaacaatattattacattagctcgttaatttcgaaccaccagctacaaactttcaagaaaaaaaatgtattcatgcttgtccgtatcacatgagaagcgttactccctccgtattttaatgtatgacgctgttaactttttaaccaacgtttgatcattcgttttattcaattttttttgcaaatatgaaaatagttatgtcatgcttaaagaatatttgatggtgaatcaagtcacaataaaataaatgataattatataaattttttgaataagacgaatggttaaacgttggataaaaagtcaacggcgtcatacattaaaatatggaggtagtacattattaatccaaataataggctaaaattggattatttaggtgccaattaagcataggtagttgttgactcctcatcaatctcctcaagaaaagggtaatctgtataaccaacaacgggatcctgtgtataaaaggtagacctgtcatacctgttcaatggtgcgtcaagctcaaacctcctcggcaagtcagggttagccaagaagagcctcccgtaggcgacgagatcggcatagccatcagccaccaccttgttcccttcctcccggtcatacccgccagcagcgatgaaagtgccattgaactgcttcctgaatggcaggagaccatgggtgatcttcctccgtccttcgacgatggccattcctggctccaccatgtggcagtagagaaagcctgggtgcttgttgagttgctgcaccatgtatgagccgagagctaccgggttggagtcgaagcagtccatgtagttgtcgaatggcgataatctgattccaacacggtgcgctcccacctcggcgacgacggcatcgatcacctcgacggcgaagcggcaccggttctcgaggttgccaccgtactcgtcggtgcggtcgttggcgctgtccttcatgaactggtcgaggaggtagccgtgcgcgccatggatctccacgccgtcgaaccccgactcgatggcgttccgcgcggctcgcctgaagtcgtcgacgatctgagggatctcgtctgtccggagccgccggggcttggagtacaccatgcctgaatcgtccggtgtgatctgcttatcggtgctcgagatcggcgcctgtccatttggctggaaatctgtcgatttcatttcgaaatttaattaatcaaccaacgagcacaatttgcaatgacctttgaaaaaaaatcaaccaaccaccagcaagtggacgaacctgtggtggagaccctgccgacgtgccatatctgtaggaagaagagggcgcccttgcggtggacggcgtcgacgatgggtttccacgcttcgatctgctgctgcgtgtagatgccgggggtgtccgggtagccctgcgcggtgggggagatgacagtggcctccgcgatgaggagtccgccgttggtggcgcgctgcgagtagtacaccgcggcgtgcggctgcggcacgtggccgtaggagcggcaccgcgtcagcggcgcgagcaccacccggtgggacagctccagctgccccatcttgtacggcgtcagcagcgggatcgcctctttcgcaggtgcgtgcaccatcttggcctggagtgcgcacgcgatttcgtcaggtatagactggtagccgcttttctgttcccaactgcttcagttagtgcaacaaaccaagaaaaagaaaatctaacaaatgtatgggcattcacctcacgagcgcacacgaggtaacgacggcctggattcctatccgtgcgtgaggttttgattgccacaggaaaacggcagcaacacttcaacaccggcggcgaagacgccatggatgtttggagggagagtagagaggaaggttggggaaagaagacgacagtgcgtgtggtttggggatggatgtgctggccctctctatcaccaacacaagatcctggtactagaaaagatgtactagttattggggcggagctagcaccaaaactaaggtggtgcactaccattgaaaacctataaaacttcaatcgaatactgtgcatttcagtgttttaaagtgagaaatcttggctttaggggagttcctgtgcatcagattagctgaacgtggctgactagtactataccaccaacacgcatgacggggacagcgcgtgtggtttggggatggatatactgccactctatccccaccagctattaggacaggtgtgggtccagttgacatgactatacttaggccgtgtttagtttcaaagttttcctttaaatttctaactttttcatcagatcaaaactttcctaaatacataaacttccaacttttccgtcacaccgtttcaatttcaaccaaactttcaattttggcgtgaactaaacacagtcttacaaaggttacaaaggccgtgtttatacctttgtcacatcgaagatacggacacatagaagtattaaacgtagtctaataacaaaaaaaaatacataatccgtctataaactgcagcaccatattgttaaatatatagcaattaggcttaaaagattcgtatcgcaatttacacgcaatctgtgtaattagtttttatttttatctatatttaatactttatacatgcattcaaacatttgatatgacagggtgaaaaaacttgccagaagatctaatcaggcctaaagaatacggaacacagaaaatgaatgaacggttgcaatagatatggactggtagatgtatgcacgaatctccaagttgagaaaattccatatgtacccttgaaacttcacccaatcccttctattctcctgagatttgtttattttctttcatatccctaagtttcaatttggatcccttctatacccctttcatcagttgactattatttgaccgttaaatttctatcataaagttcatttttctttttggtatcaagaaaatataaatttatgaagtatattgataaagtgtatactgatatgaattaggagccatactgctccaaacaccaaagtagacaagcagctctttttacgacatatgtggcaaaaagaatttatttcataatttaatttgacagttcgtgtataacaccattgttattcatgcttggcgccctttaggaaatgacacaggtagatggaagtgataatttctttttaagttttgaatcgatttatggtatagagttaacataatttgtttatggcgttgatcggtcaactaaattttagcggtacacatagatacgctggggaggagggaaggagggttggggaggagagggatgccaggaaggagggatagagtgtaggggagaagaggggtgctaatagaagagggctgccaagtagggaggagggacgacatggatgaggtccgtacgtcaacagggaagagagagccgcaggtggggatggagcgcgcatgcggcggggcaagcgatcggaatcagaaccgagaaccgagatggatagggagagttgggcggactaatattttgttggaagcagattttattttttaaataggcaaagattgatcctttaaaaaaacttgttttgaaaaaacatcatgataaaaactaattacagaaataggcatctgctttagcaccaacctcaatgacactgagctatagcctgggacgaacccaaggggtgccgggtatgcactacccaaaaattttgaaaaaaaaacactagggtgtggcgtggaatcatggcaaggatggtagcgagaaagcattaaaatagaatcccctcgatgaatagagcacaatggtgatcacagtttgtccggaggtcaaatcaggataagaagaaaggactgaaggaagaaccaagaagaagaatggctaggtagcttagggcatgatggctttcgttggatggtatcactaggagttcaccttactaattcattgtgcatccacgatgtcgtgcagctgtgcgcattaaaataaccgatcagatcaagagtggactgaaactcgatggtaataagaagatgaacctttagagactatacaactatcttaactgacaacgggttgcggcaagggacgaagcatgagtggactgctttttcttcccctgaattttacagatttttcacgaattctgaaccacagtttgattatttttttgaaaaattaaatcaaaatttgccaaaattttgctaccaaaccttgatgttttctttttaaaagatagaggggagtgatccctaatagacacactcaacgtgaatttccttagtcctccactacctgcaatgtctcggcactagtaagtttggagttgagctcttattcaaggtggtacaaatttgccaggaaccaaagtaccactgccactgacattgacctctttattgctaaaaatagtgtgcattccctcttttacagcaaagcaaggctagtgcagtggtggaggtcttcagtcccaagtccatggtttgcttccgtgatccttcatacttgcttttttttttccatttcactcaacactttttaattagtagagtgctcagggccaatgatattgatgctaaactctgatgacatggtatactcgtgccaccactagtagatagctcaacacaatggcattggcactaaactccgatgacatgataaactcgtgccaccttggacaatgtgctcatcttcaatgacattgtaaacttgtgccgtcttagacaagagctcaaagctaagcattggtattgagatgttatagctcaacgcagtggcgaatctagcatataagttaagaagatgctggtgtaaaaatatagtatgactgaaacaacccggtgtgatcatgggtgctctgtgataggtgtgtcgagctacatactctaacacagtaggattagcactataatgatgataggaaaaggaatacatcgatttttttaaaagtaatatgattttaatggaaaatcgcaaaactatagatcagtttgatgaaatcgcaagtttagcaccctatcgaacaatcacggttcgataggggtacctatcgaacaactacaactacagttcgacaggtacatgtcgaactgttttagttcgacagggtagttcgtccaaaaacaaataaaaaagtacatgaacagtatcactacagtgctagacagggacatatcgaactgccaaagttcgagaggggttgcgtgaacagcgcgctatagtgatgctacagtgctcgcaggcacatatcgaactgcctaggttcgatagggtattgtgaacagcgtgctacagtgatttttccttttttaattttttttaatcacctgtcgaactgccgcaggtaccctatcgaattgtagttgttcgataggtatcctgtcgaaccacggttgttcgatagggtgctaaacttgcgatttcatctaaccgacctagacttttacgattttccattaaaatcgtattattttcaaaaaaaaaattcgaatacatctttctcgaacaatatcaatattacattagctcattaatctcgaatcaacagctacaaacttacaacaaaaaaatgtattcatgcttgtccgtatcacatgataagtgttacattattaatccaaataataggctaaaattggattatttaggtgacaattaagcataagtagttcttgactcctcatcaatctcctcaagaaaagggtaatctgtatagccaacaacgggatcctgtgtataaaaggtagacctgtcatacctgttcaatggtgcgtcaagctcaaacctcctcggcaagtcagggttagccaagaagagcctcccataggcgacgagatcggcatagccatcagccaccaccttgttcccttcctcccggtcatacccgccagcagcgatgaaagtgccattgaactgcttcctgaatggtaggaggccatgggcgatcttccttcgtccttcgattatggccattcttggctccaccatgtggcagtagagaaaccctgggtgcttgttgagttgctgcaccatgtatgagccgagagccaccgggtcggagtcgaagcagtccatgaagtcgacgaacggcgataatctgattccgacacggtgagctcccacctcggcgacgacggcgtcgatcacctcgacggcgaagcggcaccggttctcgaggctgccaccgtactcgtcggtgcggtcgttggcgctgtccttcatgaactgctccaggaggtagccgtgcgcgccatgaatctccacgccgtcgaaccccgcctcgatggcgttccgcgcggctcgcctgaagtcgtcgatgatctgagggatctcatccgtccggagccgccggggcttggagtacaccatgcctgaatcgtccggtgtgatctgcttgtcggtgcttgagatcggcgcctgtccattcggctggaaatctgtcgatttcatttggaaatttaatcaatcaaagagcacaatgacctttgattctttcgaatcaatcagtaaccaagtagtaacaactagcaagtaaataatctggcagatggacgaacctgtggtggaggccctgccgacgtgccatagctggcagaagaagagcgcgcccttgcggtggacggcgtcgacgatgggtttccacgcctcgatctgctgctgcgtccagatgccgggggtctccgggtagccctccccggtgggggagacccccgtggcctccgcgatgaggaggccgcccctggtcgcccgctgcgagtagtacaccgccgcgtgcggctgcggcacgttgccgtaggagcggcaccgcgtgagcggcgcgagcaccacacggtgggagagctccagctgccccatcttgtacggcgtcagcagcgggatcgccgccgcagctgccactttcgccggtgcgtgcaccatctttggcttaggagtagctttggttcttctcgatcgaaattgctctgcttctctctctgtttcttgctgctgctgctctgctctgctctgttctttgttgctctacttccatttttgttggtgcctgcctctacttataggtgttggtggtcgccgagacgccaagtgttcccaactgctgttgtcaccctctccgtcatcacaacttgtcgttagaaaaaaggtttccatttgttcccgtgggaacagattcattgcatgtggccgttttttagttcgcgtactcctgtggttctgatcaagacatcgaggtagcaggagtttggtgccgaggacggtgccaatcaacgcgatggtgtgtttggtgtgtacgtttgattctgaattcaaacatgaccctatttgtttatggttccgatttccattgcttgttctagtgcgtgtggattcccggagtgctttgagtaaataaacaacttgtttgtagttactctgtatactactactagtattttacgtttcaatactgacgcggttgacaatgccaggtatttataaaatttaaaacaaccaagttgagataagtaggagtatgattttaaaggaacactctatatctttcgaattgcatgttactgtagtattttgtggttaaatttatcatgtgcccgccaaggataaagtgaaatgtttagctcttaaaacataaagttcgaaatacgtaggattctcaaacactacaaacagaccaaacataaacagaataaggcgaattctggtaagtcaacaaaaggggattgttgcatcgaaagaaagcgacgcgaacgttgggccgcacgcgtgcttacgtcctgcgacgtcattgcaaacgacagcacgttagaaatcagtggctacgcgtttgatactaggccctatttaaatttcaactttttttttcttcaaactttcaacttttccgtcacatcgaactttcctacacgtacaaatgtcaaatttttttgttatatcgttccaatttcttcaaacttctaattttagcgtggaactaaacacagcctagacaccttgatactaagattaaaaatataattaaaaaaacttaaattctaagcatgaatctagatatccctagtatttttatttctttgagacggaggaagtaataacttttagaggaaggctgccgatggatgcagtgcggtctaaaacgcacgaaggctagccggcagggggcgatggtgcagtggacccacatgtcggcagaggttggactgtggtggagcatcggggcgagtggcgggtgaaaacccaacccggcctcagctgggccggcaatgatgacgctcaaagcgtcattcccctcctaagggcattgccgtgccgtctcatccctcatgtgtggatgccgggcaaaagcaaagtcttagttctctttgggaccttgacggacggcggcggcagtgttttccgttgcttctctccttagagatgtcgtttaggtatcccctagccaaaaccccaaaccaattggtgcaagctccctctagatttcatcctcttgtagcggcatcctagtctctacaagttggccacgttggagggcctaggggggagaggtgttctattattctctctcaccctctctcccttactcctaaagacttggatagataagggctttgtgttgattgtaagggttgggttttgggtgatctcggccgtgtttctttgttgacctagcggtagccggtcacgcttagcgacgaccggtccaatgctagccttctccttgttctatgtgttggcactgtcgatgtatgggtgtgatggtatactttttttttctttttcctggttacgaccttctaggtttgtaatcttataatttttcttctgctctatcaatataacttcgcaccgtcttatgtgagtcgttccagaaaaaaaaaacttttagggcccctttgaaacgcataggaaaaacacaggaatagaaaaaacgtaggaattgaagtggcatgttttcctaatcctacaggaatggaaaacacaggatgaagagggtccctttgatagcaccataggaaacaaacaaagcaaaagatagtttccaagaggttgaatctcttgcttattttcctatgaaattgagctataggaatgcaatcctaagaaaaatttcatatactttcctatgaatcaaagggtttgataggaaaaaatccttaggaaattaaatcctccaaaattcctatgcaaatcctccaattcaaaggggcccttagaggaaaatcgaatacctgtacatagctaccaggtacatcattgacagcaattgacgacaattgtcatcaatcccaggctagcaataatcttcagttcttgcagcctgctagatcatgcagctgctctgaccaggctgcttatggcgcaccgccgcgttcaccttgatccggtgcatctccacatgatcccacctctgcaacgaggcgtacatgttggacaggccataggcagcgccgtcgtccaggtccagctccgatatccggtccgccacccactcgcccaccctgacgccgtcctcctccgacgccgacgacaagcggcgggcgtgaagcaggagacacccgagaatcttggcgttcggcctgacgggcatcgcccgcacgacgcgcacggcgtcgccgaggagtccggcgcggcagaggaggtcgaccatgcagccgtagtgctcctcccggggctcgacgccatggaccggcaccatctcggcgaagaacctccggccctccgctaccaggccggagtggctgcacgccgacaggagcgccacgaacgtcaccccgtcgggccggatgatcccgcggcacgttcgactcctcccgaccatgtcgtggaacgccctgacggcgtcctcgccgcggccgttcatgcctagccccgcgatcaccgtgttccagcagaagaggttggggccgtcgggcatggtggcgaagacgtcgagcgcgcggtccacgctcccgcacttgaagtacatgtcgatgagggcgttgcttagcacggcgtcgatccttgtcccgagctgacggatgtagtgatggactcgcgggccaaaggcaaagtcccctgcctgcgtgcacgcggcaccacggtggctatggtgaccgtggtgggcatcatgagcgtctgttgctgcactgtctgcgcatcaaccggcggaacatggcgatggcggtagcggggtcacctcggcgcaaatacccggccatcatcgtgttccatgtgacaacgtccggcgacggggaagaggagaaagagcagcccatacaatcgaaaagctcctgcgcagcgtccattctcccggccttgcagtacccatcgatcatcgtgttccacgacacgacattgctcgccgtcgccccgaggctcgcctcgaacacctccctggcggagccgaggtcgccggccttgcagtaacacgtaaccatggtgttccacgaggcgggggtcctgtccggcatccgctcgaacagctcccgtgcgtcggccatcctccgggacgcgacgagcgcggccagcatggcgttgaacgcgaccgcatccctgcgaggcatttcgtcgaacagcctccgggcgggatccaggaggccgcgcctggcgtagcgggtgagcagtgcggtggccagcaccgcatcgccggcgaggcccagcttgcaggcgaggcagtggagggcctgctcctcgcggcggccgggggcatccgccaccgcgcggatgagggccgcgcgggcgttcgggagcacccgaagctgcatcagatcagataggcggcgcctgtgaacaactcgttgctcctccgaacggctgctcctcggcgccccgagcgctgatggtggtggccttcctcccaacgtggtctccgtccatgggggtgggtgctcgtgtggccgtgcctcaccggctcacccgtagagctcggctttagcagcagacaatgccgcggggtgggctcgtcggggtggagctccaccgccggccgccgggtgcccgggtgtagggagaggaatgagatcccctcctcaggtcaggtgactttacagcatatggttcatgtaaagatggctactatacgtcagtgactcaaagttatcatgtgacttaatatactttaattttgtgctgtcggtataattcacgtatcagtgcgacagctacaaattacataaagttactgcacaaagttaagggacttgtttctgagaaggggatataagaagatttttcttttgggcacatagaagatttggaggtgaagaaagtggaaatgggaagggttaattggaccataccattataaataaatttgctcttttttaaaatatcattagtcccttcgtttcaggttataagactttctagcattacccatattcatatagatgttagtaaatctaggcatacatatatatctagatttattaacatatatatgaatgtggcaatgctagaaagtcttgtaatatgaaacggaggaagtactgtttatctaaccgatatcatatcatcatctacatcggcatccacatccaccaaatagctataccaatatccttggacggattcaaagtgaagcggattacataatatcatatccgttttcatctctgaagcgattggttgaaacgatacaggtagtaaattttatttttacttttaaatataagtaacataattgtattaatccaatacaacacgcaatgtcatacaacaatttgttattccccatcgtttcaaaagaaaaccaacccttttggcctctcaccaaaagcaaaaccaagttattcccttcatctcacaatattactacctaatatataattggatattttctagtacaatgatatattaggtggcaaaattttaaaacagaacagtatactacttataactgtcgtagtggtcgccgttgccatcgcgaccgaacgcgatttgaatcagttggagagcaggaggcggcgcacgtccccgttcgggggtttggccagctggcggcagcaacagatggggtaatattgtcccggcttgcagtacgtggtatacgggtacacgtagcccctcttctggcagtactccgggcatgtcaccgaatcacatggcacgatcgcatggcaccaatcatctgtgcacaaatattcgattaagggtcagaacgtttggttgaaaaaaccgataataaatatacaaagaaaaaaaattcgataaattttgataggaatacaaacacaaaacacagtaagatttaaacagaaatataagtacaagataaaaaaaatacataaataatcttttgaatataatagaccaccagaaagacgagggaatcagaaaaaagaaacagaatcaaagatatgtcccaacaagttgaagttcttgctaattttccactaaaattcttatagaattatctattttataggaattttaaagaagtagatagattcaatccttttcaaaggtctttctaagaattttttatacaattgaaatcatccaagtttcctttttttttttgacaatcaaagggaggctcaatgtatgaattaaattttggaagatattgtgtgtcagaatcatttatatagcatgaaacaccatattttgttatacttttcagatgacaccaaaaatatatggctcatataacacaaaacaccgggttaaaaaaatatttcacaattatttgccaatgcaattcttcacatgataaataacagtatttatatgtatactgtgtccaaagttcttcaaatttgactgtctatatataaaaaataacatctatttatgaacggatggagaattgagttatacgtattgatacttttgtaaattaagatggcagaaactcttttataattaccttgtgcagcacatgaatagaccatggccatgagtaaaagagacgccaaaaacatgaccctgttagtgtccttgatgttgagaaacgccatgatagacagatatggccaggatattggaaattcaaaaaggctggctgaatctctcttgtgttctaagcttttcacttgctcttctattgcaatttggaattgctgctacattgctcagcagagcagtttatatagagaggaaaaggccatcaacaatagaattaaattcgatctatcctaatctttgcttttattgacctcttaaacctatatttgaatggcattaatttgttgctaattaacaaatcaatattttggcttcttgggccgaccattgcattcctaggcctgcaagcttgtaatgggcctacacaaagaggacctggaaccatctgttggaataagttcactcagtgaccctcaaaagtgatcgaaatctaatccgtgaccctaaactacaaaacgggatatctcgacccccaaactcttaaaaccggtgcaatttgactcccttggtggttttggagggcggttttgctgacgtggcgcttacgtggcggtattgaccgggtctcctttacacgtggcgtttagatggcgtttaggtggcatttagaattaaaaatatctgtgggacccatttatcattgacatgcaaaagaattgcaccggttttaagagtttgggggtcgagatatctggttttgtagtttagggtcatggattatatttcgatcacttttgagttttgagggtcactaagtgaacttattccccatctgtttgacaagttaggtaatgtttggtttgagggatatcctaaatagaagatggcaattcagtacatactttcctctttttttaatatagcgcagtaggagcctctcctgctgtttaatcgtcaaaaaaaaaatagaagatggcaattcagtttttttagtgtgtttggttggtgagtgacgccatgatggcctacaaagggaatatcccataaagatgttggatgagcgtattcggccaaattggtcggacgaggatatccaccttgttaatcttaatcttgatcattagtaattgattagcaataattaatgcattgtattgttaattagtaattaactttgtcgaaattagggttaattagaccgaattagtctattttgtttttaattagtatagattatgactatattagtgataattattatatttttagtattaattaatatatcattgttttccttctactccttctcattcatccctttccttgtccttcattcaaccaagcaagaaattgaataaccatatctcactcaaccaaaaaacaaaacagaaccaccgtatcattactttgccatgcaccaaacgcacattaagtgctaatttggaacaaacaatatttgaaggatttgattcccatggaaatttttcggtaatcatgaaatattatctttcccatttccttgcaaaaagaatatatatgatcactataatcgagcacagtacagatctgacatcacattacagtttttttattatttcgtgctgtttcagaaaaagaaactatagtcgagtatattgttgtaacagatctatcgcgccgcgccgttgtctcttcatcgtcggacacgtacgatgaaataatcttgagaatcatttggagagcaggaggcggcgcacgtccccgttgctctgcttgtggcagcaacagctggacacagactcacctggcttgcagtacgcccgcgcgttcttcccgcatagctgcgggcacgttatgttgttgcatggctcagtcggctcacagtagtcctctgcatgaactgatacacatattcaattaaaacttgttgaaaccaatatgtatgtttaaaaagctttttgctccaagatttatatgttcttttcctactgaaaacaagtgtacaaagcccaaccaattgatgagtgagtgttattaccatcattagaaagtattaagttactgtccatatgcatatctttatcattactttcctactatacagatatataaactgctaacaatggttaaaactgtttttcttaaaatatgttaatgtaattgattttcacgacaaaccataatactatcgaatatgtatttgtacacaatggtttagagcttgacccgatttttttatatataataattaataaccccgtaattaaatatctggtaattgcgtgcaagtaattagcaaagtaggatggacgttgtttttgttagcgtccagatgtggacgctattctctagagcgtgtaggtctgaacgctattctctagatcgtgcaggtctgaacgttattgtgaacagcgtccaccatacgggtgcagtcgaaccgtgccaaaccggcccaaacatatccacctaaaaccaatcggcgccgaaataactgccgttctctagcgaccgcatcctggcctcctcggcaatccctcatcgccaccggcgggcagcaaaggcggcgcagtattcgtcaccaatcgcacgcgactagctgacaacacgccttgccacgaaagactccatcagcatcgcctttgcttgtgcggctgaccagctgtgccgccggcagctagcacacactagagattcatcacgcgagtacgtattcaatttcatctccattgatcatattgttgaacatatatttgcattaaatttcttccaatcacaagttttccctcgtacgtgcttgacttttcgcagcctacggagatcggcctctccatgtggatgaggtagtggaatcatttgttttctttcaaattgtctcattaccctattgggataatggaactccactacccagccttcatctttgcaattgaaagaaatccaatattttctagagctgattggtaaagtgggtggtaaggaattccatggtgatgatgccatatattcatggaaccactaggctgtatgcatgaaaacatagaacaattacttaaggagattaacatgaatagatgagaaaaaaaacagatttcaacaggtacggcaaactgaaaaaatacccagattttcttcaatggtagatatttagtgctggccatgaggcaccatagtaaatcatgaactgatcacgctatcagcatttttttataagctgtaatcaatgtgaattgctgagaatttatattaccaatgcaaagatatggtgaatgtaaaaatgtaatgagcaattcagtattttggaaacaactcccatgacaaatctaatataactaattatgtatttctttaatccacattatcacaacaatcaagcatactaacaagatggacatatataggatggtataatcacacatgtattacggaaagaactgactatgcatgcaaacaaacggcacttacactacacgtggaggcgtacggcggaggagaccacctgggaacgggatgtgtgggcaagtggcagtgccggcgaaccaccacaagcgtctgaggcaggcggcgttggtggacgggcgggcgtcgccctcgcgcgtggaggagagcagcggcagcggagctgccgagaacgagggctgcgacggccggcaccttcgtgcgattggacgcgcagcggtggcggatggatgggcgacgttgttccgcgcatggaggactttccaggcagtggcgtcgccaagaacggttcctcttcccgtttttcttttttttttccctttttcattttgcttatgttcgtactgggaccgccggaccgacctaggcgaccggtcatatgctggacgtagttagccagagcgtccagctctggacgattttacaaacagcgtccacatctggacgctttattcttcagcgtccatcctattattaaaaatcccaactttgatttaccagatatttaattatggggttattaattattatattaaaaaattcgggagcttgactacatgcattctacaataacatctattctcagaaagaaagagtagcccttgtgtatatgcttttataaagatgataataaaatgcttataattaccttgtgcacaacacaaataaatcatagccacgactacaaaaatggccaacaacatagccctttttacacccttgacacttagaaactccatgatcgagatatgtggctagggatattggaaattaaaaaggctagcaagctatagctattccttaactgattctactctctttgctcttatactgcgatggaactgttgttgcagtggtaaacagtgtagcttatatatagagagagagaggggaagcggccgtcagtaatcaaaccaaatcaaatctatgagatctcttcaaaaatacaatccatgcaaatcttgctttttattgacctctcaaaaaaaatctcacatttgaatgccattaatttgatactaataaaaaaagattctagtctcttgggccaattccaaaataaaacaatttctacctatgaatctgaaaaagctgttcaaattcatacgtaaaaatagtttcattttgttcatattcgtatttagaaataactttatttaggatccatttgcgtttacttggcacttttaaccaaaatttaaataaaatattgccaaattcattaaaaataattaaaatttgaaaatttcggccaaaataatatcatttcggggagtctgatagaacgaaaatttcctgcgtgcaactgacttcttacttttcagtgtttatggggttttgctgcccagtgggcatggtagaggcgtagagctagactgctagagcatagagcatagagttaatctccaattgtggctagagaaggagtattttgatatgtggatcatagctaaagaaagtgcgttgaaggatacccgtgacagtgagacaaagcgactgcatatatacaaaaatcaacacacgccacgaacatgcgcagtacaattaatccctcgatcgtttatttcaaccgaatgacccatacaaatacaccacacgcaacgcaacacaattagacatatagtatatattgcaattaataacttacaatattatcaaagcacaatgatgttctgatatcgaaccagaactcccagaaggtggcatgcagaagaagaagaagatcgacgtaggctagcagccgcaccatggccggcggcgaccaacccaacatctcggtggcggcggccggcggccggcggcggagaggggtgggcgggggccgggtcagtcgtcgcggcaggcggagctcttgggcttgacgatgaacttcatctggcccatggtgcagtggatgccgccgcgctcgccgcagacgaagtagtggggcttgcgcttccggaggacgaactcgtagcccgacccggcgccctgcatcacgttggccaccagcttcgccgccttgaggttgcacgactggtagtccgccgcgttccgcatcatgtacacgctgtgcgcgtgcgtcgtcgcgttcggcgggtcgtacatgaacactgccagtgccaccccccataccattgttcatatatatatacttattaatttcaccaacatttttttttaaaaaaaatattagactcaatcaaggttcaccgtgttactccatccctccgttccaaaatattagcatttataagttgtttagcaatagaaaatagccaaatatactaaggttaagggagaaaaaagttcttttcagtcatctctggttaaattcggaattccttatatttttccccatatatctgattggttaaaatttgtatggatttttatgtattcggatcagtgttatagaaatggtcataatacggtgtaaattttaaatcctagaaatacttatattttaaaacagagcgagtaaatatcattgtataataataattcaaacatgtaaaagcattatttacggcatacatactagttgtgatggagtgtgagatgcaggggcggagctagtatatattaggggagtgcccaggaacccggttaagaaaattttttagctatacctcatctatttttatcatgtatgcaccccctcaatacaaacttaggcacccacataagcttaaactcgatctaaagtagagtaaattaagcaactagcaccacccttcatttcgctctagctccgtccctggtgagatgttacgtaccaaggctgtcgttttggaagaaggggcccttcttgatgacccagtcggtgtagttgtaaccccacgtccaccgcgccgcgtcgccgacaacgaaccgctcggcgcgcgccgccgccggcaccagcaccagcatcgccaacaccgctgccaccaccagcgttgcactgctaatcctcccctccatcgatcccaacgaaatcctcactctaattaaccaacaaattctcttcagtctccggcaaagctagcttagctaattaattaactggatgaatggatggagatgcttgtgatgagcaatgacatggcgatcgagatcgagcatgctggtataaataggatagccaagctgcaggtagctttggggacgtaatgatgtcgcaaagttgacccacacccagtttaaacctgggcgaaacatcgggaaatttaaattaaagaaaattcgtgtgaaactgatgtgccatgccgtggattctgcatcacacgatttggttgggacgtaattttcaggtaaagcagcactcgatatggagctcgcgttctggattggtcatcgatcaagtgccccattagcgagcgtgcttagtggcctcgtaaaaatttggagacacgggggttggtgagcaaactgaccatttcactggtctaatctctagttgcttccattttgcagtggtgttcagccattagctaggagcttagctagccatgattttttttttattcccctctcgagttcctttcgttgattagccaatagccaccatgtcagcatgattactgtagaggattagggcggtgataggagatgattaattaagcaggcgtgtgtgattaaacgacagtgtatgtatatacgcctgcttcatgatcacgtcatgctgatatggactacgggagtcgacaggagtggattagtggatgttgcgtcgagtaagcatcacttcgattattacactggtcgatcgatcgtgaattactccacggttctccgaccaccgtcaaacgccggagctgtattaaccggcaaccacacgtaatttaaggtcagcttgtggtcaagtctggcctaattttgtcggaaaatcgcttagcttagaatacttaaatatgcctagcttctcctgtgcatttagctttgggatgcagacacagatttcgcctgtaatgcgtgcacgccgctgcaacataaaatcgaccgaaattcaacggaagatcttgcttgcagatggctactagtataactgtttgcgcacatgcacagatgcagccgatccatcgatcccggtagtagtatatgcgtaacagcgtgtatgcgtcatcgataccaaagggtagcagagcatcatgagcagaggcctctgtattcgagtgttgtggcatgtgaaggttcagacttctactgtgctgtattatacaatgctactgttcataggtgcccactgaggcactgaccaagtgaccagtagtccagtacgtagcttggaagacaagattaaaagatgagcggcttaatgatcacgaactcatggtgtacattaattcgaccggccggccattgcgaaagctgtggcagagagtatacgcaaaccacaaggctggggctgggcattttctttgcttgagtggatcatgtccttatggaggatgattgggatgcaatgagtgtttgggcagttggatttaacaaattgagtgtatatgacttaaacagagttaagtcaaattgatgtcctaataatcgaatgtacctccacaccaatactaccatgaatgaaattttatagaaatttgaactaaatatgtgaaacaagctcatgtcttccaaaggaagactacaaagcggaagttgccgaaatagaacagacacgtgaactttccaccggaaccgctattctcttaccggcgcgtgacgctcacgccaccaaggcactcacgggggaaggctaaaacaaagggctgcagga

SEQ ID NO: 67277 - DNA, 2880 bp, Oryza sativa
gcaggtctcttgtagcgtaaagaagagaacaggctggaaacattcgctccaaaagagaactttttgaacacagggtcaagttcatgtaacgctgcataaattactgagcagtgaatggcaatatctcaagatatattgttataagtatacaagtatacaaacaatataagcttttcaaagcatggaaaatactaacgttaactagaaaaaaacaaccaaacaggcaaattcaaaaacaaactaactcaagaaaatttctcttaacccagattaatggaaatgcaaacagcagaaatagcaaggttgaacaagaaaatttatgttcagaacaagaaaagaattaccaataaaagtgctacacgattggttataagactattccagcagcacctatgaatcgaatgcaatcttgtttaggatgttacgttgttatctttcggcctagatgcaatgtaaatatttgtttgagcaatcagagaagtctattacaattttcgacttctatatttaagtaggaaaatccctgactgtttctcacaagaagtcatcatgctaagacaatttacaacttgcatagcaagtggcatcaggttccaaaccatgcaacataaacaacacaataatcttgcaagattcaatcaatcatcatagtacaaactacacacatgtataaccaatttctacttggcatactgaccgtgcccaactttattgattgaaagttcctttgcctgcttcaagcatccatcatctccaaatgccttttctgtgagtaatagaaacagcaaaatatataaatataaatcactatccaaatccaagtaaacctgcacatgctaaaagatgtaaagcaacaacagagccagaagaactgttcgacactaataggtctgtaactagtacacattatcttcttgtttttttttaacaaactaccaaccaattccttgttcagatagcataactgatgaatgttaaactccacaactccaagaggatgaacttcacttaccctcaaagaagaaagagatattctccgcactcttgaagaaaaagtcgttcttcacctgccgctgcattgggaaacaatgtaacagtaagttcaaaccgcgatgcatgtgccactggcaatcaaatctagcagcgagactagaaactactcctcctgataatgtacatacgacaagcatacagagacagctattcagtaaaggggaaaaatatctttccccagacatacgtgatcctttgtggagaagacgtcgccagcgccgtcgaagccgtcgacgagctccgccatgcggtccctcatcgccctcacctcctccgcgctggagaacgaccccagcacgaggtaccctgcgaccaacgagacccccccacgcgcgacaaggatttaggtcccctcgtatcgtacatagttctagctgggcaattcgctgcctccgattgctgggagcgacactgaccagatggccgcggaggaggaggaggggaggggaacgagcggtggctggcgcttaccattggcgtcgaagaagcggagctgctcgtcggtgaggctaccggccggcggcatggcggcggacgggaaggggagatgagaagtttgacgaaacagggggcgggtggattgcaggagtggactacaggatactacacgaaaccgcataaagctggaataattaactactccgtatttgccactcggccgtgtttgcaatccttcgttcccacccttctccatcgtattccccacacacacgtactatttaaaattgctaaatgggtgttttttaaaaaaaatttatacaaaaattattaaaaaatcatattgatatattttattttaaaaaatagctaatatttaattaattacgcgctaatagaccactatgttttctgtgcacactgtacatgttggaaacccatgattgcaaacacagctttagggcgttcggaaccaagtgctcgcacggaaaacggagcgattcattagcgcgcgattaattagatattaaataatttttttcaaaaatagtttaatttgtttttaagcaacttttgtataaaaactttttttgtaaaaaatacaccgtttagtagtttaaaaaacgtacgcgcggaaaacaagagatatatgttgagaagagagggtgccgaacacagccttaatgtggtgataaaattatttatcactaaacccacatgtcatagatatatgagttctcacatgttatagacaatgagtggcaaataattaattgtcacatcttaaaagtggcataaagttaaatgtcccatttttacgtttccttgaagcaaaagcgggcatcgagtttcagccacaaacgtttacgcttccttggagggaaagcagattattgtggtgcgagcgtcttgggcttttgttttgtaggcttctaagctgcctagcaggaagctgggccttactacatactccctccgttaaaaaaaaagacaaaccttgggtttctgtgtccgtcttatatgaaagtttttttataattagtatttttattgttgttagatgataaaacatgattaatactttatacgtgacttgtctttttaattttttttcatattattttcaaataagacgaacggtcaaacgttggacacggaaacccagggtttgtcttttttttaaggacggaaggagtatatcggaacctttgatccgtacggataaggtttttttttcatttttcatttatttatttatgaaaatatttataaacataatttttatatttttcaaagtattgcagatttaaagattctacacccgagcttcttgatagggggtaatatttgaaattacaaattatttttctaaatatttcaataaaaaaa

SEQ ID NO: 67278 - DNA, 1354 bp, Oryza sativa
aaggccggcgagctcccaaggaaggtggccatggcggtggcacggtgcgttcttggcgtggcgagagtgagcaagcaaagcaaaggctaatgtaacgaggatttttctggagatttttcctcgcttttttttttgggcgtcgttttgcagcgtctgttttggggcgaaatgtgtccacacaaaacaagcacggctactacacgaggcttatctgctactactcgttatctgctccgtcttgagggctacgtgccgaggcctgatggcgcaatctgacggctttccgttgtcgacaatacgtgatcataagcacatcgggaacacaaagcaagccgcattgcaaaaaagtcttaaagacatttatcttttttgagtctcacaaaaacttggataagactttcggtgctctataaccaattttgcataaacccttcccttcttaataaattttggccggctcagctatagaaccaattttgccaaaaggaaaatcggtttcattacaacaaaagatcaagacaacgtcgcagcgggcctgggcctgcggtgtagccgccaggcaatgtttccccatggaagaacgacgcttggttgcagaaccaccactacagtggtttcgtacaatatcacagcgcccccgtctcaagaaatggggtatagtaataatatggagaacaaggacgggctacaagaatgaacaagtttatataaacttacacttatcattgtcatctgtcagcacctgaaacaagcacggtcccgctgggtacgtctgaataacagcattctagatttcaatagttgacaaaagtcaaaaccagtacgtacagcttttaagatatttcaatataattaaaaggatgaactcagaatgtacggagttgaatcaagaaaacaaagcaacatagtcacacaacttaacaagatgcacatatggcagcattgtaaatgaatgaactattactacaaaacctgaaaactgggtattatgtatgtcacctaaaacttatgcaatttttcatttgtatcctaaccacctgtttatatcactgaccaagtttttacggatagaaactatctcatcaaggactcttaacgtagtatagtaacccactatgacaggttaaaacagagtaatagaacctgaaaactgggtattatatatgccacctaaaacagagtaatagaacctaacgaggatttttctggagatttttcctcgcttttttttaaaacagagtaacagaccgaattttaatttataataaactttatcaactcaaggacaattcaatagccagacgcaacggttgaaagtatagtaacccactatgacaagttaaaacagagtaac

SEQ ID NO: 67279 - DNA, 779 bp, Oryza sativa
atgaaaagcactcttagttaccatatcaaaatgaaaacgcactcttagttaatatatcaataaaaaagaagggcaaggataacctgactgtgatctacttcgtttgacttggttaatcgactaattattcccaaaagtatgtgtaagtggctctaaatccaaaaaaaaaagcactactaattagctgttcagcaaaaggaaaatataagagattaatgtatgaatttccgtaagccacctcacgtatcaaaggatgaaatctaggctcccaaatatacaacacagaatgaagcaaaagctgaaaacaaaaataaaatgtcaagactgtgaaatttaaaaaaaaacatctaataaattttaaagtaagtacccacatcaactgatggtaccacttcacagtctgaaatctcagtaagtatctcatgattttgtttgagattttcaataacatcataagaacaatcagaaacctgcaaatcattaagatataaaaaattgtgctttcaactaacatgaaatgaataaattcaaataagtaccttaatgtagggtttcagtttgacaagttcgctaagaaatttacatatctgcatgttgcatctgaagcaagtccttgtgtaaaattgtcgctgcacaaagtcaccaaaaagaagccccttagccaatataaatacacatgaatcctctttgcttgcgtgtctgtttgaagatggagtgtatataaaacgcttacttgtcggagagaagaaatggtcaccatataaggatgttgatagctg

SEQ ID NO: 67280 - DNA, 5727 bp, Oryza sativa
atccagacgctaaagctgcattcagcgctacaattgtctttgccttctctagaaaactcctgccacagagcacgggggaaagtgcagaaagcatgtcagaacgtctaagttcaaaataataatattcaattcaagagcaaaaaaaatatgaatgacttgcctggatttgaaaataattatacaattgttgacaaaggacaacaaggtccttgccagcactatcagctgcacctggattcagtttgtgtctttggcactggattgcacaagtaagctgattgtctagacgtctaactatagatggaagcaaatcatccacgatgaagagcctgagactcatatcatcagttgttgcaaggtgaatgagagaacgtaaaaaaggaatagccttgcttgttgcttcatcatccacaaagtacccaaagaggctcatatccagccagtcaaaacaatcaccagttaaaataaacctataagattagcagctttttacttgttctttatatcaaaattatcatccaacaaaaaagaacataaaaataacattgatagtagattacaagttagccaaagtagtacctaaagagagagattgatgacatagattcaggatcttgcaaatagttttcttctgttactgccaatactccaagaaattctgaaacttcacgagtgaaatcaagtagtaatttttgctgtagcttttctgtctcaccaaattcagaaaggaatggtacttcagctttccctttgtataaatgattgaaccaagcaaaattaagtacaaatttacactgtcgtaacatgggttgtacaaacttgattgccaatttcttggagaattcaggagggcaacacaaaaccaatggaatagctacataatggataaggctttttcaaatgcctcacttccatagaccctagatctttagtgatagtagcactgagagatagactacccaataactccgaaaatgatccaccaatggatggacatagacctatgccatcatatctgcagtatgacacaggccattataggatgaaatataaaagcagcaaataagtaattatcataacatatatttgctatatgagagttaggttcatgacaggaagctctgggaaccagcaaagggaccaacaaagaataaaggaatgattatttaggagaatatctaacaagtagaaaaattgaaatagtatatctgaaccactataaacagcatacttacactttctgttgaattccctctaacaatgctcttgtcttaggttcaacagaactctccacgatattaatgttagacaatccatcagtgattttaagtatatgagcaagctttgtaaggctcatatgtttttcttttttaagatcttcgaataaaccgtcaacaacttgattttcccgaagcgagtgtatatattgaatcagctgaagacaaagaggtcaaattaatcagatactatacatgtagttatatgcaacttaaaactatagcttcaataccataataccgtataacttagtttgaattaacacaaggtttatagggatattgacatgtagcagcaaagcaacaattgattgtaaacgtgttactcagcaaatatgataatgcacaggcattaagtttttttttttggcaattcacacaaatttagggttttatttttatgagatcaagatcaatgcataagatttgccactgttcactggaaagcactcggatttagtgttttgtttttataagaaaactggcctatatattgttttccatgtgagatttgcaactattgattgaaaagcattctaaaatttagtggtgggttttaagaggctaaaagacacaaattcaacattaatttattggtagtatctccataagatggctaattttcccgtgaacaataaaggattggaagattagaggctaaaagacacaaattcaacataaatttcttgatagtatctccataagaagactagttttaccgtgaacaaaaaaggaagacacaaattcaacatgctaaaagacttaactgaatccagttcctaaaagaaagagctaattcaaccatctaccatcttatgagattgagaagtttgtgatgctggcacagaacttcatccatctacatttgtttattagttagaaggaattttgttgaaaccattataatccctttgcagaaaaacagtacaacaaccaatcagtaaacaatgtcaacaatacagaaagacttgttagttagtatcaccggatcgatgtctgccacatgcagcaagtatcaagatacttccatttgaggacagcacgtttatgtttcggtgtgcagattaacttgatatacttccacacacttctaatatattaacgtgcaatccttttgcgctttcgtaaagatatacttccacgcacacctggaatttgcaggccggtcaaaacctaatactagcggacaattgcaattcaggttgcatttgctggacaagaaacctaccatggcttctggtaacccacaacaatttcaattttaggtttcgtatatcaacaaactcagtagtaattggcattagtaattaaaaaaaacgcagtctaagctacctgtttttgttttttttctgaggggaaaaaaaaagcacaaacctgctgctctgagagccctgaatctccagcgacaggagccgctgagtcaggcacagcggaggggaggacagtgtccatggcggtgcgggtaactgcttccaccgctcccgttcaccgccggcgcacctactcaaagctccggtcctcccgtggcagcgaaggcgaggaagccacaggcgagggccggagggccgcccgtggtagctaggcggcgccggcgtttccgcggggcgagagggcggccgccgcccgtggcacctaggccgggcggcgcgtcgattgccgggatcggggttagggttggggcagcggcgccggcggcttggcttcccgacttcaagttgcctacgggctacacgtttttttttttttctaaagtaaatttcactttagtccacttatatcgacctactgtaagttgtacattgtgctaggggtgggccactttttttcactttacaccacctatttttaccctcctttacaagttgtaccatgtttactgtaaggctgggtttcgacccacacaagtaggtgtacgtttactagcggccgacagtccccgtctctgggcaccagctgcgagggctccctcgacggcggttccgcctccctctctggtatgaccgtatgagtacttccctcccaactcaaaaaagtctcccttgacacgtgactgctgtgcagcaacataaactcaacaatcggcgcacaaacgccaccgtctaggtccaccgtccaccggctgaagaccctcgttgcatacggctggggcgaaaaggtacgtggtcgtcggcgccaaggtggagcaagtctcatcatccggtcgtgtcgccagcgtcagggcgaagggcctctgcgtattggacgcccatgccacctcgatcgatggcttcctgaggatggaatcgctggggtcgtcggctggctcgttactagcatgcttgttgggtttatgaggtagacaggtatgcgtctgctattcgatcatggagcaatccatggaggaatgatttgaccctgggacttgggagagtgaaacaaagcaatgtattcaataatttctatgagatttgggttttgtggggtaatcaatattcctctctactcttcgaaaaaactagagtaattaattcgtacgtgttcctcggttggtaactagaaacgtgtcgaattatctcaagaaaagaaaagatcggatcgatcttgattactgctaaatggaatagttggcttttttttcttcatatgcatgatctgaatgggatagttctggacttctggtatagtctcagatcctgtcaacgtaatcagatgtgtcgcgtgatcactacagggtccacgtccactggacgacgaaatgctcgccctcgctgatgaccaccccatcgacgcgtcgcacacgctcctggtatcgcgtaccaccgccaccatgagcaaattaaacaccagctgctcgcgtggattaggccaaagcgtagcctatgccgtaaacctggtccaacacgtaaacctggtccaacatgaaaaagatggtaaaattaggtggtgttaagtgaaaagagaaacttaaccctagcccattatgctacattggtcaatataggtggttcaactttttttaattggaatacacgttaattgccttcacacgttattggggattttaactatttgccacttttacatttgtcaattgctcaaatacccctcttaaatttttagttaataatatgccattggatagagaaacttttctacttttttgccacttttcacactgtacactgccacatgggcttgccaacgtggaatgggcacgtgaggaatgggcacgtgaaataacgaatttacccctgtctccagaacactaaattaggttctatcccctctctatcctgattcccctcgtccgtccaccaccgtcgccgggcaacgccacgccgtcgacgtctgtccgccccgcgccatcgacactggtccgccacacagcttcaacgtccgcagcaggcattattctttttggccaataatgttgccacataatttagaccgatgtggcaatgttattatgtcacgccagctaggctggcatggtcaaaacgttcatatcttagaaataatttttggaaatgtttgtttttaaaattacataaaattttgaaaagttcaaaaaaataaaaaaaataaatgtgtgggtattttgctatttctataacactgccttcgtttttttaataaacaatgttgttaacttttaaacacatgtttgttcattttatttaaatttttttaataatcgatgttgttaacttttaaacacatgtttgttcatcttatttaaaaaattgatgtaattatcatttattttgttacaagttattttatcactaaaagtactttaagcatgatgattttatattttatgcatttactattttttccatgatgatttatattttatgtatttatatttttttaaacaaggcaaataaacaaatgtgtgtttaaaagttaatgccgtcatccattcatctattaaaaaaaacagagtgaagagtttatgccaccaaagataagtttaattttagccgttaccgagtgaaagatgtattggatgggagtgtgggtgcacatctacacccaaatcccggtcatcttcaacccaacttcaaatgcatttctccccgattcaattgagttgttcatactaaaaatcctacagtgattttttttcacagatattttttaattaattacacatgaaaattgccaaacgtcgtaactcacggacattttgccagttactattgatgttagatggattgtagaatagcaaaagttctcaaatgagtaatgaatgtttacagttggttacatagtataggctttgacaataattatgtcacattcataattagcttgggtcatgttacacagtatttgtattggtaaatcccacgagctacctctaggagccgatacaaagaacaaatggaaagggtgttctcaacatatttcatcgagctatttgttttctttaatgcaagggacagtcagtacttttgtcattgaa

SEQ ID NO: 67281 - DNA, 1598 bp, Oryza sativa
gccgaaccttccttcctcgtcgccggtcgccgtgggcctttgccgccgcctccgagcccctttaaaaggacccccggtgtctcctctacccgtcgccgccttcgccttcgcctctcgtcgtcggaaaagccctagcgccgtgtgccctagctttgccgtcgccgccgccgctccagccgtgcttcgccgtcgctccagccgtcgccgtcgctcgggaagaccgccgtcgtggtcgccgtcgcgtcgccgtcctcgtccgccccttcgctgtcgccggagatcgccggagcatcgtcgccgtcgtcaagccgaagagcgccgtcgtttcaatctcgtcgccgtcgccgtccgttcctcttccgccgtcgctttggtcgccggtgagttcgccgtgccgtccgctacccgttggtgccctccgttcgtgccgtagcgccgccgtttgccggcaagcgtgcgccgcccgagccgttcgctccgccgagccgccgccgctgtcggtgacgtcaccgctaacgtcatcggggtcgtccgccgtgagccggtcgtggaccgatcgatctcggccgtccatcttggatcagttagatctcggccgtccgttcgcgtgaaccgccgcccgtgcgcccggtccaccaaaaccctagccgctgacgcaataaaccttctcttccttttcaaaattaattcattattgcgtcataattcaattttaaccaatttaagtgttttaatccggtttaatctttaaaaattcataactaattcatcttagctccgatttagttggttcaagtctctaaatttttctaaaattgagatctacacattaaaaatatccacatgtactgttcatgcttgtttatgtgctattttggtgatttggttcttttctgcttagattccgtcgtttccggagagtccgttttcgccgaagaagagtttgaagagttccaaggccagcaaggcaagtcacacagatcccaaacaaccctttgagcatgttgatcctatttaaagctattgtttcttttcaactattgcatttattttcgaatgtcattgggtggaatcaacctattctttgttatagcccttttgttcttgattactttattccttgataccttgggttattataatttgactggttgaactttatttatattggttcaactagatactagatataattgcttagccctgcttagaaacattagcacactatttggataactaatgactcactgttgtttcatgatggcttaatgatagttcacgatggtcgatcgtgattagttaattaaataatgtgccaactaaaacttgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgtgaagtggcggagataagcccacgggggtcgctggggagtccatgccttgtttataagggggtgattatgatccaggaaagtgcgctgcagtggattgtgttatg

SEQ ID NO: 67282 - DNA, 4953 bp, Oryza sativa
gttcattgccaacagtgttcgtttttccaattcctttgctttgcttataaaccacacttatcgtcgtgtttttttttcatggtggtaatctctatatatctaatacaaaagctcgaatttgagtttgaatgattttaggcttggctcgaatgtgggttttggctcagcttattagcagcacgtacgcaaatcaagtctggtcatcaactcatgattaattaactgctataaacttagacatagatttatttatttttaataaacttctatatagaaagtttgtatcaaaagtgtatcttttttagcagttcataaagcgtgctaattaaaaaggcaagggagtagctaaatcctaaaggtgcattcaaatcacccttagttatttacaaattgttagttacaatatattacctccgtcccaaaataagtgcagccgtgggaatccttatctaacgtttgactgttcgtcttatttaaaaaatttatgaaaaaaataaaaaaatagtcacacataaaatattatttatgttttatcatctaataacaataaaagtactaatcataaaaagtttttaaataagacaagcggttaaacgttagacaacagtgcaaaactgcacttattttaggacggagtgagtttctaattgaacaatatggagtttctaatgaaaacctccttctcagtgtctcttttcattgtctgtactacacaacatgacgtttgcaaaagaagactaacagaaatataggaaattacatttaaaaagacataaggtctagaaaataaaatgtcatgaagtgggtgtgcatgctcaaaattttcgtacatgagtttggtgttacaatgtaatttttttctgaacgcacaaaagaaattacatgttattcctttaaatgttattcctttaagatgaaagaagggtttacacaatgtaaaagtcggagggcgtctgccagggattaggggattgaaggattaataccagaaggtgctattagaggaatgatccccaaaaaaaaggaagaagggaaggaagctacataggtcctatcctcctaggaagcccactagaaactacagaagtattgatacaatgtcacatatatactcacatagttactatttattagtgcattcaattatttattgtgttgatcattattttacccgagatgcctgatttaatttgtctccagttttcttctcctgttcggtctcccatattgattttatctatgacatatgctaatgacctttctataacccatttattcatgtctcatatatattgcccaaatttgctccttggtaactgcgatgaggttttctaaagcaatgggataacaattaggtaggagatcaatacatacatgacaactagagctagagggatccaagaggtgtgccgcccgactacttgagtagaggcataacctgtaggttagtattgaagactattgggaatctgagatgagagaaccctgatttagtagagatgggggaagaaaaaaaaatgaaaacttaaaattaggcggtccgataaatttttcaataatacttttgaccacaactacttattatgaactatatgagattgtaatataatcaatttttccactgtattgacaatgcacaacatgcccgatggtatggcctaccctttcacatcatagaattactctgcagcggcagcccggcaaaggtatcatccatgacaaacgagtttaccctaaagattttaccataaaaatttgaatactataaaacatcttaaatgaaaatttgaacaaacataacatagaatttatttaactagcgctatacattttgtgtaattttacatacaggcaacaacttaagttgccaaataaaactcattacaaaccaagttgttaccttctaatataagctaaaacgtaattgttgtgaaaaaaaacaaatacagttttatactccttctgtttcatattatttttttctactagtgaaacattttttaatttgaccatatttatagaaaaatatagtaacatttataaaaaaaaaaatattatcaaactgtatccaatgttacatttaatgaaactaatttagtattaacaagttaatttagaaaataatcaacatgattataaaacagatgaagtataatttattcaagcctcttcatttattaaaactgaaaaaagaaatgtaatttgagaacaaaaatcccttgctcatctcccttcccttccgttcgccatctaacgaactttcgcggaataggcggttcccacttccatccatgtccattcccctttttcctctccccttcgctactcgccaacagaagaaaaaccctcacctccactcccccctcgccggagccacggcgaccctctccaccccctgccttgccgccggcgagtgtccttgcgtgcgccgccggtgagcgggtgtggatcccagcggcggcgcgatcggccttcgaatcgaactgaaaggtattgggctcttctctctcgtaactggggatcgattagatcggtgttagattggcctatttgcgtccaattagccgatcctatttcgtcccgatttcatttatatgatccgtggtgcgtgctgcagtactaattgcaattttgtttttatttttttttgcaaaataattggggctcagctgaaccctcgttgccactgctgtgaacatgtcccaaattgagaagatcgtatgagctatggggaattattaggattcttggaggcggcggcggcatatggtgttcttcccggaggaggtggtggagcacatccttgggtttctagcgtcgcaccgcgaccgcaacgcggtgtcgctggtgtgccgggagtggtaccgcgtcgagcgcctcagccgccgctcggtgctcgtgcgcaactgctacgcggcgcgcccggagcgcgtgcacgcgcgcttccccggcctgcgctcgctgagcgtgaaggggaggccgcgctttgtccccgcggggtggggtgccgcggcgcggccatgggtggccgcgtgcgtcgccgcgtgccctggcctcgaggagctccggctgaagcggatggttgtcactgatgggtgcctcaagctgctcgcttgctcattccccaatttgaagtcgctcgtccttgttggctgtcaggggttcagcactgatgggcttgctactgtcgctaccaattgcaggtgagactaatgcaagcttctagattttgtgtcgtaatgatctgaatttaggagtcctccattagatattgactttgttggctctgactgtttaagttaatcttgcatagccattttaattagctatgctttacctattgttaggtactcaggttttcaaccttcttgatgttcagtttatggcaatgctcaagtctagttcacatcatggaacctcattcgtccttgtgtacttcgtttcagtttaggctatatctatctattacaggtttagagatcataatcgcgtaactaaaactgtcaaacacaatgcacaagctcctcacaaaatttaggggcaatctaagttttgcataatttagtttgaatctccagttaaatacttacactatttttttgcattagttgttattagttaacactcttttattcatatcaaatcgtgtgatatgatttgcttgtctatttattgggattttgtgtgacttatgtcagaagataattattgaaatcacgaaaatatcacatattcatttttccatgagcacttaactgaaatacttcaagattcctttatccatagttctcaatgtttatgtgaactccatatagcaaggtggaaacaccaagaacaaccatgtaatgttggaaaattgagcaagtcactgctactagtatattgttattgcaattttaaggagcactggaaacacttcattgtatacttacacatgtttgggaaatgttttgactaataaccaagaaacagtgctggagggtggagaactggagatcaacaaaaattatacttcctaaatccatcctaaaggactaaagaaatttaaactattcactgttttactttttcctatctaatagcttttgcatttctcagtttcacagtttcatttataagccgtctcatgtttttttaataacatctattgaccttttactccaaattgaattatgataagttgtttggttatttggatgatatcatctttaagggtgttcaccatccagtattttgtgcactacctgtttgtttttggtggaactggtggtcagtgctcaagaggcaccagtgctaagcatatttcatcggcttgattaccttgatagtcatttaatcatagtagctggcaacaatttggacaactttaaatttgtgatctcatacttctgttctgttacataaagctaactttagatttattttcacctctactgtctctagtttttctgcagaagtattttggctgacacaatgcatcttatgaattttatttataactcttcgctcttagatttatgaaggaactggacttacaagagagtctggtggaggatcgagactctcgttggcttggatgttttcccaagccttctacattactagaatccttgaatttttcttgcttgaccggggaggtgaatagtcctgcattggaaatactggttgcaaggagtccaaatcttagaagcttgagattgaaccgttcagttccacttgatgttttggccagaattctttgtcgcagacctaggctggtggatttatgtacaggatcttttgtacgaggcaatattgttggtgcatatgctgggctattcaatagttttcaacattgcagtttgctgaagagtttatctgggttttgggatgctacaagcttgtttattccagtgattgctcctgtttgcaagaatctaacgtgcttgaaccttagctctgctccaatggtca

SEQ ID NO: 67283 - DNA, 11083 bp, Oryza sativa
tattgaatttatttgtcaatgcaagaaactccaacaattgtgggtaagacttactagaagtaatgcaaatgatttgctagggatttatttaagtaatctagttatgaagtgtgatactgtgttggttgtttatattttcaacttacaaaatttataggggttgctggcgaatgggaaaaaatataggtgtttttttgcgaggttaagtacactgttaacgttcctgcagtcgataggtgcatttgttgtgacttgtgaggttgattatactgtttccctgtttacaagaccgttgcactggaagtatatggaatgacagtgtagatgggatatcattttcttcttatttggaacttctgttttggcaatcatatcctacttcaatcagcttatggtttgagttacatgcttagtaggcaagaatttcatatacttaaacaaaccaaaattcattttagtccactttctagtaactctcactgtttagcagaggtgaattgcacccctctgagttaaataaaaaaccacaaatttgtttgtgcgaatgttgatctgtttgtgcaaatgttactaaaatatctagatggtgagatagatttacaaatgttctagaattttgaaataacaacgttttgaattttcctgtatctttagtaatgctaccatggttttaatgttctgatttgtgttttggtcgcatcatatacagttcaacgtttgtgtcaacatggtactgattccttgatattggaagattgttaattgataacttgataaaactagtctggatccacttcataccagggaaaaagggaataatgccaaatatttgttggactagagtatcaatgtgacctaatcagttcactgtgtgattagtgcacataatgacacaataaatcaagtataataataattggggtgttatactcaggttagataagctttgtatgtgggttgtgttaacaactatttgaatagaagttaaagcttactaactgcagtagaatgctatccctatgtttcttctatttgtgatgcagttgttggttgtttcttcataaatgtgttttggttacctaggccttatccttggtttcaggtgttagatcacattggtgatgaaggattgaaaattgtagcctcatcctgtatacagctccaagagttgagagtatttcctgcgaatgcaaatgccagagcaagcactgtgacagaggaagggctagttgccatatctgcaggctgtaacaagttacagtctgtgctctatttttgccaacggatgacaaactctgcactgattactgtcgcaaagaactgcccacgattcacgtccttcagactgtgtgttcttgatccaggatcagcagacgctgtgacagggcagccattggatgagggttatggggcaatcgtacagtcatgcaaaggccttagacggctatgtttgtctggacttctcacagacacagtgttcctctacattggcatgtatgctgagaggctggagatgctttctgtagcatttgcaggagataccgacgatggcatgacctacgtgctcaatggctgcaaaaatctcaagaagctggaaatcagggacagtccttttggtgacagcgcgcttcttgcaggcatgcatcagtacgaggcaatgcgctcactctggttgtcgtcgtgtaatgtcaccctggggggttgcaagtctcttgcagcaagcatggcaaacctcaacatcgaggtcatgaatagagcagcaagtatcaatgaggcagacaatgctaatgatgcaaagaaggtgaagaagttgtatatttacaggacagttgctggaccgaggggtgatgcgcctgaattcatctcaacgttctaaatccatatatttttgaagttgaaggtttgttcttcgacaaccaccttttgtttatatcatactctgctacgtcgagttgatctacatgttctaaagatctatctatcttcacggtcgaagggatcttctaggattattttgtgtaaattcctttgctatcacctctgctatgtcattatcttccagcagtgctacacttatgattaatctccaaaattgaaactctatagttatggttaacttggcagattgattacacatcatggtaacatctaagccttgtaataccataattctagcaagtcatatgcgtggttcatcttcatgtatatacgatttcatatcgatgctctcatgtaatgtctgggaaatttgaagtgccaaattgttacttttctgagtcgaaagatatgatcagttaagcctgatgaacagctgattcagtagttggaccctccaatttgttgcagcatttcagcactggtcaagactaatctgtgatttacaagttgagaatttgagtagatccccatcctgtttaccttcaaatactctgaaatttttctttctgatgtcgcaatccaatgtccatgtcgctgcaagacagggtggcttggaagtcagtcatctcgctgtcagttgtagcgtgggggtgtactggtgttgctcacagtttgatatcatcatcatggccatcacacaacatgcttattcctgcacggtttagcaagctttaattgaccaccatcatcgcttgctgtttgatcattagtactacatcaattggagtccaaattccaaaatgtttggttataattgcttcgaggcaattaagatgtttatgagggtaaattaaggacttgtttagttggggaaaatttttatatttgattgtcacattggatatacggacacacatttgaagtattaaatgtaatctaataacacagtaaattatagattccgcctgtaaactgcttggtgaattattgagcctaattaatccgttattagtaaatgtttactgcaacaccacattgtcaaatcatggcgtaattaggtttaaaagattctcctcgtaatttacacgtaatatgtgtaattgttttttcttacatttaatacttcatgcatatgtaaatattcgacgtcacagcgtgaagatttttgttttgggaactaaaggtgaaaacaacatgatggtaggaaaagaatgagtatgagcatgcagcgacgtgtgtaggacagtacgggtctgtgtcatcatgtgatgggagagccccattgctctgaaaattaatgtagagaagtttctgcgaacgtgatatatatacgatggagagggagaggggagacagattgggcggtgagaattaaatcataaaatcaggatctcatcgacatgtatgcctatgcttatgtgtcggcgctgcgtatgggtcacatgcacgcatgctactgttcgatgactctgtaattaacattatatttttgtttctttaattagtttttttctcaaagaatcaacccacttcttttttttttcgtgagtcgttgacgcaattcctgacatttgaccttatcaggtacgaatggcagtatggcagtgagaaccgagatatccagtacaagtacagtagaaaaaaaatactcatcgaagggtgataaattacactaaatttctcccccaaatgttttgattgatttatgtcaaatcatacacaagtactatatccgtcccattaaaaaatcaacatagcaccacgaatgtgatcatacatttgtccaaattcattgtattaaaatgtaacaattcgttttttctttcgtggaacagaggaaatacatagcaatgatacaagtgtactggtaatagtgacacgttctttatgaactgaacttcataaatatttgatactcattctgtcccatattgattcctagcaattcttagataaattagtaatgagaaaatcaaacaaatactattgacaagccagcaaatatttgatattcgttctgtataatgtggcgtggaggagagagatgcgagttgagatagtcaggccggcactttacatgagcagtcgcttgcacgggtacctatgcaaccagtgggatccatagtaatatctccgtcccaagataagtgaagttgtggggaaccatgtccagtgtttgaccgtttgtcttatttaaaaaatttataaaaaaattaaaaaaaattagtcgcccataaagtactattcatgttttatcatctgataacacaaaaatagtaatcactgaagcattggatatgaatagtataaaactgcacttattttaggatggagggagtagtagcaatgtagcatgcatggagggagcatggcttagggttgtttctgagaagttggttggaagaatataaaaaagttaggtttcctaactcctggctttgaatttattttctggattctacagctatagcttcttagaatctggacacgtttttggtgggctcaggtgagacttttcatccattaaatgtatcatgtgtatatagcctcgtagagctttaggtggtgtttggatccagggacttaactttagtttctatatttagacactaatttagagtattaaatatagactacttacaaaactaattacataaatgaaagctaatttgcgagacaaattttttaagcctaattaatccataattagagaatgtttactatagcataacataggctaatcatggattaattagactcaatagattcgtctcgcgaattagtccaagattatggatgggttttattaatagtctacgtttaatatttataattagtgtttaaatatccgatgtgatagggacttaaaagttttagtaccatctaaacagggtcttatacatcaactcttcgactagggctgtgtttagttttacgctaaaattaaaagtttgaagaaaaaagttgaaaatttatgtgtgtagaaaagttttgatgtgatagaaaaaatgaaagttttttaaaaaaagttgggaactaaactcggcctagctatatataaaaatcggagtaagcagtaagtttttttattgactttgatcttacaaacaagtaaataaaagtacgccgctagtacaacatctagtaaggccatgttcctgcattagtagcagatagatttttttacacataaaacgagataaaccattcaaacataattaatcaagtattaattattataaatttgaaaatatatttatttgattttttattttttattatatatcagttttaataaaaatatcgtttagcggttaaaaaagcgtgttaaacaaaaacaaaaaagtttatagtttggagttatagtctagaacgggacctaattagtactgccagcaagactataaatacgttgagtgagttgactgagatctatcaggattcggtcattcccaacccaagacactagacatagttttgataaacttcacatcatcatgaaactagtactagacactactctttcaatgcaaacatcactattccgtacttaaatttaatgctacttatctcacatgatgtcttggatgttgtgtagaaaccatgtcttatgcaagacatggtttccttctctttcctcatttattcacttgccacatcatttttcattctagatggcagcttatttaatgctatggactctatcctggtcattgggttgggaatgggcttataattatttccatcagctttgcttgcttgcatatgatacataggggacactggacacaccatctgattaagggtgtttagttcgccaaaagaaaatttttggtgtcatataggatgtttgaccagatgttggaggggttttcggacacgaataaaaaaactaatttcataactcgtctgaaaaccacgagatgaatttattaagcctaattaatctgtcattagcatatgtgggttactgtagtacttatggctaatcatggactaattaggctcaaaagattcgtgtttaatgctctatgcatatgtccaaagattcgatgtgacgtttttaggaaaaaaaattcgttatatatatagctatttcattggttcaaaaataaatcaatcttatataggatatgacacattctaatatgatgaattcaaacacaaaaaaatattcagattcattatactaatatatgccatatttgttataaagattgatttattttaaaatcgtgatagtagatacttcctctgttccaaaatataagggattttagttggatgtaacgtatactgtactataaatctatacagggtatcataatactactattatgaatctagacatgtttcttatctatatttatattactagcatacgtcatattcaatcaaaatgctaaatatttagggagcgagggagtagggccataggagatggaggacgacatacttgtaaaatcaaaaggtgtttttgattattattctgtgatgaacaattgggcattggagattattggttttgttatttggaacttattcacgaagtggttttggagatgattggattttataggtgatcgcaggattcgtcattttatgtgaccggtcagaccgggatctggtagccggtcagaccggcgtgtaatgcgcggtcagaccggcgcagcccgcggtctgaccagccgacactgtgtcggtttcggtttcgggttgtttatttggatatccgagtttatttcatgattataacttctagatggatactatacgtatgtaatactattgtttgttgctaatgagtcaagttggagatagcttggtctcggaatatagtttctttgtttgttccatatgtaagtgactcgatgtcttgggagagtatttgtggtgatggaccgggagtcggcttggggataagacgacgtccgtggtggtcagagatcatgcaggatacttaggctagagttgatacacgtggttgatggagattctatatggcatacgatggagttattgtgtgcatatgggatgcggagtcgaatttggaaggagtccaaatttggtacgattggttatgtaaagtttctttcttgtactatagagttttctaaagtgtttaggactcctagtatgagtttggtttgtggctttaggctgcctacctcatatataaatagagggggagcgtgaggcttcccggtatcgctttagagaccaattgagttgagttttcagttagggtttcaagtttagtcgaaatttttgtaaggagtgctgttggtgcactttgtaaacacagagagaatcaataaagtcgtcatctactttaagagttcttcgatttgtgtttcaccgggtttcggcggtctaaccggcgatctacgggcggtcagaccggcggcaagtggcggtcagaccggcgggagcacggcggtcagaccggcggcggcgacaggcgcggcaggcgactttggcggtcagaccggagattcaacaccggtcagaccggcggcattcactcggtcagaccggcagatcaatctcggtcagaccgatctccgtcgatttcgagggtaacttttatttccgctaaaagttttcggtttttggtataccaaccattcacccctctctagttagcttagttcctgtgatttgatcctacctgtatgcatggaagaacgatgaatcagcataatcagtgcgatccgatattgcggagagcagcttgccgccggaccaatcatgcaaccctacatagtgcgtcgaaagcgacacgtgcatgcattctcgttagtggaaacgtacaatcgaactttggaactttctacgtgtgtgtcatttggcgcatttaactttgagcaaatttcgttaatgaaaaaccccaattattatattttatttagaggaagttcatattttgagagacaaaatgtttcaaggagccccaaaattatataaaacacactcattttcattgttatatatgctttcttaatatacattcacaaatataataggcgcaaaatgcccatatattcctcatgtctaaattatattcttcctcaccctcgctctctatgattgcacaaacactcaacacaatcctcaccgttaatgacagattaactggttacatacatacaaaatggtttatacttttgataatttacaagtgtaaaaaatggggctaatgtgtatatatacttgaaaaatatcacataccatttttttaaaattattatatataaatatattagtcaaatagataatataagtttaaaaatagggttctcgaaacattttacctcaaaacatgggttccttggaacaaaaatcaatacatgggtttgtgagttacacaagccaccaaaacatgcgtttaattttgtggaatttactctttaactttcttccggcttcattatagtgtaattcttccactgtctttgccgctcgatcacatcacttctcctccatcttcattggctccaatacctcctatcaccatcctacactgtctctggtagctcatgccaccagctcccacagccccctaacagatcgaacggcgagattcctctgctaccaacaacgacccatcgctctccttgatcttgtgcggccaaggaggcaccaccttcgtccaccccaccacggcggccacagccccaccaccattctaagctagggaacaatcccatcttcccctaaaacctaaccactcaggagttcactggagacgaagacataactgaatcatataacaaaccgtaaggtcagatattcacacattttgcctacaattaactttatactcggcacttctcctactctaacacgactcgatcaacggctaactttgcataatttgcgacatctactaggctaacactaagcaaagatcggacgatccacgtaaagtgtaaccaacaaaataaaccgtgaccacaccagtcgggcaacccttgtttatttttatgtaaaaaaagatggaatgctacagctgcgaaatgaactaaacaactgcctaataaaatgtggcacacgtctaacatttagaagaataaacctcaaattaataagaacaaattaactaaagctagctatgtactccctccatatttagacttgatcagcatatattaatctataatccatgtaattagtgcatcgaagaaagaaaattattgcttaatttggtggatgtttcattcactgcgtgaaggtgaagagatgcagtgattccctacatataaattaacagtcccatgcgcatacaagcacagattcattcacttcatatatagaaacgaatagaccatgagtagagtaccaaatatatgtgccgatcatttatgaaaaacatcgaaatcttattatgacgatcatttataaatagagggagtatgcatcaatgatgttgagagggcagacgtttacatatgcatttaacctaccactgcactagtgcacacccttagacaacattgtaggatcataggattgacaagatggatcgaccatagcttctaacctacctggctggcatggcatgcatggctgccggatctttgcattggtggttgttacatgcacataaggttaagttgacggtgtagtcggttgggtagttgccatcactcactcatgcatgctgaatacacagcgcaaaagcagccgacaatttgggattagggtttctttctcctggccggcccctcggttcatttattttctcaatccgacttaatgtgcgattgagcaatgataataatgagctatacacttacgtgaaaaagagaaaaaaaatgagtagtattggctctcacgtataaaagtttagctctatacatgctccaaaaaatacgcattatagaaggtttaatagagtatacataaccgctgacgattaaaagtgccacttcagattggagtgatcaagagaccgtatgtttagcagctggctattaacacgaactccaatagattgatccatattttttaatttaactttcacacacaaaatgcttttacgtggaccccacaaccgtatttttactggttggtggcttggtgctgcctgtctcacctaggaatgtgtttggagccaacagttcatcttccagttcatcacttctgcatgcatgcacactacagaaaaaacctcatatacagaggcacttttgtagaggcgttttgtaaattacttctaagatcagaagttttatactgtagagacaatttatagagacactttaaaaattgcctcgaaaacttttactctagaaacattttcagctcagtttatttgattttatcttgatgcattctttcggcacggtaaaatgtgcctgatatgtaaaggcattttcttaagacattttagactatgtagagacactttttagaatgataatgtgtactaaaggactaaatataaataattaaaggcataaacatacgagtaatgacatggagttgagttggttaatgcatcaagagatcttgagtttaaagcctaactaaagcaaggaaactattttattctcctcttttggactagtttcatatgtttggtacaatttaattcctttttttactagtttcatatgtttggtacaatttaattcctttttttactagtttcatatgtttggtacaatttaattcctttttttactagtttcatactattttattctcctttttttttgactagtttcatatgtttgtggtacaatttaattccttttttggactagtttcatatgtttggtacaattaaattcctttttttgactagtttaatacatttgtggtacaatttaatgtctctagaaaatgactctaccatctaacatgcattttataaaatatatcttcatatgtagagacaaatcatcataagacacttattagactttttaaaaatgcctctacagtattgtaaaggtatttgaaaagtgtctctacagtaatagaaaaatatctctacaaagtatttttcttatagtgacattataccatcagtttaaactgtctattatacttgctcttaataaatttatagtaagagagagagagaaggaaaacaaatagagctaacattatagacatgtacatgtgagctctgcaaggaaaagcgatcgagctctactattaaacttgctagcttttaagttaaaacacatgtgat

SEQ ID NO: 67284 - DNA, 3052 bp, Oryza sativa
tgcgggcgcgacggcgcgagcgagatcggcggaaggtgggggaaggacccgacaggtgggccccacctgtcggcgaccccgggagaggagggcggcgggcggcctggctgggcctcggcctgcggccggcccagcaaggaggagggggaaggaaaggagagaatgggccggcggcccattcgaaaaaggaggaaaaagagagaaaaagaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcttgatttcacctgcattttcttggggtcgttttaaaaaaaattttaggcttgggaggagaacttcggggtgtgacagctaagcaattatatctaatatctaattgaaccaatataaataaagctcaactagtcaaattataataacccaaggtatcaaggaataaagtaatcaagaacaaaagggctataacaaacaatatgttaattccacccaatgacattcgaaaataaatgcaatagttgaaaagaaacaatagctttaaatatgatcaacatgctcaaagggttgtttgggatctgtgtgacttgccttgctggccttggaactcttcaaaatcttctcctgcgaaaatggactctccggaaacgacggaatctaagcagaaaagagcaaaatcaccaaaacagcacataaacaagcatgaacagtacatgtagatatttttaatatgtagatctcaattttagaaaaatttagagacttgaaccaactaaatcggagctaagatgaattagttatgaatttttgaagattaaatcggattaaaacacttgttttgattttaattgaattatgacgcaataatgaattatttttgaaaaggaaaagagggtttattgcatcagcgggctagggtttcggtggaccgggcgcacggcgacggttcacgcgaacggacggccgagatcgacttgatccaaaacggacggccgagatcgaacggtccacgaccggctcacgggagagggcgacgatgacgtcagcgatgacgtcaccaccggcggcggcggctcggcggctcggacggcgcacgctggccggcgaacggcggcacttcggcacgaacggaggacaccaacgggtagagcgtgacgcgacgaactcaccggtgaccaaaggagcggcggaagaccaacggacggcgacggcgacgacgaaggatgtcgggtcccaaaactaatgattcggaaaccgacatgtttagactgtatcaagccctggatcagtagattgatacaggttcaacaatctggatcttcattgcatatatttgattaaggtttcaaaggagatattattacaaaatataagggtatttacaagcttgtggctaactattacagcagaagctatagaatgactcaactctaatgttttgctatagacttaaaccatctatctaatctatacttgagaactaagttaaaatgagattaacttatatgattgaactcccagcttcggcaagaactccaagatagactctgaaaaatgggggttgaagcaagggtgagtacaacgtactcagcaagctattatattcaataataaatgtatgaaatggtaatatttgagtagagctaggtttaattgcagaaagctgagaataaagaagtagaaatcctgaaatgtttgatatgcaacagtatttaataaagtttgaaattatgtttctaaccaagatgccatagtgagtcccaatgctcgataaccgcgagcacggctattcgaatagttttgataatattcatactgcagtagatgtacgctttacccgcaatccatgacatgctaatattcattagcttagtcatggcaaagcttttcggttactaacatcagtggtacctgttccatgaactataatccccatgcgctctgaacgtaacgttatcagtagcgagaggagttctggcgttcccgaggtttttagagagaactggttgagagacccccgtcatctcaatcaggttttcataattcacacacacagctcgcgagataatcaagatatttacctgcgcctcggtaaatatcacaattgccctgttcagcgtaagtttgcctcctgcgcgaggacttaaaaagaaccactatacagaggtaccacctttgctagataacttaatcagctaggtctatgcccatacgagaattgcggtcgtactcgtatgttcttcacatgtacttggcaatcttatgtcggttggaacagtactagccacccggaaatcaaccatttctaccgtactgttccaatctaagttcattaaattttatgcataatctaactaggcatggctaagcaaaatctagcatatctggtttgctatgttcaggttatgcatttgaaatcatgtatgactaatgcatagaacagagatatagaatatagggtatttatgctcaaaggagaggaataataacttgccttgctccaacgcaaataaatccgagatgggcaacctgattatccgatccttgaaatatcacaggttgccatccaaaatataacggactccactgaagaagaggaagatccaaattcaataaaagccatagaataacaagaaaacgacaaacggttaagagggctagggtttagggtatagcctatcttttctatagggtatagggattactgggctaatattttatgtgcagattctaaagggttggaggctaaggtggataggagattaagcaattagggtcgcttatatttgatgcatgggcttatgtggtttggaggataggaaatatactggataaataatgtggttaagtaggcatgtagctggtataggtcaaggtcgggctttgatagaacagtggctagagtttagttgttctcgagacgat

SEQ ID NO: 67285 - DNA, 19765 bp, Oryza sativa
ccatcagccggcctttctctagcaaagacatgtgtatacgcttaattgtctctgcttatatattgtgattgtatatattaacgcgtacacgccatctatacttagtattcatgaattgtgttgtgttggccatttagcatggaattaatgttttcttggtaaccaattacttactaaaacaccacttgtttgattcattggtttgtctggttattgtgattgtatatgtgtgtatatatagtactaccagggcccaaccctactggaattggaggtagctagctagctagagaggatcagtatatatatgtgtgtttatctcttgtatgcttgctttgattggtgattccaacaataattaattaactatatcatcttcttggtgttttcttaactttgtcttacgtgtgggattagtgatgagcctcttttgctttggccggcctctcctgcatcgtgcatgtgctttgttaggtcgattgatcacatccctaggcagtttactgatttgccagaaaggaaataaaaactaattaataatgtgctcttgagaaaataaaatccctttttaattgtgaagagaaaatatccaatacacacaagcttcctgtgtacactctgtgcataccaattagcaaatatcctagaaaattctagaaaaaattggacacatacttccaatagtattacacatatctgtaaagtctcatattcaaattcattatattttagccgtaacaaaaatgtgaaaaatctggcagttttaagagttaaaatatatcaaaattttgtctttttgttacggctaaaaaatatataatgaacttttaaataagatttcactcataggagtgtgttcattttctctagaatgtgtttattttttctagaattttttatgatatttgttagttggtgtgcacgaaatgtgcaggataagcttatgtccataggatgtttcctatagtgatatgattatttaggcatatatattgctatagtttttcactgtctattggagctatagctgcaaaattgtcatactgattcgtgcacacactggcattacttgcttcaacaacagggtgtctcaactagcatgtacacgtgtcacatgaagataacactttccaaaaaaaatgcctggctttccaatatttttacaaaaggaatattcagcaaacaattaacaaactataaattactcaaatctagcacatatatgtgtatgtactatatgtggcaagtgcactgttactttctcacagttgctagtaggcagtagctccctatatatgcatggtcctctaatcccatatgcattcatgcaatatggcactaattaattacaattaattcgattatatatgattatgatgacacaggagtacccagcagctacggcctacaaactacaagccagcagctttctgttacaccttccgcttaagaaagcgatccaatctctcttgttgttagcaaagctaattaaacttaattgatgagatgccaaatgcaaaggctttgatttgccgctgtcagcaaagctctctctacttttatattttgagcgaaaatttgtcagctagctcttgcatggatatattatcatcatatcgtacgtacgtacagtgtcattatcttaatccaataattaatctgggttttactcttttgctccctagcttcttgttgtttctttcacgtcgcttttggtagtacacctaggcttggtccgggtgcatgactttgactcctcaatttcgtgcataaaattgacaggaaatcgggaaggaggtacggacgcaggattttacaaaagatggggggtacaaacttgaaaagaaacatcaattaacatatggaaaaacttaaaagtttttttactagaggaaaaaaactaaactatgtaaaaagatataaatagtagctcactataaaaacgattttcctgtataaggagctcttttgattgcaaacggaccgtaattggtcgcgtctgcaaaaaaatcctcccattttcgcgtgcagaccgttaagagtatcgcaagcgaaaatcgattttcgcaggtgggcacgtaaaaataagcctatttttgcaggcggatctcttaaggggccacacgattttcgtgtgcgggcctcttaaatgcccgcctacaagtctatcctccctcctcttttccctgctcaacacttcaaaatttcatccttatccactcatccttatcctctcctctcctctcacactctctcactctgtctcctccctcactgtcctctcgtggtcatgtgtgggcgacgcggccgacgacgggcggcggcgcgtacggcggtgggcggcgaacgcggacggcggaagcgaccggctcggtggccggcggatccgcctttgccggccttgcgatgggcgacggtcaacgagggacggaaggcggtggatccctcgctctcccccgcacagctccggtggcaggctcgagcgggaggccggcggggctctcccctgccctctcccgcgtggatctagcggcgggcggcgcggtggccactgccgacgaggaggaagaagaggtggccgggaatggcgtccttggccccaccacggccggacccgtgccccccgacgatgacgaggaggaggaggcggcaggcgggagtggcgccgccagccccacgcgcacgcgcgctgggcggatctgcgccgccctcgccgccgacaaggaggaggaggcggcggccgggagaagatccgctggattctagggtttttgttttttcgaattttaattttttccatgcgggcgacgtaagcaaccgcatgcgattttcgcgtgcgggtgcgccaccctcatattaaaatcagattttcgcataccttttggtgcagacgggttgggcttacacacgcgaaaataggtttcggcccgcacagaaaaattgtttttgtagtagtggattttttttgtttgaattgtttggggttattttgcaattttggaatcaactatagtttagtcaacaaatcattttacacatatataatacctaacaaatccaagggtatttaagaaaattttgaggtataagtgtagcacatgtcccatgctgtgtccgccatgtgtacgtattatatagataggcatagatatcatgatcggtgttttatggagaaatttttgtatgggcctggaatatttggaagcaaaggaatagtttcatctttgagaatactcttccttccttggtttattggagaacactccttaagggtgatctccttcttttgttatttagactgaatgaatgtgaaaactatagtcttgaactggattagattgtggtaatcttttatattttccatttattattaataaaattttttaacggcgggggcctccctgctgtgtttcttataaaaaaatgtattatatagattgcatattattgccaccttctttattgtcgataatgtagatattaagatggtatatatgtggggatattgttttatcattgactagattatcatgttaaccccacgtatgatataaccgctataaatttaggcccatatggggtaaagggaatagtttcaaaagttcaaaacgatgtacgatttgatagagttcatgacttaattttataattcagtgaaatttccaaattataaaatagatttttgtcatggagaaattgtgaaatcatgtgataagcaattgtcaaaagtaagtgttttgtgaaattgtagtgaatagtatttttgaatggtgaatagtgtgcttggcactagaggctgatcagaccgagcagggccttccaagcagatcggaagtgtccgagcggtttgatcgggcagaccgacgactctaggagggagtcggtttgaggtgtttgggtggattttctagattgcttcatattgatgacttctagatggtttctatacgtatgtgatattattgtgtgctgatgtgagtcaagtcgttggtacaaacttttactcggatatggagtttctttgttattcatgtgcgggtgttgcttgaaaccaatggagtattgtggtgatggatctggacaaggcttgggagaagttgagatccagacggttaaggagatcatgcgtgatactaaggctagagaacgatgcatatgaaggtgaaggtttctatatgacattacgtggtgttgtgtgcatgtggaaaaaggagtcaaatttggattggagttcaagtttaggaatattggagtgtgaagttgtaaagggatgttgtttccctagtttgaggggtttcttatgtgattaggagtcctaattatatttggattcgtggataggtgtagccatgttttgggtataaatagaagagtggttgaggctagaagtatatcaacttttaggagagaaatattagggtttgcttctaggcttcgattatagttcatgacttaagagaggagtgctttggatgcacattataaatatcttgatgcaataaatttgatctatattcaagatcatatttagtttgattttctctagatcccaacggtctaaccgatggcaaaggagcagtcaagccggcagtggcggcgatggtggcagcaagtagacgaggagagcgactggaggtctgactaatcggtaaggcagtggtctgatcggtgaaaagcagttatttgaccaatgttatctagtggtctgaccggtgcactccattagatttaagggtccttttagttccataaaatgatttggtttttgtggtcctaccattccctcctctgatagtattcgatattacaaagtggtatcacaactctgtttgctatttggatctttatcgatctttgagtttttgtcatgactgaaaagttttcgaccaagccttattttttttatggagttgattttccttattggtgcaaaaaaatgaatcttttattatctcaaagttatgatatttggcaaaaagttgataacccctacgagatttagtgttgttctcaaagttgattttgaaaataattgtaaagcttgcaatattcttgttaatggaatttcttgttcgaatttcgatcgggtttcgcgtcttgacactgcgcttgagatttggatgtctttatttgattttcattaaggtacttccaataccaaggaattacgcaaagaagtttttaaaaagaattacataaaatttgagatgaaatctggagaagctttagatgactattttgcaccttttaacaaagttttgagcaatcttcgatttattgatgagtcttttgatattaacaattcttaatttgaaattgctcaatatcttttgaaaagtgttgatatgtaaatttgggagatgaaagtcactttgattcaaaagtctggtgatatgtcttatttgagttttgaattctctttacactaaactgaaaactcataaaatgaatattagttacctcaagactgatttgaaatctactcctttggttccttcttcgagcttccattgatgcttcttcttcatcggtttttacgagttttgagtgccatgtatgatgatcaatttgagcaactaggtgaggaaaccttggttttgattactaacaagttctcttgagctttgaaaaattcgaagaacatgaagcgaggttgactagttcggtgctttgagtgtggagttcaaccacatcaagtacaattgtcgtaaacacaagaagacgatcaaggaggaggaagttgacaagaagcataaacaagaaagaaaaaatagtcgcaattagcctgaggaagaaggatgcatagctattgtgcatttttaacattccttaatactctctctatttcatattataagtcgtttgacttttttcttttggtgtggtagttcttcttctgctgctagaagtacatgtatgatagtcttttaccactgtcacctgcaaatcaaatggaagaaaccttcaatatacaatcattatgagacaacatacaattatcatcgaaatcaacaaatatataccatcactctctgctgattaggttgcttatgcccaacagtatgccaagggaaactttccactttacaaccacctatagatcgttcaggatcagtttttagcacatgtagctcaaattccttgtttatggcaaattgccacatagacaatctaaactccatacttaattctagccttcatgcaaggattatcagggtcgtgggggcatcaccaactctctaggcacttcatgacaggtattgcagctcctttggtgtcttcagtaccaccatctgcaccggtagcagcatctgcagcacccacaccatctgcagcagcataagctccatcaccactaacaacctgtttagacatctcggcttgctcatcctcagccctcaaacccagcaacttgtagaatttttcatccccaatgatatctagccacccttcatcatcatttgggggcaagaacctctagcctatcccaatccacaatatcggtaggaacatatggggcatcaacaatagggactgaaactagtccattaccccatcggtcgcaacgaggaaaacaaaatcgtcaccaaattcaggtccagctaccacgatattaggttctaacatagctaattaagctaagcgcaggctcctcctcaagcttgaaggaaaaaaaaaggtggacgaatgttagagtcctctctaactgattcgcaccactcgcaagaacaaatacatgcaagaatcgatttgaaaaccaaaaagaagttgaagttcttaccccatcagtagctcatgccaggtgcgctttgtcgataccatcctgcgcctaagctagcaccatttggtagtgacggttttgtgcgccaggtgctaggttgccactcgacatggtggcctcgacgctagcggcagtggcggtggcggtgatggcgatgacgggagcggtggtggtggtggcggctgcggcgatgatgggagcgcctggatctggatcccctttcctctgctccacgagtggccaagctaaaagaagcagcttgtaggggtattttcgtcagcccgggtgcgaaatttggtggaaatggagagaattagcgaatatggtaaaagaaatatttggcatcgcttgggcgtggcattttaatgaatccaattagcggaatgtcatttaggcaaaactctttagtagtggcaaaatgttcaatttcttttctaaaacggactatgcagtaattagtaaaattaatgaagcatccttgagttaaataagagacatctacttattttatatttgaacttaatttctactactatgtgcattgcgtttgctgctttggtcagcagtgcaactaatcgtctgaccacgaattaataatgccaataatgtctactatcaaggacactaccaacccgtactcacaagtggctctcaaattatccattaactgaaatgcgatgacctgtactatagtataaataaaaaattttatggaacgttgtgacttgtgaggattgctgatcacgctacgtaattaagacaatcagtaggtcgtcaaagtcattatggaagtaaactaacgaaaaacgtcgtgacttgacgaatagaaataatatatgttcttctcacctctcatgtgaaaattaattttggatctaacacatcatctttggcagtcgtcacggtttacgtcgtctatacccacggctctccatgattaaattgttgtttaattattcatttaaagggtttctaaaacaatccattttgctcttgcggaagatcaggggaaaaaattactagctggcgttctaactaatggaggccaccccaccctgcaatttatagctttcgcgaaacacaagaacttttatagaattttcatatgaattagttcattttatactgaatttctctagtaatttatagaaaaccaattgcatgtgcaggtgaatcttatgcttgaaaccttagaaccactatcttgaaaaattctgccaataattttgctgctttccaaacatgttttttttaagataatggaatagataacatatcagcctttgcttaatagagttatagccaattattaaaaaatacactcaaacaaagagtgtagttcaaataaaattaaacatactcaaacagaaataaaagtgaccaaaccaagataaaaagcacacaattatttaagtctatttgtaaatctccacccatagttggcaaaatgttgcatggccgccgtcttaagcttatgacatgcaaccttcgaaagcttcttcatcataccttaagaaacatgttagccaacaatcaacatgatctctagaaaatccttctgccagaaacttccttcgtctcccattaaatttctctaaatttccttcattaattccaaactgaactttataattaaagtgtgatatatataagtaatctaggtttctcattaatttgatagtattccacacagtgtagctggctagcagcatgcattatatttgttagacaggtgcctgcaggcatgaaccccaacaacctctaggaccaaaaccgcataacatgtagaattgggttccatgtgagtgcagccactttccaactctcacttgtctttcctcttatctcacccctcaccatctttccatttccactgcaaacagttggcctaccccccttatgtgtgatccacatgactgcctgtaaaaaaaacaaattaattaattaaaacaagatgtggaccccagggacaaaaaaaatacaggcaactctactgtcagaatactatataaaggaagtagaatacagtgacagtgctagtttgatatactagctagtagcaggtagtaattgcatggaggcattgttactcccttctttgtgaaaaaagaactagtaatttttaagctagaaattatatttttttatggagggaatatttatttgagatattttattcgttaatttttttcagacaaatttagtattaaaattttcagattaaattttgactatggatttgtcataaattgcattctttgtagccataaaaataatattggctgtgtttagatccaaacttccaacttttccatcacatcaacctgtcatacacacacagcttttcagtcacatcgtaccaatttcaacccaaacttctaactttggaaggaactaaacacagccattgtgtaataaaactataagagccaaattaataagagaaaaaaaaggcagctctactggcggaatactatatactggtatgatactgtgacagtgctagtttgatagtcctccgggctattaaatagccaatcttgctatttagaagtattaaacatagattaccgacgaaatcgattccataacctctaggctattttgccagacgagtatattaatccatgattagtggatgattactgtagcattattgtagcaaattatagattaatatacctcgttagattcgtctcgcaaaatagtgtaggggttatggaatgagttttgtcagtaatctatgtttaatactgctaaggccccctttgattcaaaggaaattcataggaattttaaaggatttaattcctataggaatttttcctatatagccctttgaatcaaaggaatgaatcctatggaatcctataaaattcctatggaatgcctcttcccatgcaaattttgaaggaaatttaacatgaggttctacctcatgttaagaatccttcgagtctttctctctcctcaaattcctgtgtttttcctgcggctcaatcaaacggtcattcctatgtttttcctgtgttttgcaatcctctgttttacacttgtattcctatcagaatcctatgtttttcccattcccccgttttttcattcctgtgattcaaagggggcctagatagcaagattttggagagctatttccggatccaaactggccaagctagtgacagtggcagatagtaattgcaagaaggcaggcagctattgcgtcagaagaaaaacagtgacagtgctagtttgatatactactactatatttcattcgctatttttttaagacaagtttaatttgaaaagtttcagattaaattttgagtatggattgtcataaattatattcttggtagctataaaaaatactgtaataaaatataagggacaaattaattaataagagaaaacaaactgttcgacccatcctatacatttccatcgctaaatctatgtagtaataaataatgtatctgctggaggactgggaaattaaagtggttgaaatagcttgtaaaatattactagcagtatcatgccacttggattttgaagactagaaagtcataacacgaaaattgatatagctaacacccaaatgtatataacaaaacaaatttgctctgtaatatggttatggaggaacggttaatttgtgaatctaactttgacatggttgttagggtttgcgagcaaattttcgtggggattagtatgcgtgtatttatataagtgcatgccaatgcactgtgttaaaaaaatccctttttttttctatacttcgaacaaaaatgttgtgtaaatggctcaatttttcctcttgaacaaaatagtcgagaaacataatttgttggaagtgccttacatgttaagctcctcttcataattcaaaaatttcacgaaaatttcaaaggctttaactaaatcctaaaaaaatcccctaaaatcactctgttcttaatagcacaaaaccctttttttccctttaattctcatgtaaattattattattctgaaacaaggcaaaatcatttccatataaagtattatacactctttaatttttgagaagcaagtattatacacttgctagtagtagttgctcctcctactgcctagtgtagtgtattaattcgagttgttggctttgcttcccctttctcgtggcgcgcagattcatcgcggtttcgcagtttcccccgccaacccattcccgctccccgccgcgccgcgcctcgccacgccacgccacaccgcgccacgccatgccgccgccgccgccggagtccggcgagccagccggggacgacgtcctgcagaaggcggagtgcctccggctgcttgacgcgctcccggccgccgcggcggcctccccggccttccgccgccactggccatccatctcggcgtcgctcgccgcgctctcggcgtcgctgtcccaccccgcgttcccgccctccgcgccgcgcctcctggcgcccctcgcctccgcgctctccgcgctcgtgtccgtcgccgggaacgacgccgcgagcagcctcgggcacctccacaccgtgtcgctgctgtcgtcgtcggctgccgagctgtcccagctcgccgccgacgcgcggctgctcgtgtcgccggggaatggtgggggtgagggggtggcggcgggggtggatgggctgatcccgcgactccgcctcgggtccgcggcttcccgcgcggcggcgctggacgcgctcgttgactccgtcgggtcgctgccgccgtcggcggcggcggtggcggtgtccgccgtggccgcgatgctcgactcgggggagatcctgccggcgtcgcgcgagaaggccgtgtccgtgctcgccgcgttcgcgtcctcggacgccacgtgccggctcctggcgcaggaggcgggggccgtggtgccccacctctgccgcgcgctggagtccggcggcgccggcgccgaacaggcgtgcgtggcgctgcgccctctcaccgcggactcgcgggacgccgcggcggccgtggcggcgcgcggcggggtgtcggcgctcctcggcgcgtgcgccgcgggcacccccccggcgcaggcctcggccgcgggcgtgctccgcaacctcgccgcgttcccggacctcctcccgacgttccgcgaggagggcgcgctcccgtcgctcatccagctcgtctccctcggcaccccgcgcgcgcaggagctcgccctgggctgcctccagaacctcacctccggcgacggcgacgagtgccagcgcctcaaggtcgaggcgttccaggacggcgcgctcggctgcgtcaaggacttcctcgagtcctgcgtcggcgacgagccgggcctcgccccggcgttcggcctcctccgcaacatggcatccttccgctacatcgccgagatagccgtctcggccagcttcgtcgaccacgtcctcgccgcgctgggcagcgacaaggccgccacgcgcacggaggccgccatggcgctcgccgagctctgcaacgtcaccagccacggcaagacgcgcagggacgtcggcgacgccatcccgcgcctcatctggatgctcgaggccaagcccgccgccgagagggacgccgcggcgagggcgctcgccgcgctcgtcgcggcgagcggctacaggaagctgttcaagaaggaggagcagggcatcgtcaatgtcgtccagctgctcgacccgagcaccgcccgcggtggcgtcgacgcgcggttcccggtgtccgtgctgctcgccgtctcgccgtcccggcggtgccggaagcagatggtggccgccggcgcgtgcggcttcctgcaggccctcctcgccgcggaggtcgacggtgccaagaagctcgccgactgcctcgccaggggcaagatgctcggcgtgttcccacggtcatgacacggctgccgccattgccaccgatcggtgaagaatttcagagcccttgtgaagatcaaatctttgagctgtatgtatgtgctttttaaccaacctgaatttttacatcctgcttttgctctctgtatcaaaaaatatgatatcaatgcttctgatgaaactttgtacaggctgcttgaacctttctgttccatagcttttagagtgctagatgatgcgtggtttttagtgtgatcaaataagaacatggaaaaagatcttgtaatttaatctttgatctgaagaaattgagcttcgtttgccgatgcgcattactgttgcttgtcaaattatcttgtgttgttcatttggcctgatggttttgtttttcttcagggtatatgcaattatgcatctaatgtcatttcataggtactataattgtattggttgaaatggatacaacaccgacaattgcatcattattcatgagaactagtggctaacagttttggttaacattttcttgtccgaagcaagtatggcattgttctcctcaattattaacttttgttctacattattgttctcctgaattatttcaccaaatgttctctttgattatgaactggttgctaatgagggtacaataggtctgagtggctcatttgctcataagtcataattcaatgtgtagaatagagatggttcctcttttaagatgagggatcagctttggtacattttggtacaagttgggcaaggcctacaataacttcgaacagagaaatgagtgtacgattctgcaatacccatccagtcgtgtctttttctttcctgactgtatgaccaccagtaaaatggttaactgtccactgttacttaagcttaatttttgttaaagtttatgtagtaatccttgttcttttgtagagtaattggtaattaggagatgttgatcctagcttcatttttaactggaggattactgatgggtttataagctgaagctagatccaaactccaaatttaagagttattttcagtaagatgttacctgatctagttgtttcactcgctaaggtccaacagatatgtttgctggtttcaattgcatgatttaattcacatttgttctgtcttcatagttcatcagtagaagtctgtaaaacaatatgtgcagagctagtgaaatgttgaaatgttaaaaaccaccctgtgttgttggtcaatggtaaactgcctatggactcaactcaaactcacatggggatggggtcaactggtgcagcaaatctaccactctggcacattaatgagcaagcttaaatgtgactacttgggggcatgctgggttaggtaaccttttttttcttctggaccagactgactcagattggagatgatgagcactacaccaaaggtttactagtaacatccatgcatatacactcacatacatccataaaggttatgtttagtttacactaaagtttagaagtttagttgaaattgatacgatgtgatagaaaaaatgtgtgtatgaaaggtttgatgtgatggaaagttggaagtttggaaaaaaaaactttggaactaaacagggccaaagaaacaaacaattcatatctacgaatctaattcatagctagtatttggtttattttgggatatattcatagccaggaattgatttatttcgaggcggaggaagtacacattgtgcaatcatgcaagaatcatcaatcatatcacactgtccatgatactggtagctatggcattctgttgagatgcaacattcttcttcttcagtccaagatgcatgcatggatgcacagccagccacatggccacaactcatggacacctggtgggtatagttggtgggcaatggtaggaggaggctcatgtcatgtgtattgctgtgatccaaaaatgctgaacagtgtcaggaaaatggttttcccagagagggggcatgccatgttctgatgctggttagttttttctggagtgagtgccctgaaccttcctctgatgataactgatccctctgatcgccactgttgtcgccttgtgatgaaccatcatgcatctctcatctcttcatgcacatcatcattatggcctcatcatccattacggctcgtttgctgattttttttttctgaacgggcaaaagccttttaccctgagcattgatatattagcaaggaaaaatagttttaccaattaattgcaaccagctgacgcatgtcatggaggattacatagagggggaatggcacactaggctaacggctagtgtcacagtagtcgttcgtctcttctttaatttggttttttttttctcttttcttggcataggtcggtctgactgattgcgtcgcgtaacaaatattctattcctctaatatattgacgtgcaatccttttgcgcgtttgagaaaaaaagcacactaggctacctaacgaagacaaccagactcaaaaacaacgagaaaaaaaggatagagaagagtctctgtgaatatggtaaggagagctcctaggggactaggtttcatcgtaacctaaaccttttcttcttacacgatgtgatcgaccaaatatcactctctttatacaaaaataatcacttatagtatacttatctactccctccgtttcacaatgtaagtcattctagcattttccacatttatattgatgttaataaatctagacatatatatctatctagattcattgacattaatataaatgtgggaaatattagaatgacttacattgggaaactggagtaagtagatttgtaaatacacataccataggcagttgctgtcgtagccgcagtgctagctagcctagccgaacgcaacctatatcttgcaacagatggagtaatatttaacttcaaccttcggtctccttgccaagttgagagtttcaggcatgaggtgattaatcagcaaaggcaggcttaacactggattgggagtcagtatcattagctcctaagcctgggacggtaatggtgcttaacactgattttttttttggcaattgcaaatttaccactactttaaatcgttatcgcaagattgctactaaaaaattataaaaataccactaaaactatcattcaaatgacatcgttataatattaaaaaaaccggtgacaaatttacaaatgcccctgcaccgacgcacacggagcattgcagttgcatttgcaggcagcagcactagctgagctgtcggcctgatcggcaacggccctgcgtgtgccttgagcggcggacggaccccggatcctctgcgcccaaggggacctccggacctgtaatgttaagggcatcgtgcgtcgcccgaaaattaattgtaaaccgtaacggtatactagcgataaaaatatgttgattacactgtttgactactcgtcttatccaaaaaaatttatgtaaatataaaaaagaaaagttatgattaagttactttggataataaagtaagtcacaaataaaataaataataattctaatattttttaataagacgaataattaaacagtacaagtaaaaggtcaaaatctcttatattatgtaacggagggagtattaggtatgaaaaattttaacttaaaagttagtatcgccgaaaaaattatttttacaactatctaaaaatcaaatttaaaattatgttttaaaattaaaatctttactttggcttattcttttttacaaccgataggaatagggaactatgagaagttttttttattttctttgaaaaggtatgattatataattaacacaatccccacggtaaaaatatacttcaaacaagcaattacaacgcttttgtcctaacaaaaataaataaaatatgtgctagagaaaacaaacaggcttcacttattggaatgacgaaacagtgaagtacggactgctgaatttattttcctcgagaaattcgatctgaattatttttccttgacaaatccacacatgtgacattttcgtgccgccaacatgttttccttttttttaattaaccgatagttttgctttaataaaattccagcacaaaagaatcttagaatattttcaaataaaatcttgactttccctatttcttagtgaaaggagaggaatcacagagagttttccggcaaaaggaattatggacaatactcttggacacgaaaattaatggagatgccaaaacttgagccataagaggagcaaaacatctctcagagtgaatatcttagtattttccatccctatgtacagtttattattatttttattattacctatttagctttttttttcatgctttgatgaaattgggacaaaccaatattggtttgttcatatttttttgccctatttcttgtataatcgagtataattaattggagccggactgttgttcaaattagcatttgtcaattgtcaatttgtcatgcttccaccagaattggactactcctatctgaattttgagaccactgtgtttcaaacttaccgacacaatgcttggctaaattgtgagacaagccacagtgaaatcaaactgttattatgtccatggtgaagggctcaacgcactaaatcactgtttagtgttattaacttcttcatgcacggccgtagaggtggatcagagacaattaaaaatttttccggctatttataacggccacagtgaatccaggacattgacagctttctggagaaagggctcttctgtttagtgttaaagatgctgctgctgcgtgctttgtttgacctcactaatctcgcttttccactatggaagtctttctagctactccctgcaactgtcctgtcctttgtgttttcctttttgcaaagttgaatcactgttgtagaaggctgaaaagaaaatttttaggtgtcacatcggatgcttgactgatatcagaaggggtttttagacagaaatgaaaaaactaatttcataacttgcctgaaaaccgcgagacgaatcttttgagcctaattaagccgtcattagcacatatgagttactatagcacttatggctaagttcaaaagattcgtctcgcgatttccatattaactgtgcaattaatttttgtttttatctatatttaatgcttcatgtatatgtgcaaagatttgatgtgatgtttttaggaaaaaaaattagaactaaaccagcccttagataatatagctaaacagtgcaagttcatggatggaactcgatcgtaagctccaataatgactcgatcgttcggaacgcacaaattttcaatgttttcattggatttagttcaattattgtattttaagaaaattctctattttacagctgatttacaggatttatgacagctagcttaaagcatactctctgcatgaaaaagatcctttttaatttttaggttttccaaaaaaaaaacatatttttatcagtggggtctactctatttcttaatatcactgtttcttttgggtacattttatgaaaccctacctattatggtctaagttgcacaaaaccacattaattttggtgcgtcacataaccttagatattatgatcttaaagtttcataaaaccataccgttaatcaaattgatatactactgtatcaaaattttaaagctatacttatatacttatatgaatataacatttctatgatgaacaaagagcttataattttgagatgtaattgtagaattccaaagtatgatgtaatttctatgatcaaagtatgatatcacataaccacactattgttcattttgactttgatctactttggtggttctttgaaattttatagccataatacctaaaatcatatgccacgtactgaaaaccccaaggttttgtgtatcttagattataatacatgtggatcggtgaaatttactcttttcttttcaatttttctatgcaaccattagactcccttcgcctcctcgttttaaaaaaaacatttggaggaaaagacgtcccttcaattttttttaaaaagaacaaattatgagcatatgattgaacatgggatattgggattactacacacctcttgtcactgcactatcaattatatctttcctccttgttttttccccttagtttctctattcagtaatgaagggtatgtttgtctcttggctctttgcatgatatgcatttgactttataaaacatctttcttggctccttgcatgatatgcatttgactttataaaacatctttgtgggacggaaggagtatgcaatagtaattaatatctgacccacaaaactacctgctgtgctagtagacaaatttgttgatgtggaaggaaaagagagggtgaggggagaaaaatatatattaacctttttgacttgtcatcaatcttcgacaccagctacatacggtgaattttgttgtatacttgtatgtgattagcgaagatgaaaggtaaataaataataataataatttgatgtattaatttttagagattggctccccgcaataaaaaaaaaagagattggcactatctcaactatatatactactttaattaacagactcaactattttaattatccttatgggtaattttaaaggaattaagagcttaataatatgtcctcacaaaataatagcttaataaatagtattatatattgtgtagtactatgtaattgggaaagacaactctagtagtgctagatggtctagctcgtggtgggtgaatcttagcccaagttcctcttgttcgagcgtggactgaaattgggcttcgatagcttgggctttaggacgaatatttaacttcttccctgaagcaatagctacatgatttgtgcacaatttccacacagtctataatataaaaatgcaaatttggaatagaagtagaactttccaaaaaaatggacttaatttcttttcgaaaataaacaagccactgcagatgttacggcacaattagactcttatgtagtgcttaaatagttggaatccatgcatttttctagtttgacacaactcacaaccttctcagatgtttt

SEQ ID NO: 67286 - DNA, 6462 bp, Oryza sativa
taggatcacacagagcccgagagctaactgtgcggcgtgctatggaggtcgagggaatagtgaagctccgaccgctgtacgcatcgaggcgtggggtgccaggagcagcacttcgaccttaggtttggttttgccgggctttacaaccaacggtccgacgtcggggccagtagaccgcgaacgtccccatggaaggcgtaaagttccaaccggcggctttttagtggctaatgggtatttttggggtaaaagaaaatatttgaaaaaggcaaatataaattcaaatgatatttgaataaattcaaataaaattataaaatagcaaattaggcatcaaaataaagcatttgaatttatatgaatttaggtccaggttttactgagatcggatctatggtttaggagatatgggcttctaaagattgggatttgaattaaataaagaaaatgtgaaatagtactgtgtaagggcccacctgtcagcctttcctttcctctttcttttctctttcttcttccttcttcctcctcccgttctcttcctcttttctgttgccgagtgagttgagaggaggagaggaggggcgctggctctccggtggatggaagactgcgacgccggtggcaatacatgttcccgagcgacgcgcatccggggagggtgatagtcggcagaggaagtgagagaggaagctggaacggcgcaggcaagagctctgctccggcggcaaaagaggaggttgtggtggcttgttttaaaggggaagggaaaggggaaaggggtgaaatggattcgcctcgatgagacgaagctagtggcgcgagggcttggccgacaacgctccggtgagggagatcgactagtggtggccatggcctaacatggccaggagagagagagaaaagctcggcttgtgtgggggagaaagggacttcaccgtatatttataggcttcggaggtcggttgctcaagtcggttcgcagaggaggagggcgacgaaggcacggctgcagcgacgtgaaggaaagaatgacggcaccggttctttcctcccattggacgttggagtcggttcggcttgcagatgtcgtcagcgagttgaggtggtggctgacgtaagattgggcggcagaggaggaaggcaaggcacggcgtcggtggagtgggggcgaagagaacagcgccggcttgattccttagcggcgaggtttgcggcggcgtgcgccgtgcacggcacgcgcactgagaggaaggaggcggctgggttgtgggctgaattgggccggctcggcttagctgggccggcagcccaagaggaaggaggaaaatagaaggaaaaaggattgggccaaaaggaagaaagaacggagtttcggcccgatgacaaaaagaaagaagtctaatttgtatacttgatttgaatcactgggttttgcgaagaatttgaatttagagagaattcacaaaggagatttcctaatttatttgagtgcaatgtttagaggtggagtttgagggaatttatttggaagcactcaaataggaaaggaaattaatagtattcctcaaaatatttttgggaatgtggtaggaaaataggtggaggcaaaaggataggatttgaaccctaaaatatatggcataggtttcaaggaattgtttgaggctaaaaggaaatttaggtgacaaggatataatttattttcttagcacaagagcaattattcacaatatttgtaataatattattcttgtgccgagaaggaaatcaagccacaggaattaaattagcggctagatcaaaaggaggaatttagatatttggcgataaataagaataggtttggaatcaaaggataggtttaaaatcaaaggatgggtcgacaattgaatccaataaaattggaatcatttggtttaggttctaggacaatagtggcagaatttcttggcaccataattcataaaaatagaaaggggttttcaaactaaatttgaataaaagaattttagtcaaaagaaggtttcaaaccaaatcaagaaatacctcaatttaaccaaatatattttaaatgaaaaacacaaaagaacttaaataccagagaggttttgtgcgagttagttctaggaggtccctctaattatattgttctaagtttaggaggttattgaaaacataagaatcggcatgatgcaggattggaaaatgacacattttcaggatgttacaaaggaacggcggcaaacttcgggtcgacggctgcgacggtgctccggcggtcttcggcggcggcgaaggggcggacgaggacggcgacgacttggcaaccacgacggcggtcttcccgagcgacggcgacgtctggaacggcggcggcgcacggctggagcgacggcggcgacggcggcgctagggcacacggcgctagggcgctacggacgacgagaggcgaaggcgaaggtggcggcgggtagaggagacaccggggaagcttttaaaggggctaggaggcaacggcgaagtcccacggcgaccggcgacgagaaggaaagttcgggctcggagagagagagactgatccgaatcgacctcgaatccacgaacttccaaagcgagatagacgatgtttccaaaggagaaaaggtagaggagatctcggggatcatttcccctcttttgattcggccggagaaggaaaggagcggccggatttggaaggaaacggcggcggcggcgcgctagggttcggccgggcgacggcggctcagggaagacgaacctgacaggtagaccccacctgtcagcgagcgagggcgcgcgcgcgcggcggcggactgggccgacttgggccgaggagagagagcggttttgggccgactttcggcccaaagccaaaagggactttttaaaacctttttcaatttaaattatttcttaaatgcaattccatttattaaaaatacttccttagctcaaataaatcccagaaaaatctaggaattatagaattaagcaaagtatttaataaaattttatctggccccattttatattggaatttattaattaaaattagatcttctcttcaagacttttaaaataaattctaagaattccatttaaacaacaatttatatattttgaattttcagggtgtgacattctctatttctcatcctttgaacccttcttttctgattcttggtgaaaatacccgccggacaccattgtgttttcctatcttcaccctcatcatggtcataatcttgattcaccgggcccaacctctgatgaacaggaacccttttctgactcagccgattacctccagaataggatcggctcgaattccctgcattactgcatccagggcaatcctcaatagatggcaacctcatacccttattccagcaaaatctaaaaaattcacaatcccaatgaggatcaaaaccaccatcttcttcatgatatttatcttgttgccttccatacttcctcttgtatttgctgataatcctagccgaattcacctgaaattttctattattcccccccatcggccgtccttccagacgtatgcaccatattaacagggaaagggttgccatcaaccttcattggcttctttgaatcatcaaatttgatcttccctccctcaatggccgcctggacttgttgcctaaagaccttgcaaccattagttgagtgagaaccagaattatgccacttgcaatatcttcttttgcccaattcttcggctgatgggatcagatgaccagcaggaagttgaatttgtttcttccaaagcaatacgtcaaaaatcttgtcagccttggtgatgtcgaagtcaaacctctcctcttttccagagctctttacccattggcaaggtatgactttctcgctcttgacccattcggctgccgccacttcgaaatcatcatcctcatcatcagaatcatacatgtaaggatatacatgattgattttcttgaagttcttctttgcctcagcaaacctttgctcatgtagagtcaccttttgtgcaagatgagataaactctcaaaatcttgagccgaaaacttttctttgattggtgctatcaacccctgaaaagctaaatcggctaactgagaatctgtcaaagacaaactgtaacacctgtttctcatctccctaaacctttgaatgtaatcttgcacagactcatcatgcctttgtttaattgttattaaatcggatagtttcatctcatgaattccactgtaaaaataactatgaaactgcttctccaaatcagctcaactgttgacagaattgtatggcaaggaagaaaaccatgtgaatgctgatcctgacaaagataaaggaaacaatctaactctcaaagcttctgtagccgatgcctcaccacattgatccaagaatcggctgacatgttcataagttgaaatattatcctgccctgagaattttgagaagtctggtactttgtatcagctaggcaatggaaccctctcaaaccactcagaataaggatgccgatacaaatttccagtatcttttggcttgagcccaaactgttccctcattacatctgcaatcatatcagtccatgatgtttgctaaggtactccttgtatttgttgctgcattggctcaaactgattgaattgaggagcgtactgacgttggcgatcctgtctgctgatactgaacatgatgtgacagaggctgatattgataattcagatttcctccttgatagttctggagattcgtctgaatattatgcaccaaatgtttagggataacctgaggcataattgattgatcggcctgtacgtgatggaccaagtgttcaggaataacttggttcacaggatgctgtattggctgattgtcaggtgtccttaaccttccaacacatgctacaagttttggtgctgagttggctgaaccgtctactgcctcggctgtgcttgctgagtcggcaacggctgtgttgggtcgactattgttggattcggcagaaacattgcagcaacttgatcctgggtcagccgattgacattttgcccagcatgttgtggctactctctagtcaataatctgggattaactatctgccttggtgctgatgatgtaacttgcgcagtagctaaaactggagccgtcggccaagccggcaaagcattagatgtattctgctaatttgctataaccaaaggcctataattcggaaaaacacctcctggtagataaactggtcctgaggcttggtgctcggctatcgagctatcgacaacagtcttcaccatgttggttaagatattaactagcactccaaattgattgatcaaagcatgttgcacagcatagtcgatcctatcttggaaattattgaattgcaaaggcacttggttgccatctgcaccaaggtcttccactgtaccatcttggggaatgtcacccttgtcacctgagccagttgcagtatcttagttaccctaagatgaactcgagccgacctcatcggctgcaaccaccttcagtttgtacttttgtacgatggtccctctacgggtctcttgaaaagaatccataaacttgcccttcacgttgctcatcatctgttcaagttcatccctttgcttagctgtcagcctatctaatgtgattgggacaatattggttgagtcgacttcagctgatggattttggcacctgttttgttcacaggaggtttgaaccctgttccctgtgatggtggtggttttttagccatcgggatgaggtcgtcgaaaactcgggtcccaccgggcatgccaaaagcgtgttgatgtaaaaacacgaggcctgagagatctgcttaactccagtgcaggtccaaaatcttgccttttaggttcatgagcatgccagttgatttgatcctgcaatcaacaagaaacaaagacaaataaaccgtagttaatccataaattatagccgatcggccagccgccgatgacgtatcatttatactcgagctgatgtcatctctgtatcgatcggctgtgcgaggcaataataaagaaactagatctattcgatcggctgtagatatcaatgatatataattttcatgtcgacatatacttaaatcaagtgattgggatagatcggtcgccatgccgagacagtataaatcacttagatcgaaatatatgttaacaaggaaactataaccattcatagcatagtcaatcagatagatctagtgtgtatcggctaatactccgatactactctacattaagatattaaagcaagtaaaatatatcaaacgtaaagtctaatacacctaaaagcaataagatcttaacataaagggcagatctagcatatcaactaagcacatggaatataaagctaaatcaggtaagatcggctgaaaccccgatactactctaatc

SEQ ID NO: 67287 - DNA, 903 bp, Oryza sativa
tgctccggcccgtgaccgcgtccgacgccggcgagttcgaggagcaggggttcgtggtgcgcgtgctggacgaatgcgccgagacgtggaaggagccggacgacatcggcaacgtggcggtgctcgtgaacgcgtcgggcgcggtgccggcgtctacgcgggagtgccccgggttgcgacccagcaccgtgtacttcgccgtggacctcgccggcgagacgcgcgtgtgcgcgtacagcctcgccgcggcggccaagggcaagcacaagaggatcgaggtcatcgagtcgatccccatggcggaggggtacaagccgccctgcttctggttcgcgccggtctacacgccgtgaccgtgccaccgcggcggctcgagtttgatggtgaccattgcctttggatggacgtattgcgagttggatctaagccagaagaactcagagaattgtccgtcttcttcacagtggaattcttgcatggttgcatatgtctttgcatgtctagtgttcatcaaccttgagtatttttatctcttgtggatcataatggagtggtagattatcaggaatccaggatgttctctgctttgtgtaaagtagatcagtataggagtattagattatacggagtcatatatatgaaggttcatcccaaatgtcagcaacttttgagtccccggcgattgtgtcgtttatcccaaatgtaccaacaaattctcttttatacggtcgtaagaatctcctttattaatgcgagctacagcgagatactactactatactccctctgccgatgtgccctttctagtacaacaaatctggataaaggtctatccaggtcctctcctaggttagcttttttttttggacggaggaagtagatgtaagagggatgctatataat

SEQ ID NO: 67288 - DNA, 11250 bp, Oryza sativa
tcactgccaagcaaataaattgctattgctaaagttgcaaaggggttaatgggttatggaaccaacgaatttaatcactgtgattgtgaagaaaaggctcgggaacaataataaatacaagtagctggccgagctaagaacaccttccataccaaagataacattttttgcttaaataagacaattgtacatcgtggatatgaactatgctagaccatctagttgaaaccactcaaggaaataatccacacagcaaatactgtaagactaacatgaacattttttttagagcaatactgacagaaatcatgatgtaacatctcggtagaatagtattgattccatcttctggcgttcagtattagagtcaattaaaaatgtgaatatgcatgcctaaagaaagagcaagatatggtaggtactgcttcacaatgttacatttgtataatcttctcatgcaaatatgtttgaattcctacaaacatacaggcataataaataaataaataaataaacaaacatattacaaacatataacggctttctcactcaagtaacaaataaatatgcaacatgtttcagataatcagacaaaattaacaagcaacatgacaccttttggagaccatttaggctcagttggggactccactaacattggattgctaccagcaacacagacccgtttggtcaagtctctacaaacaaagaatcatgggtgcttaatcataaaaagctaacagttgaaaaaaaaatcagaaacaggtcgaaaatggactagcataaggtagacagactgcaacactagagattacaacagaaaataaatccaaaagtttttagtattatgagatattcctctgtagtcagactaacttctttatatatatattccatgcattagagatagggttccttagggacactcaaagtttattaaagtgtaccatcaaatgattcctgtagaagggctagcatgtattatgaaccaagaaaaagataatggatccatctaaatttctgtcatcccgaatgtaacatttgttttgtttatattacctgattggaagaaaaaggcagcatgttctaatatgcatttctaaagataatgttgcttacccgctttcagagaagtagccaacccaaagttctgacttatcccagggcatatttggatgactccactctatccatgccatacgcttgttattatggtcaatacgaggaaaagcatagaagtcattgccactaatcagcacctttggttcttcaatacagaaaaaaaaagtaagaattcttacaaaaaaagcagatatgagaaaattacaagcaacacgcacacatagatttaactttgtgaaagttataaacatttcgtatagtcttaccctgaacaaccccattactcaagcttatagctgcgattgttgtggtgggattcaagctactctttcgacggtctatcaagaaatttgagcatgtcagaagttcagtatgcaactatagtttgtaataaaatcatatgccaattaaccttctatcacggtaacataacggctgaagtgaggatcaaagactccatcagcataactgacatcaggcccaccataatcgggtgtaagaggcacaggcacaccagctgacaagggaaaatcatcatgtgaaatatttcagcagaaaaaaatatcattatttaatatgcatattgatcatcaagcattaagtggttctaaatatttaacagctgaatagtgtgattagatttcctttttaatcctgtcaaacacaacctatcatttcactggctgtcatttcattataaacgcaagtcttttcgcttgttaagacatgctccaccaattctacttatttgaatgagcatgctatacagtaacctataaatgcatatacacaatgaaatatttttcaatgaagtactagacaaagaattaccataagtaaggaaagtaaaaacacatccttccaactaaattatatttctttattgacatgctaattcagttaggttcacctaactccttagtcctacaaccatagcaaatgactcacttttagtactttgcttgtacagacgttgatccttgtagtttgagaacacaacaacattatctttgactgaaaatgcaccacctccatattcttgagctagagtacgtgctgcaaattcttgaggtatgatatccacaggcttatcatcctccttgactataaccatacgcctgtgtccaatatggttgaagataaattaattccgagtgacacagcataacagggaactattaaaagttgaacatgacatggtacactaataacagacattaacaaacttaacacagttattgcaaccatcaattatttaattgcacactgctagaaattcatggaattagcaattgccaggcagaaagaatttattatattacattaatcttctggcatcatgttgtctctagtgcagtaatgcacacacagcaaatgcatataaaatacattctgggtttctcaaatttgcatattcaatcaactctaattgtcaaagcccataagccaatcattcatttgaccatgtattctagtgcaaagctgtaacttgctttcatttatatgcagaaaaatcataccagtaatctgctgagaaactaaaattccaataattaaaaaaaaaaacatagtgaaacgaaatcacattattccttccagtttctatgatacaatctccacgcaaatatgtgccaacatgctactaaaacaattccagaatctagatacgcacacttactaagaaactagtaacaaacatcacaacagctcgagaccaacaatcacaatagctcgaggccaccaagacacaaaagagaatcagaatcttcatgtgccttaacgtataattaaggcaccatacaaactttcgtaaaaaaaagtgtagtagtagctgccaatgctattaccaaaatatttggaggaaaaaaattatttataactgttataagctcaggaacggcggttactggttaacttaccctttctcctcgggccggccctcgatccagaggaggcgcccgtcaccggcgagggcgatccctcccagccgcttgtcggcgccggagacaacatcggcggtgatgggcgacctccaggatccgtacggcgccgccacgggcttctcgccggtaccgccaccgtcggcggcggcagcggcgggggaggccgcggtggtggaggaggaggaggaggacatgcggggcgccgacgcgagcgggcggcggaggcggatgcggggcagcgcgcggaggaggtgggaggcggaggcggagaggcgtgcgggtgagatggaggcgagaagtgtcgccatttgtgaggactgctttttataagaggttttgtggggtttttgcggtttatagaacagtggaggatacgctccattgttccactctagcattcgcagcgagatccgctattgcgctttgttaaatttttttagttgttcatttttattgcgctttgttaaattttcttagttgttcatttttagtgcatttgatcaatgctactcaatttgtttctaaagaaatatatcaacacaatggatgcctcgctatcaacaatacatcacctatcatcgaaagaataatatattataaatataagcatctatgataagtctagagcttaatccgaatagataggttgcaccataaaaaactaccagctacgctcacttcgcaatgttactcaaccattactctgtttcgaatcatatcatcctacacagaagtacttgaaatatgcttcatgaaaacccttaaccccagccaaaatagcaaataggcgaaggcctctttcggaatgctgaaattttccccaattcctactagaattataccaaatttcgtaaaagtcatataaaattcctgcaaatgtgctacaatgtgaaaacgtgggagaaattctagctaacggaagcatttattccattatattgaccagagtcgtatgcaaagcttcaagagattatttcaaactacagctaggacagcgttgctccagagttccctcgagttgttcccagaagttgattaggtgacgaataacttcttaacgcttacaaggagggttcatcaaaattgtcgatcttgattggagtgatgccatcagccaccttgaagtgccccactaatctagcgaagaacaccatctgctgctccaaggtaaacttgatgttctcggcctgctccagaaatgcaagtcagatatgtgcctatgtaaaattgtctatttactggtctaaaagtttcatatactgaaaaataatatatacagttagccttcaatccttcatggtaaaaaaaaaaaaaacaattcggtaggaaatactcaacctgatacattactaactaatatataagtttggtgttgcaaagataaagacaagaggtactcgtcagaccttgcggaaaccatgttgttccccttcatactcgaccaaagcaacaggaaggcctttgtcctttatggccttatatatcgtcgttgcctgaactggtgacacaacctgaagatcatcaaagaggtgaaaagctggtaaggagaaacagaatgtgggaaatgcacccgctgctaagtcactcttagccgattttcgttccctctgttctgggttaacagattacatttgatttatcgataggtaactctatctgtaagtgcacttcctagccatatacatattgatcatgggacacgaggactaaagtgcatcagtgataattaaatacccttcatttttgtttatatgatgttattgctttttgtaactttgtactagtacagaccgattatattataatgatttggaagtttctttaaagacaaatcagccaaataggtttcatactgaataattatagatagctttgaatatactggtagtaaaaaattagaactcataactgcattcaaacaaaaatgacccgagggagaagttcagatcttatagctttaccgtgtcttccaatccttgaaacaatataattggacatgaaaatctatcaacgaagtttatcggtgatctctcaaagtaagcctttctattccctggaatattgaaggtatggcaagtaatgttgttaaccaaaccctgagcatatacatacgcctattttccagcatagatgagtgcaaaattccttaccaacaaggttgtcaatgtagtatgcctcaaacttgtgcatgcctgccctcaacgaagctaagtcagcaatctgctttggaccgaagcataacaccagatgcatcaaaatctcagcagatagatagtttcagcaaaagagagaatttatggaaatctgagacttgccccatataaagaagaaccagccttgaatatctgtctaaaagcaaggcaagctaaagttgtgaatccaccagcagattctcctgttacacaaagccgttgcgcatctactcttccagtttccaccttaataatcagaatgacactagcataaatgcttacaacctccacacgaaaatatgaaaaaggtctgtgtctgataagatataccaaaaatgtagcacaactgcagcaatcatttacatcaacgacgccccactgccctaaaagcctctcccgaaattttctcccatagcctttaagaccgtgaagaaatatcaagaaactagtccgtatcaaacaccaaaatctttgatgctaaacagatagtatatgtaaataagagcattgtaattcgtcagaaaaaataattcatacatcaaacatccaaataaaacaaatgcaagttctttatcagatatattagagtcaagaaagagctgaagacctgtgcttcccccatagttaacatcaacaaatgcccatcctcggcttgtccagtactgaacaccaagatccagaactccacgtgcttcatctgtaggtccacctaaagaattgcaacaatgtcaatacgagtttccatttcctttctttaaaaaaaagtacatttccttattttaatgttctgctttcccttagcaattcaaaaggcttgtcagtcaagtcagtcaggacttaggaccaatgagagctctgtgatcttttatcatcactacaaaacattcttcaaacaaaaacaactgaaataaaagagaaacaaagtgctgctctatatcactaacaaaattgaatgagaaaaaccaacatcatgtttcctaataacttctgctacaagtgtgaccagtaaagacaaaaagaataaaataggctattgaagtcaacgaaatatcatataactaattaccatgggttctgaccaataacggaggtttctcatctgacgacccttggaaaatatgattgtgcggggcatagaaataagcataagccttctggccggggactacagttggaaactccataaattcaggcaaactaaagtaggacgcatattgcataacatcctctgaagaggaccagactatagagaaattagttgctgtttttctcttttcatccagtgtcacctggtgcaaaaacagaggtcaaagggttgcactatattgaaggaattcagtttgaatagttggcatgtgacaaccaataaggtagtcgaatgaaccttagcaatcgacactggaagagtagcagatgcaccctcaacatagaagaacccatccccagaaacctagaaaatcaggaggatttgagttaaaagcatcagcattccaacaaatttaaggcactgacgagtgagatccaaatgttataaccagcaaactacaattagttctgaagttgactcatcgcatttcatacacatactatgttagttacagaagagaagggaatgtccagttctgaaaaagaccctgaatcatggtctagcactccagcacatgaccttccattctgcctggataagattcaaagttatgaattacacacagtaaaccaacacttgagtatgggaaaacatgaaaaaacctgtaacagcaaacgattttgttactcgtgtcatcttttccaaggaaaccataggagctgacaccaaaaatccacattggctttgagaattcagcatcaagtgaatacagttgcactatcaaattgctctcctcatcctgttgtaaatgaatagcacgtaaatgccaagtaagaggacaaatcgcactattttcagtatctttagcaacataattttagccatcatggttaggatggactcttttctttttgtttttagtgatgataaatgtttccctcattctaaaaaattagcagttagtggtaggatatcaacatgaatattacgctgccccatataatggagacgccaacataatatctcaataataaaatggtttatcacaagttcacaactcttcctactgaaagaagcatatcaaatataaacagaatataacttcttgtatgagaaattagactgggaagtaggcacaagtaataaagacagaacacattagcgctgagagggttgcagcggatataaggtccggtatgcaccacaccatacttcaatcaagtagtttgcaaaatcagatcaacgggcaactgaataaaaataattagttcagggaagatcatacccatttataaatattccaaaacccactctctcggtcagttatgaagaacagctcccctgaagaaaattgattgaattaagtgatattttggaaatatatttgcacctatcttttggagaaatgaaaacctacagaatgattctgacatgccaaagattcataatccatgcagagaagaatggtatagctacaaggatgaaagagcatgtcttgaacacataaaaaacttaaaataatataaactgggtatgaaaatgctaacaccttttgaagtccacttgggttcagtaggagattctactaacgttgggtcaccaccagcaatgcaaatcttgttgtgtacctctctgcatgttatgaatacgtaataaatatgtaggcttggaatatatcattcaacattcgcacgtcaacaagcaacccaaacatagtttattttaggaaaaaggatggaataatgaatatatcttattgaattgactatttgccgtgaactagagactacaagatcagtgtgttctcaaatatggactagtgcagtaatgctgaagattagtaatatgcacaactccatgttccttcacatgaatacaaagataaagatctaaaatatcattcagtattttcaaagcaaaaaaggtaatccagtagtagatagagtagtacctctttctttatgaaaactagttgagaacagaaagcatgcaagtaagaaattaccctttctcagagaaatatccaacccataattgcgctttatcccatgacatgtttgggttactccattcaatccatgccatacgccttttaattggatcaatgcgtggaaaagcataaaaatcgttgccactgaccagcacagttggttctgagcaaaaacaaaaaggttgagaagtttcaataaaaagttagtgtaacaggtatagttcaaaagaagcttaccattagcatctctgtcacttattgttacagcagcaattgttgtcacgggatttgagctatcctttcggtgatctgagtttaaattggaacttccttaaaaaggtaacaatggaaagcatacctactagaatgctaaatgtgaaataaaatactaataaccttccattatagtacataacgacagaagtgaggatcaaagacaccatccgcgtaacggagcactgatccagtgtaatctggggtcagaggttgtgctgagttatctgaaatcaacaaggaaaagatttttgaaatatattagttaccagatactctttgaaggagcactccatatggcgccttttttagcaatgatgactagtgacttaaagactaaaaagatacatcgaataaaccttttgaaaatcaaagcggcattactattcaaagaaaaaaaaataaagataggctagtttcttctcattttcttttctctaaagcatggagatctcaattatgtaaacaatttgcccatgcatttggtcatctgggtcccaatttccatgatgcatcccaaattaatggcagacgaaagcttaactacatttcaactaaattttcagcggtgcctcacgaattgcagacattagacctgctcaggttttccactcaatcgtaccatttctgatccattttcctcaaagctactacccctctgtctcaaaatatagcaacctagcgttggataggatataacatagtaaatctggacaaagccagtattaggttgatatattttgagacggaggtagtccatcataggctgcgtgggcaatgtaccaacctacaaggctacaactgagaaccggtgcagtccttgtgaaacagcagaagaacagcaactgcaccagacctggtccgttgacttccattcgaaggcctaagacttggtgcaatgcgagctcgagtagtcgagttcaccaactattatccacagtaaagagtacggtatgctgcaatggcgcggcttgttcggtgtacctccaatggtctgcttgtaaaggcgctggtcgctgtagttggagaagaccaccacatccccttgcaccgcgaacgccccgccgccgtactcctgcgccagggacctcaccgcgaacccctccggcgtcacatccacggcatcgccgcccggctccgccgcttccttcactaggaccgctcgtctgaagaagaagaaaaaatgcagcatcaggagagcaatctgaccacgcgagaagggggtggatggcgtcggcgcgcgtcgcgtaccctccctcctcggggcgcgtctcgacccagaggagtcggccgtcgccggcgacggcgagcccctcgacggtcctcccggcggcggagacggcggcggcgctgatcggcgactcccatgacccgtacggcgccaccaccgccttctcggccgcggcggaagcctgcgagtgcatcgcgacagggcgtgcgtgcgcgcgcgtggcggctgccgggagttgcggggtggaggagagcagaggtgaggtgagcggcgttgctgtcaagaccgcgggtaaactccactactcttctagtcttctgtacctcaccgccaccggctcatcggtccaactcgggtatcattaagaacttaagaatgaataggatactgataaatttctgtattactagaacagtacttcggtaacaacgactcctatcggatggcctaataagaaaaaaaaaggcaaattttgaattttcaaacttaattttgagattattttaagatattttcaacgtgatttctttttaagcattggcttttaagtcaccgagaacacgtatataaaagttttacctacaaatacaattttattcactaataagccgttttggcttattaaaaaaaaagcgaaacgatggaggccacgctaggcctcctcgattgggaatttgggatccagtgaagttagagaagctcggtggtacgactttgaggtattctcagccgtccgatcgacagcgaacggacaagactaatctctacagtgcaccataaacagtatattgacagtatacttaggccctctttatttaggcttataagccaacttataagttgaaaagtctaagccaaaacaaacaagcagcttttttatttggcttttttaagccataagccactataacactattaagccaaaagctaggttggagaagcttttttagcttatatgagatagatgtatgactccaccactaaacttaggacattaaatccattggcttataaatcatataagccaataagctgacttaaaagtctaggccgataagcctaagcctaaacaaagagggccttaacactttctacagtaaaaactgcatatcactgttcttaacgagaaagcggacaatatgccactctataggttgtgttaagataaaatgccactcaatacaatgcaccagataaaatgccacccaatacgttgcctaccggatgaaatgccactttaaagatttttgtgcccaaaatgtccctgagagagaggaagaggggagcgctggggagggctggacggggaggggagaggggagcgccggggagcactgcggagccctcgccgcctaggcactgctgctcgccgcgccggcctcctccccctgcccccgccgttgccgcttccc

SEQ ID NO: 67289 - DNA, 25389 bp, Oryza sativa
caccctcaaaactgagtataacatattcccacgctacaaactggtatagttcagatagattattttcctgtgctctttcccatactattttcataagataagatgcgtagattattttcaattttcttgagtctgaaatcattcattcagttaattaggccatgacttgactcgggttactaacaggtcaaagccccctgaataaatgaccattctaattctaaataacacaatggatctaaacctagggaactgatcacagatgaacgccaataatcatatatgtatgtactccaataagcaggaatataggatcactgatgcactgcaaactaatttttcttataaaaccaaatacatttatttgttccgaggatgtatattgtacctgcttggaatggactctataaactgaggaatgagacgagggcatggcctgacgaggcttcgcttgatcccgcagcaattccaacctcgacaaatgatctgaaattgagcaatgaaatgaaacctgagtatttgttgtagctggaaacattttaactggtaagaaaaaaagactgcttcatgagaaaattgaccattggttgcttagacaagttccctaccgagttcatggatgaactaaccgacaaccaaagcaagtggcacaaaatatccttatagagaaaaaaaaaatctaattcacctatgcatttatttgcttcaatattaatgctaaaaccgatccatccagcgacaatttttgacaaactgatgaactgatttttttttgaattgagactgtttgagataaaaattcatttgagaaggagtattaattagcatgaccctgacctgttactctgacggtagaaaccattttcttgagggtgcaggtatctatcagttcagaactgctattacacgccatgggatcatactaacaatgcttacttataattgcagcaaaatcaagaaaataaggggaaaaaaattaattctgcatgtctgatgcttcacaagttcgatcatattgtccatatggaatatatgcccaggagtgatatgatatttcttcagatgtaacaatctacttgttctgaagctattatttgtgggggttatgtgggtgatcgcttaccttaatggacacatcatgcccaactaaatccatatttgggttttcaattcttgttgagaacacagtacgtacttgcactgatttaaagataaccctgtctcaagagagaggagatccagcaacagtgttatgcaacagtgtcattcagtctctacacaagcagctgtcctagtgttctcatttgtccatttagcataatttgtacaaacatggcaggcaaagacaaaatccccgatctctaattcccatgtttgaaatttaacacgcccaaaaggacaaaatccccgatctgaaaacatgtagatggatttgtagaaagagatggggaaattttagggtttggggggaagataacatgcagccggttgggttcgtcatgtggcgtcgtcagctgcactcaccctcagtcgccatgcgccaccgtgctcgccctcagccctcttgagttggagggcacctgcaaggcgggagaagaggctgcggagacagggggccggacggaggaggcggactactcacagaatggggtggcgccgaggagattggcttccggcggcgcgcgtgaaggcggtcgaggcgggagaagaggcggcggagatcgggggcggggcgtgcgtggaggcggtcgacgagccggagattgggtcgtagtgtgccttcatcagctgccagcctgccctcaccctcagccgccatgcgccggcgaggcgggagaagaggaggcgaagatttggtgcggggcggaggaggcggacgcgaaggaaacagagatgggagacggcgttgagagggagagaaaatcgggggaaaggggtgtgtgtgcgcgccgcgtgcgatcgacgatgcgtggggcgcgtgcggaagattgaattgtgatctgatctgttggattcaagaccacgaggaggcgacgcagggaggagggcgaaggacgcggcgtggggaaaggagtgggcgtggcgcgtgatgaggagaggagcgatgggaggagatttgacgccattggatatgaaaatcggatggttgagattagacgtgtttgttagatgcgtctgctatgtcagaaatcaagaccaccactacagattttttaagtagtagagaaaatgagatttgctctagtccaacaaaaaatatcttaaggtagcagtacctcacgatatcaaatcattttttgatcgttggatctaacaatatctatcatgctcaattagatccaacaatcggaggtgatttagtattgtgaagtaccggtacctcgaggtttttttttttttttgaccggagcaaatctcactctatattgctgatgattgatctatcaatataaggtctttgcaaattgtgctttgttgattgattcgattaattgcgacatgaaccaacagatcaacagccgaatgggcaggcgccgatctcaagcacagacaagcagatcacaccggacgattcacacacggtgtactccaagccccggcggctgcggacggatgagatccctcacgtcgtcgacgatttcagggtggctgcgcggaacgccatcgaggcggggttcgacggcgtggagatccacggcgcgcatggctacctcatcgatcagttcatgaaggacagcgccaacggccggaccgaccagtacggtggcagcctcgagaaccgttgccgcttcgccgtcgaggtgatcgacgccgtcgtcgccgaggtgggagctgaccgtgttgggatcagattgtcgccatatatagattttatggactgcttcgactcgaaccccgaagctctcggctcatacatggtgcggcaactcaacaagcacccagagctcctctactgccacatggtggagccgaggatggccaccgtcgaaggacggaggaagatcaaccatggcctcctgccatttcggaagcaattcaatggcactttcattgcctccggagggtatgaccgggaggaagggaacaaggtggtggatgatggctatgccgacctcgtcgcctatgggaggctcttcttggccaaccccgacttgccaaggaggttcgagcttaatgcaccgttaaacaagtatgatggatctacattttacacacatgatcccgtcgttggctacacggattaccctttccttgaggagaagaaagaggactcagctacagtaattgtttgattatcacctaaatcgccgagtttttttttatggatcaataatgtgtacttgtgaaacacgcatgagtagatttctgtgcatgcatatttgtaatttaattaaggttatcttttgttgagtatttattgtattgatactgccaaatatatgggttacatgtttcgttgacttgttttacccattataatcatcatcatcatcatcatcatcatcatgtgacaaatcagagacctaaaaatgtgtacattaaatctattgatcgagatcacctccatggatccacctcccccgccctcccctatcctccctcgtttcaagtcggccccatatcttgttcctctctcctcatatctaccaccttggcgccatgccttcaaaaccctactctcctttgtcggatctagcctgccccacccaccacatcgtctagtagcgtcccccgcttcaatgagagtctatatcgcaatctatcaggagagcctctcctggctcaccggcgaggttgatgacaccgtggttgatgagggagtcaccgtgtcgttgcctacggcgattctggcgtggggtgaagatcacacccacatatcacccttgtcttggtggctgatgcagtacttctcccccgccctgagccaccttatcctaattaatgaggtcttgttggcctgtttcccccattccttgcggacctttgcttgagaaatggttcccgcagggcactttgtgtgtcaaatttgttggtgcgtgaatctttacctcagtagcttgggtgtctcggaagatgtgtcattttcctgtcctcgacataccactaatctatccatatatgttctaactaggagatttgctccggttcagcaaaaagtatattaaggtaccagtatctcatggtaccaagttttcgattattggatatagctagacaggatgggcattgttagatccaacgatcggaaatgatttggtaccgtgaggtaccggtagcttgatgtactttttattgaaccgaaacaaatctctctaactagacattgtgaagaagcttccattgctacgggatgggtttttccgtgcggtcaagaaaaatttcgcgtgcggatgaatggcccacatgcaacacttcgtctgcgaaaatcgtgatttttgcgtgcgggtggcgccccacacgagaaaatcggatttttccgtgcggttgcttatgtcgcccgcacggaaaaataaaaatccaaaaaaaataaaattcacaaattaccgaaccttaaccctagatccgctactccccgccaccgccacgccggctgccaccgccgccgccagatccgagcggagggcagccgccaccgttagatcctggcgtggggagggcggcgacactcccggctgccagatcccagccatctcctcctcatcgtcatcgtcggcggcggccgccgcgctgcctccgccagcagccgcgatgggcgcctactcgttggcgcgcagctgcggcgccgctcctggccgccgcttcctccacctcatcgtcatcggtggcggcctccgcgccaccctcctcccgctagactccgcgccgccgcccaccggatccgccctcccctctggccgcaccgccgcggacgcccctcccctccgccggatctagggagggaaggaaggggaggggaggggagcggatcccgcgcgggggaaggccggccgcatgccggatccgagcggggatggccgccgcccgccggatcccgcgcctccaccgccgccgtgtggagctgaggccgccgccgcaccgcctctgtcactgcgcaccgacgcgaaccgctgtcgctgtcgccgcacgccgccgtcgccgtcacccgcgcgccgaaaggagacaagaggagagacgtgaaagagagagggggagagagaagagagataagaggggaggggtgtgaggagaaattaaaagagatatatgaggggaaattttgaagtgggtgggagggaaaagaaggaatactatttttgcgtgcggctctcttaatagatccgcactggaaaatcgactcattttcccgtgcggtccatttaggaggaccgcacgagaaaattgattttcccgtgcgggcgacagctcggccccggttcccctatttttttgtgcggttccacttacgaaccgcatggaaacaaaagagggtagtgtccacaaaaatctatcgtgtagtagtgttctaactcaaaggatgtgatcatttattacttaggttgtatttctatatatggagaacctgttaaccaaaacattcaattgtttatcactatgaactcttaagttttagttcttctaatatttataactcaaaaattcaaattgaataaatataaagacgtacctatcttgaaatttaattctaaaaattcgtattcataattagcaactcataactggtgtggactctacctttagtatgagcattgctatacgtacgataaaacttcatacgatcagactacgatacttcatagtctcttgtgtgtgatgcaaatgtggggtccaacatgtttccacccaataaaaaaaaaagacatgcatggtaggatcgtactaaaatcgtacaaattttatcgtacgcaaagcaatttccctttagtataacctgctacaattaaaattttatttatactatcaataataatagcccgtgggttactactactagtaaaattgtattagatgcagtgttgtatatattttatatacatgttcttaacgatctaagagaaacaagcaaaagataaaaaataaactgcgatgacaaaaaaaaatctcaaaatcaactctacatttaaggttgaaattttaattttgactaataaatataaatataagcgaaaaggtgaagccgataatgcaagaaacctatacgttaaaaaaaaaagaactaacagctcagtgcatctcttactcttgttgattgacaccggtcatcagtagttcagcaccagacggctgttgcattaaagaatgtttagaaaattagaaccacgcattcccccacacgaggaaaatcagtgcgctctcccaggtaaggagagactttcctaccgaccagacgatgacggagagggtgacgcaggaaagatccgatggaatagcagtgcgcacatttccgtcaagccgccagggtcccactcagacgctataaatgaaagagcatcatcaacccccttggaccatcggactcggagcaaaacacaatagaggagcagagcagagcacagtgagctagtagcagaggccacactagcgttgagatggcgcgcgaggcggagaaggacgcggcggcggcggcggagatcccgctgctgacgccgtacaagatggggcggttcgagctctcccaccgtgtggtgctcgcgccgctcacgcggaaccgctcctacggcaacgtgccgcggccgcacgcggtgctgtactacacgcagcgcgccaccagcggcggcctcctcgtcacggaggccaccggcgtctccgacaccgcgcagggctacccggacacccccggcatctggacgcagcagcaggtcgaggcgtggaagcccatcgtcgacgccgtccaccgcaagggcgccctcttcatctgccagctctggcacgtcggcagggtctccaccaacggtatgtactccttcacatagttaagctgctggcaattgattcataggtttttgttgagtttttggtttcttgcaaattgttctctttggctgattgaattgcaaaccatgaattaattaccaacagaataccaacctgacgggcaggcgcccatctcaagcacagacaggcagatcacaccggacgattcaggcatcgtctactcgaaaccccgacggctgaggacggaggagatccctcagatcatcgacgacttcaggcgagccgcgcggaacgccatcgaggccgggttcgacggcgtggagatccacggcgcgcacggctacctcctggagcagttcatgaaggacagcgccaacgaccgcagcgacgagtacggtggcagcctcgagaaccggtgccgcttcgttgtcgaggtgatcgacgccatcgtcgccgaggttggagcgcaccgtgtggggatcaggctgtcaccgttcatcgactatatggactgcgtcgactccgacccggtggctctcggctcgtacatggtgcagcagctcaacaagcacccggggtttctctactgccacatggtggagccaagaatggccatcgtggaaggacgcaggaagatcacccatggcctcctgccattccggaagctgttcaatggcactttcatcgctgccggaggatacgatcgggaggaaggaaacaaggtgatagccgatggatatgctgacctcgtcgcctacgggaggcacttcttggccaatccggacttgcccaagaggttcgcgatcaacgcaccattgaacaagtataataggtccaccttttacatacaggatcctgttgttggctacacggactatcctttccttgatgagaaagacgagggcgctgctacttatgcttaatcctcaattaaattgtcaaattgaaatgttcggtttagtaatgtgcactatatttgtgatacactcataagtgaccctcacttccatccatcccccttttttttttatgtttgcgtatatcaattttttgcacctcgaggtgaattttgtttacgtaggtatgtaaccatgggcatgatgggctgttgtcaagcctgttgtggtttgatgccaaaacttacccaaccaaataattggcactttaaataataccttataaatatttagattaatgccaaatttaccaaatgtaatgcaactcctataacccaactctactaaaccattagaagtgtcaaaatttacccatgatttgacactgttagagtttgtgtcgaatatgtgtatgtagtcggttacagtttaggacttggagttgtaataggtattaggactagagtatgagtcggactctatcctaggatctctcataaatagaggggcgtgcctgttgtaaccgcatggcgacttagcatagcgtgagggagcggctgccggcggcgaccggctgtgagtcgttgtaactctgatacgttgtatatgctggatcggggaggagcgtccgtaatcagtgccccaaagatgtaggctacggcaaggtataacctttcgctccccggggcaaagctgcttcgcaccactgatagactacttaattaagattccatttcaaaggcactactttgtttctcaagcctttgtcattgtcagtcaactaaggttggccctcggccccctgcgaatccgtaaatcagagagcatgccgcaaaaaaaaggatgtaccaaatatcatgtctcggtgtcgctatcattttggatctcctatggcgttttcttccgcgtttagctaccgatgtcgatttcggggctggttttataacaagtggtatcagagcttgcgggaggtccatggtagaggcgcgatggaggtgcttcacaccgcgccgctcgtggtttatgtccagggagggacatgtgcgcaaggtagagcacggcggcgatcaacggaatttgatcggtggatcgaacacttcaggcggcggtctgaaccgttcgatggctgctttcaacagggagatgactagacgtggtgctctggttgatggcggcagaagcgattggtgatccaattggtgggtcggacacttcgagcgggtggctcggactttccggtgagctactctcaatagggagacgtgcggccgcacgctcgggttgattgaagctggaggcgatcggcgttctcggtgggtggatcgatcactctgggcggggtggcctgggcctttcgatgagttgcgttcgacagggagacggctaaacatagcactcgggtcgttcgcggctgagaagacggcatgcaacttgtcggcttcggctcgcgactagattgatggtgtttaatcggaagtcggagcgggtggttcctagaggcagcttttgaaggtgttgatgaggtaattgcgtgatggacatgctatagagaaggcgtacatacgacaagcgatggaatcaggcagaggggtggtcaattcagatcgtcaatgctttattcaatcgtgttagtacagcaaaggcattggttgcaactgaccggcgatattggtcgctggcgaggttgggcgggatgttggttggctgcgctagaggtcgtacgggtgcgtggtggctgaggaggtcatcagaggtggcggcgtgcacgtttgcatgtcgaagccgtagactacatgtgaccggagtccagaggtagcaagatggttctgttttgggccggatttacgcaggagaccgactcgggtttttgcaggcacagcggatagactcggattacgagtccttcctggctacgcatggaaaaagccaaaccggtgaccaactcgtacacggaaggggaacaaagagtttcttcgatttggttaagaattggactcgaatttctccaaataaaagcagcagaggaccacgggattgcaacaacaagcaatcgggcaaactaccaaagcaaggcgagatctgacctgttggatttcgtgggcggaggtggtctgcggtgtcgggctccggcggcgctgcacggttttcggcgagcagcaggtgcaggcggcggaagctcggcggtgccggctcttggagaaggcggcggacaccggcggcagaggaggcgtcctctcctgcgtcggggcagcgtcgtccatcaccgggggtcttcagaggcgtcgacagcaggacctgcaggcatgcactcgaggacgggcgttggcggcgggaacctaggcgattttcgacggcggcgcggtttggtggtggggtgcggcggctctggtgctcggctggtcagtggggagagaggcacggcaggcgctgggcggcggcgccaatcgggccgagaggagtcgggcagaaggagcaagaaacgggattcgatttggatctgtaaccctttgaccgcatcaactgattctttgaccgagtaaaggacacctgttccggttttttggagagagaaaaaaaaacggttcggtccggctggtactgttcgagttagtcggtggggtcaattaatcagggcagatcaatttaatagggcaacatctgttgagttgattatcatcgatggcggcgacggtggtttccaaatttgaggtggtgaagttcgatggcaccgggaatttcgttctctggcagatgaggctgaagaatctattggctcaacaggggatatccaaggctcttgaggagacgatgccagaaaagatggatgctagcaagtgagaggagatgaaggcgcaggcagctgcaacaatacgcttgagtctctcggattctgtcatgtaccaggtcatggacgaaaaatcaccgaaggaaatttgggacaagttggcaaacctgtatatgtccaagtcgctaacgagtaaattgtatctcaaacaacagctgtatggtttgcagatgcaagaggagtcagatcttaggatgcacgtggacgtcttcaatcagttgattgtggatctaagtaagttagatgtgaaactggatgatgaagacaaggccataattcttctgtgctcgcttccaccgtcttatgaacatgtggtgactaccctgacgtacggcaaggatactgtcaaaactgaggagataatttcgtcgttgcttgcacgagacttgagaagatcaaagaaaaacgaggcaatggaggcttctcaggctgagagtttgctggtcaaggcaaagcatgatcatgaagcgggggtgtcgaagagcaaggagcatgatcatgtttgctataagtgtcatgagtttggacatataaggaggaattgcccattactgaagaagaggagaagtgcgagtgcaagtttagtagcccatagtgatgattcagagagcagcagtcatgagattctcacagtgtctaacgagaagtctggagaagcgtggatgttggactcagctagttcctatcatgtgacatcgaagcgggagtggttctcttcatacaaatctggtgattttggtgctgtttacttaggtgatgacacgagttatcgtgttgttggagtgggcgatgtcaaattcaagatgtatgatggaaatgaggtgctactttcatatgtgagacacgtgctgggactaaggaagagtttgatttcgcttggaagcctacatgagacgggttggttgtatcaggtggattctgataggaagaccatgaatatcatgaaggatggcaagactgttatgactggtgagaggacaagctcatgtttgtacaagttacaagggagtgctgttgcaggtggagtcatggaaaatggttatgctggtgttgctgtgcacgatcctgaaggcggtgagcctggcgtaggctcgtcgggcgactcggcgtgagcggcggaagaaccaactcaagtcctggtacacggaggttcgagcaagtaacagattcggattggcgtggcatatttgccaaggtggagtttgttagagtttgtgtcgaatatgtgtacgtagtcggttacagtttaggacttggagttgtaataggtattaggactagagtatgagtcggactctatcctaggatctctcataaatagaggggcgtgcctgttgtaaccgcatggcgacttagcatagcgtgagggagcggctgccggcggcgaccggccgtgagtcgttgtaactctgatacgttgtatatgctggatcggggaggagcgcccgtaatcaatgccccggagatgtaggctacggctgaactccgttaccaaatatcgtgtctcagtgtcgctatcgttttggatctcctatggcgttttcttccgcgtttagctaccgatgtcgatttcggggctggttttataacagacactaccaatgatttggtaggacaccaaatcagataagcccgagattaatctattatatccataccgcttaaaaaatatgttcttttcttctctagcccgcatcaacagttgtatactattcttcaaagagcaccaacactaatacaccaccccctctattttaaaatttaaaacatattttatttcattaggataacctttaaaaaattatcctatatagaatatcaattatatcatggaaaagaataatcataagtgagtatatttttaatacggatataataaatttaaatttttgtgtcataaaaactatatccaatagagtaaagtgttggtcaaagctttgtataagttcacgtaaatgaaatcttatcctaaccaaacaaaataaaacttatattttaaaaaggagatacttggacctttccctaaattttatgatatatcaagcaaatatgtagcaggaaaaattaaagagggcaaaactaaaatttgtatgtacatcaccgtgttgtgaagtgtccagtattactagatggataccccacaggttgttgtcagagaattgtaatgaaataaatatatatgagttgtattcttttctttctcactatacggttttctttcatgtgcttatatatgttgtatcttgtatcttgatcaattatccaaagaccataaatgattaagttgtatggtatgacttttatggataaaaggtgcaatttgtacctttgatgaataatccaaagattaaaaataattgagataatgtgacttcatgatagaagagagaatttatattaactacgtttagtggggatgaactttacgaattttataggtatatagtatgaaagcaactaatattggagtaaacggcactgtgttgcaaggtttgcaaaaaccatttagtcaccaggcatacagctcccccaatgatctcatcgataaccatgattaccgttggtttgacgacagaaactggcaaaatttaaataagttttgccaaaagtttgaattacctccgatccttttcagcttggccagtttactaaatggtttctcaattatatagcttgattaacttggtggctagtttctcaattttaaacccttcgatgtagagtagagtagtagaaaaaaagggctacgagtgtgatgagaatccataacttacggaggttaaggacggcatgacttttattctagcctacatgttagtatattaagtgagtgtattgtcttttgttatcgacttagattaagcttttaagttaaaataatcggtgcgtataactcaatatgatatttgagctagagatcttagagttcatatatattctagctaacacgtaattaaataaaattgtagttcacttttattccatgctataggttttaggggaccatgtatgaaggagtgtgttaattggaatataaagtgagtgaattagccatcttttcacatcgggaccacctatacatttgtcgacaaattttctcctaaaaatttgacagatgtaattatagtacaatcataatgtaattacactgtaacttgtatgtaattacactgtaacttgcatgtaattacactgtaacttgcatgtaactttcacgtaattttgaatcgttagatctattataagatttgttctagcgaggaagaaaaaaaaatcatagcacacatatatgtgaaaggatttgttcccacgacctccattttaccgaaataacatgttacggagagatttttgaaagttacatagaagttacagtgtaattacactgtgattatactataattacatttgtcaaatttttggaggagaatttatagacaaatatatagcaaaattgtttcacatctactaaagtttctgtgttgaattaattgatgcatgtaacttaataccacaaaagtacactgcgagatcgatcgtcacaatcgcattatggattggataattgactgcgagaaagtcttaattgcacagtgagccagcacgaggcattaggcgacaccgttcgtcaacacaggtaggccgaacccaacgtattcgctgatgttggcaatggcaggacgtagcagcgctcaacgccacatatatctgggcagggctgcatgcacatcgattttcttaatccccggagatattaagtagttatgctgccgtgaaagggcatgtaatctagtggttgcagtgatctgagtagtatctaaggtcctgagttcaaatatttataggagcgaattttaaattaaattatttgatggctaattttctgttcgataagctaagttcctgattttttttaaaaaaaatacatatatccggttagatatagaggccgggtaaaatgcccttctcaaaaagaaaagttacgctgcctatcttctactctctcagttcctaatttttttaaaaaaatacatatatccggttggatacagagtccgggtaaaatatccttctaaaaaagttatgatgcctatcttctactccttccatccaaaaaaatcagccttgatgtggatgtaacgttatatagtacaacgaatctgaacacgaggagtacgatgcttcctcgaggacctgtgatccgccccctttgttaaagttggctccactgttttgtcagctcccacatttagttaagctatccggataagcacttaattaagcaggcttgccttctacaaagaaaatgagattaactgttgtccaactttctctcgtaatactaccaattacgaattatagatagcagggaacatttctaatgtgcaacagagaaatggtttgttaagattgctctagaagagtaacttgaaaatagctctctgtttcaaagaaaaaacataacaccacaaactatggtaatcttatttattttgaagctagtatcgagctgagggttatttattttactttaggtgatctagcacctatagaatgatgcaacataacttatatactcaatctgttctaaaatataacaactcctggcctttaaagtttgtttcaaaatataataacttcaccaccaacattttcttttcaatcaaatacaatcccccaccattcaatttcctcacctaccatcacttttcaaccaatcataacaattataaccacttttttaataccgtgtccaaccctacaaatccttatattatgtaacaaagggatctttttttaagttagctggtcacaaattaaagtaaactagatgggtaccccgtgcgttgctacgggagaattttgtgataatatagtagatatgagttctaaaattttctttcttacctattaaaccatttatttcatgtgtttatgtatttttgtatcttcatcaattttagctaaggttataaatgatttttgttgtatggtgtgtcttttgggaggagagatgcaatttacatctttaatgaaccatccaaagactaaaaataattgagatgatgtggcttcatgagagaagagagaattagcattaattacatcttagtggggatgaattttatagatatataggattaggggtttgtcccaaccttttttttcatatttgaattagaacattttctatgtgtgattaataggagaggctgacgatggaaatcatatttattatgtagaaaaattcatactttcttcgtttcacaatataagttattttagcatttccacatttatattgatggtaatgaatctagatagatatgtctagattcattatctagattcattaccatcaatataaatataaaaaatgttagaatgatttacattgtgaaacggagtaagttcctaataaccagcatcagtcattcgagtaaactacgagtaccatcgatctgattacttcagttgatcagctggtacgtgtgtgcgcgcgatattcaccccactgaccaaagcgcatacataatccatacccgtagcttttgcagcaaattaaaatggttatcaataaaacacttggcgcacgattgatacaaataaattacaaaccgccacagtgggggatgtttgacaatcagaatctctatgatcagctgttgatcactcacgcacctttcttatgctcgcgtcattgcttggtcatgctgctggagactcctcaaaccacacctcgtgtattgtttgttattatatgaaaacaaaaaagaaacgcctctggatatggtaatagtcgataaagtaataatagacgtatttccattcgtcagagagacagtggctgctacgtgagacgaagaaagtgacatgagaacggggtcagaaatatcgtgcagggaaccattgaaaatgggaaactctgcatgcacatggatgattggttgcatgattggtcaatgacaaagtgcgccgagccgccggtcccacttcaagcacggacacctataaatagaactcccgactaaatgcagttcatcacaaccaaaagcgttcatcaagaagtcaagcagagcaaagttcagaagcaagcaagagagaggcagaagcgttgagaaaggccgaggcgagatggtcaaccaagccgcgatgccgctgctgacaccgtacaagcaggctggcggcaagatcgatctctcccaccgtgtgctgctctcgccgatgacgcggtgccgatcctacggcaacgtgccgcagccgcacgcggcgctgtactacacgcagcgcgccaccagcggcggcctcctcatcacggaggccaccggcgtctccgacaccgcgcagggctacccggagacacccggcgtctggacgcgggagcacgtcgaggcgtggaagcccatcgtcgacgccgtccaccgcaagggcgccctcttcatctgccagctctggcacgtcgggagagtctccaccaacggtaaacactcgtcaaacgcgcatgaatgttttatgttcgtgttcataaattaatttcttagcattaccatgtaatttagtaacgatcatcattagtcgatagtgttctaattctgctcttgaatttactttgcaaaacagactaccagccaaatgggcaggcaccgatctcaagctccgacatacagatcacaccggacggttcagggatcgtgtactccaagcctcgccggctgcgggtcgacgagatccctcagatcgtcgacgacttcaggctcgccgcgcggaacgccatcgaggccgggttcgacggcgtggagatccacggcgccaacggctacctcctcgagcagttcatgaaggacagctccaacgaccgcaccgacgagtacggcggcagcctcgagaaccggtgccgcttcgccgtcgaggtgatcgacgccgtcgtcggcgagatcggcgcccaccgcgtcggcatcaggctgtcgccgttcctggacttcatggactgcgtcgactccgacccggaggctctcggctcgtacatggtggagcagctcaacaagcacgagggtttcctctactgccacatggtggagcctcgcatggccatcgtcgacggccgccggcagattcagcacggcctgctgccattcaggaaagctttcaagggcacgttcatcgccgccggtgggtatgaccgggaggaaggcaacaaggtgatcgaaaatggctacactgatcttgtctcctttggaaggcttttcttggcgaaccctgacttgcctaagaggttcgagcttgatgcgccattgaacaagtatgatcgcaacaccttctacactcaagacccaattgttggatacacggactaccctttcctcgatgaggatcagaacaactcggttgctgatgcttagattttgtgctattttagttgttggttctatatatccacaataataatgtgcacgattcatgtaaacagtgttagtatatgcctgcgtgcaagatgtcattttcttctctcttttttgatggtttatgtctgcaactaattcattttgatatttgattagttatgcatccaaatatattgggattaataaacgcagatgtattcacaccacatgagaaatatatgtgttcttttgtaattttataagttgatgtgctgtccttttttttacatcccagcatgggtcccttttgaattatcttgttaaaaaaaacttttctctctttgaatttacttagcatataaatccaaattaattccaaacaatggtttccatcacttgtgcaaatttttttttgtcacaattccaaattaaataccttaacttttatttttgataatggctagaaatccatcctctaaaacctaaactgacaatgccgatcgtacgaattatttttgggcaagcccttaagacactttagcatacatgcacacaaaaaaattatacaattatgggcctctttatagatgatattatgggcttctgttgaaatattttagagggtgtatgtgctctctggtcgagatgaaaagaagacatgctcatgattaaatcatttgagaagttcttatcatttaacatcagattgccttttatggttttattaatgttgtccatcatatatgtatattttttagagcttctatgttttcttcttgccccagcaattgtatcatatatttttgcttaggaaaaagtacgaatccctccccaactatcaggtgagtacgaattatccccctaaacccgaaaccagatatttttcacccctcaactatcgataccatataaaaaaaaccccgaccagctttgtaagcggttttggtctatgtagcagtctagtcagtaatttttttattaaagaaacaatgggccctacctgtcggatatctctccactccatgtcttcccctctcacccaccctctctctctctcaaatgccagcagttgtggctcgagcgccgacggcagcggacgccccctttgtcgcctcgacgagccgcgcggcgatggctgcgggtgcttccttcgccgcccgaacttctcccaccaccatccttggatcacttcgccgccccctccacctccccgagcaccgctggctgcgggcatcccctccgctgcctcaacgagccgcgcgccggcggctacgagcgccccttcaccgccccaagctccgtcgcccccttggccccaagctcggcccgccgtcgtcctcagctcgctccatcgcccccttcatctccctgagcaccgctagctgcgggtgcccctccgctaccccaagcaccgcccttcgttgtccgctcctcccaccactcctcctcccaccgcctcgagctccgctgccccctcctcccgtcacccgaagctccgcccgccgtcctcgtggtgagggagggagaagagagtggattttggagagagatagaggctacgttcgttacattgggttgggaacgttaccctccggcatggaaaatggagcagtccattagcgcgtaattaattaaatatttgttttttttcaaaaatggatcaatatgatctttttaagtaacttttatatagaaactttttgtaaaaaacgcaccgtttagcagtttgaaaagcgtgtgcacggaaaacgagaaaaaggggttgggaaccccttgaaccgaacacagccagagaggtgagtggaaaaaagagagtgtgggagacagacaggtggggcccgctgattaaaaaaatgaattgctgactggactgccacgtagaccaaaaccgcttgcaaaactgctcgggggagggggagtttcatccggtatcgatagttaaaggtgaaaaatatttggttttcgtgtttaggggggtaattcgtactttttccttttgcttatcaggtccaaattatagaatggaagataaaggggagagagagagagagaatacaaaactggagggggccttttacagtacattttactaccggtggtagtagtgtagtagaaactaaatccgacccttcatttgtttgggtattttagggcttttaaaaatgcttagggtatttttgactttcaactctaatttcaattatagaagggtattgctcgtaatcttggcgctgcaattatcctaatcgacggatcatggcaaggtcgccgcgacgccggctgcttcatcgccggttcatataacttctcaccggcgtcttaaccttctcactggcgtcttgaacaggagtaatgctcgatcaatttatttttaggaatcctccatcaatttagacgggcacatgtgtatatgcatatactaatttgaagaaagagcagcgatgcattccaaccatgtttgcattcatgcaattagggatcggcgaaccgtccttctctccggattagaagcaacaaaatcaacagaaaaaaacaaaaaacccgtatgaacacttgcacgttcatcactaggacaggcccacctacagtctgagaaaaccaagagatggcgtaaaaaatagagtagattagaaaaaaaaattaaccggtaattaacacatgcgaaattacttctttaccatgcaaaattttccaaatctacccttggagaaataatactatccataatactcagtgtagtagtggcggatatgatccgctggatgcaacgaatggatgatccatatttacccgagggtacagtaaaaaaatccaactggaggggtataagaaagaaagaggtcatcgattttcataagaactagctatgtggggcccactttgtgaggcccaaatattagtgattgtggcggtgaggcagacttatgttttgatgtttataaaggagtaaagatatcattgcgatgatcctcatataaaaaaaaattcttgtgtgtcattgagtatttgctccatcattcccatacccctaaatttagccatgtttcctttatacccttaagttgttttgttcttttttatactcaatctgttaattgaccacgagatttttcacaaatactacctccatcccaaaatataagtatttttagctataaatctggacaactatgcgtccagattcatagccaaaagttgctatattttgggacggagggaataactatattgcctcttgtttctacattttaaaaatatagatctcaaggtaaaaacagttttgactctaaaaatcggagtggacatgatgatttgatcaaaaaaatgaaataaaaaatacttagaattttcaaaatattaaaggtaatttcaaccccccctacccctccatggaaatatttccaaatttggttgtggttaatttttaaaatataacatttcattttttttaggggagaaaaatagagaaaaatgtgattttgtaatttcccctttgaattttcatcaaatttcactgcaattcagttcaaatgtttaattttagattcaaaaagttggtcaaacatttttattccctacaatttgtatagctgaagttattcactttcaaattatgttttataagacgttagcatttaaactacaatcccgaaattacaaatttatagattcaagctatgttattgcacaattatggacttagaacccaaatatatcagtaatcacaaaattatctaatttatcatccaaaatcaacgaacaaagcagtttggtagtttacgactttatggtgtgatttttgtttgcttgtgttgttactctggtgcaaattttgatttgtaatgtcatcttaggtgcttaagaaatgaagttggccgagcacaaatataggtatatggtgtacctgcgtcatctgttgttcatgctgatgatcgaccatatatatctccatgaccacagacatgtgtaatatgctcgtcatgcaaacgaaacatgtcctgatacgcagacaacagggctgctgcctgttacgcagaccaagttcacgacgcaaggctgacgaaatcacgatatggcatggttggtacggaggaagagtcaacgatctatatggagccagcagcgcagcgcgattttgcagatcgaaaatattagcgtactctgccggtcaatggagaaaaccgccgtcgccacgcgcgagggtccactccgacacctataaatacaaccaaactccaaccccattcggcacacagccaaagcgtttagcaagaacagagcaaagagctagcctagctagatcatcgcatcgcatttgttagttttccatcgccgattgatacatacatcatccaagcagagcaatcaccaatcaaccgagacaagatggtgcagcatcatcaagcggcggcgaacgacgatcatcaggctatcccgctgctgacaccgtacaagcaggctgggcgcccggggtcgaagcttgacctctcccaccgtgtgctgctcgcgccgatgacgcggtgccgatcctacggcaacgtgccgcagccgcacgcggcgctgtactacacgcagcgcgccacccgcggcggcctcctcatcacggaggccaccggcgtctccgccaccgcgcagggctacccggagacacccggcgtccggacgcgggagcacgtcgaggcgtggaagcccatcgtcgacgccgtccaccgcaagggcgccctcttcatctgccagctctggcacgtcggaagagtctccaacaacggtacgtgcaccacgaaatatgtacattcttgttgatgaatttgccgggaaagtgaaatcatccctcgaggggatatcccctcgtttcgtgcatgtcacctaaatagttataaaaaattataaaaaaaattggcaacatagattaatacgaaatatatcactccacaaacatgcaagtttaaggtcaacttctacaagttgtaacaaaaataacaaatatagttgtgaatgtgcattaactattttcagtttaatttgttatttttgttgcaacttatagaagttgaatttggttttgcatgtttgtggagtgatatatttcgtattaatctatgttgtcaatttttttaaaaaaatttgataactatttagaagacatgcgaataacgagggatgtcgctggatgaaaatccacatccgaatttgccgtgtgtttctcatcctgcatgctctgctacaggtttccagcctgacggattggctcccatctcaagcaccgacaaggcgatcacaccggacggctatgggatggtgtactccaagccgcgacggcttcggacagacgagatcccgcaaatcgtcgacgatttcaggctcgctgccaggaacgcagtcgaggccgggttcgacggtgttgagatccacggcgcgaacggctacctcctcgagcaattcatgaaggacagctccaacgaccgcaccgacgagtacggcggcagcctcgagaaccggtgccgcttcgccgtcgaggtgatcgacgccgtcgtcggcgagatcggcgcccacagcgtcggcatcaggctgtcgccgttcctggactacatggactgcgtcgactccgacccggaggcactcggctcgtacatggtggagcagctgaacaagcacgaggatttcctctactgccacatggtggagcctcgcatggccatcgtcgacggccgccggcaaattcagcacggcctcttgcccttcaggaagcagttcaatggcacgttcatcgccgccggagggtacgaccgggaagaagggaacaaggcggttgccgatggctatgccgacctcgtcgcctatgggaggctcttcttggcgaatcctgatctgcccaagaggttcgagctcgatgcgcccatgaataactacgatcgcaacaccttctacacgcaggatcctgtggttgggtacaccgactatcctttccttgacgagcatcaccatgacgacgacgatgactctaatgctccttctgcttaaaaccagtcatgcaactcttcaaatcgatcggcatcaataatcaataatgcaggcacccgtgctatcgatttcactatttaccgctacattttctttaagtgatttatgtactcttgtactattgtttatgtttagtgtgagaagacatcaagacatgcatcatgcgtgtatatatttactggaataaaacacgagttatatgaacaatgattttgttttatggacacttctattatgcgaaagtttgctactccctgcgtttcaaattgcaagactttctagctcattaatatgtactctccctccgtattttaatgtatgacgacgttgactttttgagcaatgtttgaccatttgttttattcaatttttttgtgaaaatatgaaaatgtttatgttatgcttagaaaacatttgatgatgaatcaagtcacaataaaataaatgataattatataaaacttttgaataagacgaacggtcaaacgttaaaaaaaagtcaacggtgtcatacattaaaatatggaggtagtatatgaatgtggccaattctacgaagttttacattgtgaaatggagaacatgcctttggtctttggtcttcccatcctagaattaatcttcttctcgttctgtccatcctttatttgaaatgttttagtttcaaatgtactagcgtttcaaaatctttatcgattagaaagtttgaaagacgtgctcatgataaacgagagaattataaaagctgaacgggctctcaagcaaagtcttagcttaagtctcgtttgcatagccatagttaaaaaaaaaatagaggtactctagtaaatcaaagttgtgctgagcaggcctggattcggctcctctgactttaggagcaaacggcaaaggtgcacagtaaaatgagtctagtgccgtagttaagaacgagaaaacggacaatgtacacttaatagattgggttcagatgaaatgccacttaatacaatgcactagataaaacaccactcaatatgttgcctaccagatgaaatgacactttggagatttttgtgcccaaaatgtccctatatatataagagagagagaaggagagcgaagcgccggggagggccgggcaggcggcattggaggcctcaccgggtggtggcggcgccggccggcagggacgacgggagaggaggatagggcggcgggcgagcggcggtgaggacaatgcggcagagggaggaggaggcgacggtgcggggaaggaggacggggcagcgtgcacgcttacctgcgtgttcgccgggaagcggcaacggcgggg

SEQ ID NO: 67290 - DNA, 503 bp, Oryza sativa
cgaattcgagctcggtacccctaatacccttttctaaagttatatatataaattataatgtagttatataaagtttaaaaaatataattacactataattataattatattgtatttatgtttaataactttttagaagaagatttatcgactagtcctaaacagaagcagacacataagctaggggacaattttagtatttacaaagccaaactttgggacaaatgcgagcacacctcttaaacacacccttaactaaactttaggtataagagcaattttcagttcacaaaccttgcagcccaacgcgtacgtaagctgaccacgcactgacagtctaaccaagcaggactgtcccacaaagtcaaagcgaaccgacttgacctaactggctacgacgaggtctctaccaaaatggaaacgtaccagacaacatccgggagacagcgaggcgaccggcgtcgtacgtagtacaaattagtcgtcgtactcgtaccctcaat

SEQ ID NO: 67291 - DNA, 1585 bp, Oryza sativa
gagggagtgagaactctcgggtaccagacataaccgacctcgcccttcactcgttaaatcccttggcaaatcatgctcatatccaatattgtttgaaagtaatttttcccctatcaagcatatcataaaacccaaggaataaattccgagaagagccgtattaaacaaagggaagctaagacgcagtttcctttacctctgagcatacggtacgtacacatgccaagcttggcaccggaagcaccgccggtgccatcttccattgacagaaatgacgccgacaactctcatgtgcctagacatttgcaaagccagaaacgaacctgatcaaaatgccttttactaatccaaatcacaacagcatgaatcgatgcgatctcacacatataaaaaaacagtagccattaactagaggaggtaggaaatacgtacatcgagaaattacggcccatgtgccatgttaatttggttaatactgcaagcccctgcaagctgcaagcttcacggtgttctacacagacatgtggttaaaataaaatggcacactgactgtaagtggagtcaacgcaagatctgtaagaatgacaaactggcaagtgaaaaatactggcatcctgcgccaaattccagaagatggaatgaagaaatgctgatccatgaataagatgcagagatgtatgtagcttttgtcagagattgtagaagacatgaaaagaattgataaattgatgcgatcactcaccagatgcttggtgtaatttcagtggtataggtttctttttacttgaattcagtagtataatttgtccagcaattaatcaaagccccaacaacttcagtgattaattccatacttcattagtatcattaccatcctggagaacaaaaatgtatatgagaattatatttatcagaaaatacagataaaaatcagacaacttaaacatgagtggtacggcaggatgcagtaagcgcaaaagatttgtttcaatttgggaaaaatacaaaagcaaacatcagatttaactcaaacaagtgctatgttgacatttttacgatcatttaaagcaaatccagttgactttgtcccaagacaacatttgagcttctcaaagtacggatatgtgatgaacttgtactaagatgtaccgttataaatttgcaaattgtttatagcacaagttctggggttttgttcccatgagcatccatgaaaaaagaatatgagtgcacagccgcacatagggcttagtctgaaacttggaggtctgaatttactggtggaattttggtatgcatcacctcgtaatccacaactgacttaccctttctgacttgcagatcaatttgtctatggaagaacagttcaccgcgtcacttgcattagttgggtttctagaccagagtgtcggtctacacaaaaaccatcagatcaatcaaattaatccaccagtcaggagtaactcctttgaaagattcctctgaggaacgactgatatctattggagctgcacaaacctgacaataatgagggactgagttgaacaacagcaaatcattggtaactgttccgaaggcattgact

SEQ ID NO: 67292 - DNA, 700 bp, Oryza sativa
gtacaatgtatccaaatatgttgtactggaaaatatttttattctcctagtttttatattttgtgacggatgtaatacgtattataacaatatgtggctatgaaatttagaaaatgagcgtaaaagctggctgtttacctgacgagacgtgagcgtcatcaccgtgcaggtcgtgcacgttctccagtaaactctcctagcctgaaggccctgagcgaacgttgcctgcacgcaacctctcccattggtttctcctgctttttccctttttcttttacgtaccattttggttggctacaaaacaaacaatgagggggtgtagtgtacccactggtatgtgctccagtgcacggcgtgatgcaacagcgtttgtgctacaccgcctcacgttgagaaatcaacacgagtataaattgatatataacgtacttgattttttttaccaacatctgatcattcgttttatttaaaacttttatgtaaataaaaaatatttatatcattcttaaaacatctaatgataaattaagtcctaataaaaaataaataataattacataaaatttttaataaagataaatagttaaacatatgttaaaaagtcaatagggagggagcactactactactccacaaccaacacgagcagtagtagtattaactaatgtaaatttaagtccttttttttttgtgaaacaca

SEQ ID NO: 67293 - DNA, 2863 bp, Oryza sativa
cagctgggatagatttcctaatttggaaacaaagtctctagttgcacgaacttcacataaagattgcaattccttcaagttccacaagccctcaaatggctccaaagattcccaattattcagacttttgtatgtagcatcaactaatttccaaacaagtaaatgacgcaattttttcagatttgaaaaccctctcggaaaattcagcaattgtgtacgttcaagactcaatgtttgtaaattgagaagctttgtaatagattttgggaattctttcacattggtatcattgaggcataaataccgaaggttaaatagctccccaactgaatatggaatggtctcgataggcaagccggataattctaacacagcaaggtacttggattctgagaaaatgaaataagaagctgaagataatgccatgctagtgtcaaatgctaggaaggtacgtagcctggatggatctacagttgatcgaatttcactgttgcattggagcacagagacgcggcgagagtctgatcccacttgtaccaccccatgagtgtcatcataaactgtagagaaactttctttctttgattggaaaatggctagttctcgcaaaatatcatgcattcgaagacactgaatcctattaaaactattccttgctacgacttgaatcatgcttcgtcggacaagctctgttaggtaaccttcagcaacatcttctaagctgcatgttcctttctgttcaataaatccttcagctatccacaatctaattaatctctttctctggataatgtagtcttctgggaacatagcacagtataaaaagcaattcttcaaatagtttggcaagtgtttgtagcttagatttagaattttctccacccggtttaagttttcattattgtgcacctctgaaataagttggttgtagaaaagcctccattcttttttattccttggtttgagggacagtaaactccctattgtaacaagagctaaaggcaaaccaccacatttgttcactatgtccataccacactgatgtagttctggagggcacatatgattttcagttttggggaatgccttcctgcagaatagaagccatgcatcatggttatttagaggctctaaacggatcttacaaccatcctcagctattgaagctacttcctcaattcttgttgtaattattactctgcttcctaggccattatcaacaagaacctcccgaatctttaaaagatctgcagccaaccagacatcatctagtatgatcaagtaccgcttctgacgcaaaatttttgccagttccagtcttagttctctattgttcatattttcagcatcaacccctcggttgtcttctccacaaagttcttttagcatgttttgccaaatatcatgcattttagatgattgagagatacatagccatgcatggcaattaaaattggatactattgcttcatttttgtagatatcattgacaagagtgcttttcccaaggccacccataccccagacagcaatgatccgaagagaacaatcttccaaacgcaatgattcaatcaaggtttgcctatttttatcaatccctacaagctcattgtcattgattgaataatcatatccaggcaaatacaactgttgctcgctattataatttgttggaggaacataaatcccactcgataatggtcgggtccaacgatctagtcttttggaaagctccacaagctctgtgtttatcatatctgctttagtggcgatttcatcaagtgaaaataaaggtttaggtttcttgataattttcttcacacaagcccatgatttcttgtgtctgtttttgccaacaacatacataaattcatccacaacatcttccatatcatgtgccaacctccgaacttgccttatccaagtttctacaacttcacctttgtacccattcatgccaagttctttaagaaatgcattgataatttcaagttccttttttatttgtctcatgttaactggaagtgctgttactagctcaactttctttaactcggtcttttttgcaaagaggggtatagctaactttagtgtatctcctgccacagctattcctatcttttttatgacaaaaagaacggcaatttcagccatttctattagtgcagttacttcaatatttcagtgaaatgcagttgcaatgatgaacaatcagtcctaagtaccaattccacccttgtacatcatatctacagggaaaaaacttattcatcaaacaggaaattctaactgccgaacaagttgcaatggttaaagcagcaattatagaagtgcaatctgctaaaaagattgttgctgaataccttcagtattgctgaaaattgttgaaattatttttttcttgaagtacacccgcttgatggagaaaaaggagagatgaataataacacaggaggacacgtgtgtgtatagccgtgctgttcctgtatatgtcacaacaatttggcaggggagggaaatggaagaatttgtcagttaaagatataagtactgggaaacaattagattgttttcaaactgagaaaataatgcaaaaaaatatattgtgcttgagtaacacattcattttccatgttagctatatcacgcttacagtgtaaattactaaaaagcactactctgaaaccgtaaaaggaagaaaaggagaagagagcattacaactttatacatttgatcaaattttcttcatcatcatgctgatgtgaataatcttccctgttgagcaagaaggcagcatcatcaaaattgccaagtgacagaatggcaaagctgaaggaatgcagaagtaaagaagcagcagtg

SEQ ID NO: 67294 - DNA, 5617 bp, Oryza sativa
ataattataaactcaaatgttttggatggaaatttcactcattgtagctcaaagtatgttcatgggaatttcactccactacacagtcagtgttgtggtgtcacagtcaggttgggctgtagctagtaggcccaatcagtaagagaggatgttaggtaaaatgtgtggcatctctactatacttatcgaactggaaatacacaaataacccattcgtgggtccagtatttttttccgtttgcttcctgtcagagctccacggttgtctttcattagcaaatttaataattaagatgtaccaaaagtatgcagaattgcctaacagctagttgatggtttcttcagaacaaattgcagctgtctgaacctttgaattaagaagttgaaaataactttggtagatttacgcagttgatgatattatcatctagacttctctcatgatgcaatgccataaaagcaaatcacagcaggctgaaccataaatcagttgagaaaccaaaccctgtattggtataagtaagcatacaactgaaaatttcaattttaaccaaaaatgagagtaataaagcaatgaagtatatcctgaatgagtctaattttttttttgtcggtaattatgttttggtgctttcctttctaaatcgacatagaggtagcatgattctcagctctagtttattcagactctgttatacgcaatgttacgcggtaggaacatttcgctctaccacagatttcttttaggttgattgttattgcttttgctggatcttctaccttccatcctccatcttcatcggggcatttaactttttgccaaagtcagtacccctaattgtccaaatatctctccatcttctactgaaatgaactctgcttccccatgaatcctatcatgctggaacatcaatcaatcaattactagcaagcaaagcataacagcaaacaatgaggaatcgattggaggcttgaagtcgaaatgtacctccgtggaacggggcggcgtaatggcgaaggccgcgggtggaggagggaggggcttccggcgagggcacccgcgccgccgatggcgcctgcgcctgtacagtccaccctgcctcgcgcatgccgcgtacggccgtgtcagcgagcagagcgcgccggcggcgtgaaggtggccggccggtggcggcggcggcggttgttgcctgctgctgcagcctcggcgaaagcctgggtggtcgccggtcatcctccggctagccgcggaaggggtcgaggtgggaacacggccgcagagggagacggcgacggcgacggcgagctagcaaatgtgcagagaagcacctgcgaaattacacaaacttctaaaggtccttactaggggccgtttgagttcacgccattagcgcaagactaaggccctgtttgtttcagcttatgattattataatctagattattaagccagattataataagctgtattataataagttgacatataataagctatgagttgtttgtttgtctggattattggaggtatggattattgggtttgaaaggctaaagtctataatgccctcagctatatgttcggttgatggcataggtgggtaatttttcttaagtatgtagggatagtgggtctttagctactcaataatctgaaaaaagctcctctagagcagcttattagattataataatctggcttatagattataataatcttctataataatctacttgtttgtttcagcttactactaataagctagattataataatcctaaactgaatcaaacagggcctaaatgaattttaattattccaaacttaatagggttgtgtcatataggtccctaaactctcgaaatgcatatctagatcccagtacttgttaaagtgtatcatctaggtcccaaatcgacacatcccctctaggatctacgtggcgctgatgtggcatgtcacatggacgttacgtgtccttttcatctttttcttcttttctttttctttttcttttttgttttcttctcattctactttttttcctttcttctgctcgggtcacagagaaaggagaagaaagggaaaaaaagagaagaaaaaagaaaaataaaaaattttaaatgagtcccatttgtcaatcaaaatgataccatgtcatgtccgtgtggcaatgccacatcaacgccacgtagaatactgaagaggttgtggcgatttaggacctaaatgacacactatgacaagttctgggacttggatatgcattttgagagtttagggacctagatgatatacccctacaagtttaagggccgcccgtacactttactgatagatttgtctgatagcagtttttatataaaaattttatcgtacgaaacgcaccgtttagtagtgtgaaaaacgtgctaataaacacccagataaaatctgcatcttaatcagaaaagaatgttgagtggtatgacaaacaaaaatcagttttgaaatagtagattacagcaagtttatttcaaattttaattattgtttttaaaataaaattccaaatatatacagcaaaatgatcatgattttttctataatatagttgtgtttattggtgctacatgaggtgaagtgtaagtaaagagtagcacaattttaacgagatgaaaaggtaagtgaaggtttctaacaatgtgtcatgtatttataaacttatagtgagatagagtaagaactttcaatgaagcttctagccaattcctcagttccaaatgctaccatggatgaaaataaaaacccgcatagtagtggtttttcatctcttgggtttccttggaaattccaccataatgtgcatgctctaaggatggagtagagatgagatgagccaatggttaataagaaaaaaacactgtgagttgaatcaactgtattttccaaccaattgatcttgcgtaattaaatttttgaagaggtaaatagctgcacttgcttgtcaattgtgtatttatgtgcaattgacataaatatttgacattttgggcaagatttaattaaaactttgatatttgctatttatcgaatgcttaattaaaaaggcatatattccatggaaacaactctctcgtaatatcatggaattattagattttttttttaaaaaatgtcctaatataaaaatgaaagatcaaaatttcacaggtttgactttttttaaaatatttataatcggaggtcacctaaagcacaccaacaagatcaaaggtccagaagaccaacacagaaaatactgagtggacaaggtatatctgtccactgtcttaaagtaaagactgagtgcattattcatcaacattaacctgataattactccgatcagtgttgccaattataaagtcatccgcatacacacatgctaggtcaaatagaccacaattgaccagctagacagctagttaagagtaaccactgacaaaacaagtgttaacatcaaattggtgatactactacaaagacactcaacacaaagagaaaacttgaccacagatggagtaaaagaggagatatgatgatctgataattaattacacacgctctgtatagtcttacaaaaatatctcgatccgcgttgaacagacatacagatttctttcaccaatcaatatgtgatcgatctgttgttatttaacttcttaattaagtaggtctgcaattgcctatcaatttggtgctaatttctgtatcagacatgcactaccacaagaagcactcgaaagggcagttagtcatagagtgagaagactaactgaattttactgattgcattgtgcagtgtcaacgatcgatcggctaaatttattaaacaatgccaaataaatatttacacacttgaagtaagtaagtagagtagcagttgcgagttgctcagcaacttgtagcattgaccagtaacctcaatgaaagatgcatggtatcagataccacaagaccagcttaattagaggcttggagctagtaaacactaacaatgtaacataaaaacacgtgttagcatcagcctaacacctgcccatttcgtcccttttttttttttttgttattgtgttgcgtttcctcctagtaaacagtgtattctacttagtaatttacttggcttgaattttttttctgttcttttgagtcaaatgacttggtgtgtgaccgtgtgaatcaacaggaccaagcagggttcgtctttccaattgaatggtagataccgaccctatcagtatgacattttctgccaaatttcaacaaaatttattattccaaagttgggctctcgaaaaccattttaaatttcactcacagtatacttctgtcctacattgaaacatcgaaatttcgtcgtttttaatccgctttcatcgaaaacataaatctgtgggaccaagagagtcggctagtaactgacgaccagacgagttgcgattgcgagcagccttccggcccacacaatagtccacaccggccataaacgcgagcccactaaaagactcggcccattactatactagcccaagcaaaagactcggcccatggatagcccaagtaaccaacgcgtatgcttggaaggcccatcaaaatcggcccagcaggcgagcgtgacgtggaccggtcgtttcgcgcgcgaaacgtggcgcctcacatgctcgcggtcgccgccgcgcgccacgtcgcgccttcaccaacacgtagctcgggacacggcggcgcgcgccgccgctgcacgcgtccacaaaaaccccacctcgccggcggccgcacatgaccaccaccaccgcagcaacgctcgtcgacggccatggacgacgacggcgagacgccgatgccgtcgctcgagctccacaagctccccaccctcgccggcgccgccatcccgaacccgatcgcgcgccacccgctgtaccacccgtcgccgagcttcttcatctcccccaccgacgtcgtcctccgcgacatcctcttcgacgcctcgccggcgtcggccgccggtgagcggcggcggcggcatgtcgcggcgtaccaccgcgcgggccctcgccgcgaggtcgcgttcgacccagcgacggtgcgcgcggccatcttcacctgcggcgggctctgccccgggacgaacaccgtcgtgcgagagctcgtcgtcgggctgtccgagctctacggcgtgcgcggcggcgtgttcggcgtgcggaacgggtaccgcggcttctactccgacgaggtcgtcccgctcgacccggcggcggtggagcactggcacaaggccggcggggcggcgctcggcacgtcgcgcggcgggttcgacctcgccaggatcgtggacgccatcgagcggcacgggttcaaccaggtgtacgccgtcggcggcgacggcacgatgcgcggcgcggcgaggatccaccgcgaggtccggcggcgggggcggctcgccgtggcggtggcggggatcccgaagacggtggacaacgacgtcggcgtcgtcgaccggtcgttcgggttccacacggcggtggaggcggcgcagcaggcgatcgccgccgggcacgtggaggccgagagcgcggcgaacggcgtcggggctgcagg

SEQ ID NO: 67295 - DNA, 1276 bp, Oryza sativa
atccgaaccagttgcagcgagctcactcgaactctgcactggcctcacaagccaacagaatcatcatcagctgctgccttctccagctgcgaggcagcaggatttggactctcttctctttttagagaagcataatttggacttgtgttttggtcctatcaacacaccactctgaaatatcgtatgtgatacacatgcttaagcaaagtagagtgatcactatgtctgaaatctgaatgttattgtgacctatgagcaggttcaggtggattggatagttgttttttttccaacttctctgaacaaaagggatggtaaaatctgaaaattgtaactggaaagattatgcagaagtgagattaccagtgtctagattgccaatgatgacgccttctccaaatctcgccttggcccagatggagttggccctaatccggccatccttctccatcccaagaaactcccatgaacgggtggtgtgcaacctatgccctctgtttgggaaaaccgagatgacacttggatgctctgcgatagagaaccagacgaatcaccaaaccaagaaaaaatcgtacaaaaatcacacaagaaataaagagaaagaattacaagactattagactagtacttgatatctccattgcttcctcctcctccagagtagcagcgaagccattgatgtacttggtgtaggagtagaagatcgcatctctcgccttctccttgctgcattcaaacacaaccagatcgtaagattcacttgcatttgcagcagatttcatattcagattaaacagcaggataggtggtcctttaccttcccaggaaagagcccaagaactcgtggtgggagttcttggcgcgttcttggctggaggccaaggcggctcctccccttccatgcgagtggccgccgaggtagacaacaaacgactgcaaagaaagcaagttttcaccaccaaatacaaagagaaaaacccaatccagcaacagaaacgatcaagaaaccacttgccttcttctcagcataggctggtctctgcaggagcacaaggctaccgatcagtagagccagagcaagaagaggagcagggggatgattcttcagagaggaacacatgttacacacagagtctactcagattgttctatggattagtggtcaaatgctgggggggggggggatttggagtggatggaatgggtgatggattcttcaggagttcagagaaggtgaatttctgaatgtgcttgggcactgttggtattttatagg

SEQ ID NO: 67296 - DNA, 1558 bp, Oryza sativa
gagtagtagcactagcactctactagcaggctagcagcacagttcatgagctgtgtgagcagtggcgttcgttcagagcatcaaaggagaggcagctttcctacgcctgcaggctgcggctgctgcaatgcagcctgatgcctgtggccgccgtacgtgtgcaccggcggcgacagggaatccccgaatgtagagtcaaatccctcatcggcgccattgccattgcttcttggttggtttacagtattcgcagggccatgctctcgcgtgcctgtgagcatgtgaaattaacaaggatttgttgctcgcgcgcgtgcttgcaggggtgtggccggaggccggcagcttcagcgacgacgggatgggacccgcgccggtacggtggcggggaatctgccaggaccaggcctctgacgacgcccaggttccttgcaacaggtctttctcagcctagtctttttagcttatgcttatactcccatcttatatccaacgtttaaccattcatcttatttaaaaaataaaaaataataagtcacacataaaatattattcacgttttattatctaataaaaataaagatattaattaaaaaaataaataagacggaggggtttctatgtcaaacgttagacatagaaacccatgactgcacttgaaattggacggggggagtacttatcagtcaaaaatttgaattttcaactttaaatttgaagtttatttgaggttttttttcatcgtagtttattttatcctttgcttttagatcgctaagaacacgtatataaaatttttattcatactttttttcatttgcaaatatatcatttcgctttttacaaatgtgtctctccctctctcctttttaccgtctcgtcgttcgccctatacaaaatcagttgctgctaaaatttaaattttcagtttaatttcagtattttttttgaatgtagttttttgaatgttgatttttaagtcaataataaagttttatttgtaagtactaaattatgtcttctctctcggtctcggacgctgtgctgtgtccttaacctgcgtgccttcttcgtctgatcggctcacgagggggaggtttatcctgcgtgatgggggagggtttgtcgttgctgatcgtgttgtttatactgcgtgccttgtttactgcttttgtttaatccctaagcaataggcgtgcatcttgacttgtcgcattgaagagtgtaaactagagttttcacaactactgcacttttgtttagaacgagggatggctacaaatgcctacagagcagtcagacctggactttggttccagagacgtgtctggtcttgctaacttggatttgttcttcagagagatgggctttgtctggacttgattagtttaacttggtgcttagtgctatctggataactctccttggaagctatgccatatataatgccaagcttacatgactgagagctcttttttttttctttttttaactaagtagtagtgtaaaacaactaatcgagccaaaaactagttctaattgagaaaagaaaaggaga

SEQ ID NO: 67297 - DNA, 8280 bp, Oryza sativa
cctttcatttgataataaaaaaaagttttatagcgttagcaatgtgtgttgtaataagacataattttttagcagaataatcaaaactgcatttaaaaaagtatgcataacttttttttcaaaaaaagacaaaagattgggaaaaaaagtaagtagaattaggttcaagataaaagaaagttactagggcaaatatcacaaatgtatgatgtcagcactttagcgtttcctattaaaatgtgataaatgaactgctctgccttgcaaggttgagataattagagattacaagaaaaaagaaagagctttctatcatgggagaaaaagaagaaatagtggtaggtcgactattataaatcatgaaatcttatggagtaaaaacattcagagactagctcatttatatagatgtaaaacaaaatgtaaaatggataaaaagaacagaatgtgaaatctctgtagagtgtagtagacttttgtcccccttgccttttagctctggatctctcattctctctctcactctccctccctaccggccaatccatccagtccacgcagtgaatcatgtgatgagagatcagatgaccagagctcatcctcacctcaccggccggtcagtcacaggagcatttctttctctctttctttctttctttattaatttctttcgctgttgctgttcttggcgccacacagattgctgccatgattccgcagagattagagcccaaaatccgcccccaccctggaaagatttcccctctctttgtcgtcccctttcccatgattacatataatccccacacgatgaaccctacctccctctcccctcggagatcgtgctctctgaattttactgtggcatcacactatgtgccaaattaacctgcttgtcccatgtagtaggagtatgtgtatcccagtgtgcactgtgcagtgagctgtttgtttgcttgcttgcttgcagcttgtggattcattcacattcagatatcgacaagcagcaagcggctagaacagcacagtgcagtgtgtgtgtgtgtgtgttttatctgaagaaaaggtcaaaaaatgtgcgagttttggatggatggatggatgggtctccatgaagccatgggccatggctgtcttgctcaaggcagcagcatggtgcaatgcagtgcagcacagtggtacagtcaaaacctgaagaaatgcattcagggagagatgagatgggatgagagatcagacagactggttgtcgtcgacctgtgcatggaccattgctccctcccttatcccaaatctctgtttgctttcgtcaggattctcttggtgctttgaccacaccattagcttaagtgcttggcaattactccattcattctccaaatagttgacacagttgactgcggtcatctcacgttaaccataaattaaataattagaagaggcactaatattctggagcccatcaccttgtggagctagccaggagactcctgggtgtttctcataatacaaaacattttcaagtatttataacttttgtgaaaaaaaagaagacaagcggtcaaagtttaaacttaatagtatcacggtcaattattcagtaacagtgtagaaatttacaagtgttaatagtatcacggtcaattattcagtaacagagtgtagaaatttacaagtattaatagtatcacggtcaattattcagtaacagagtgttgaaagttagtacaactttggtgatgaactgttccttctgatcgagatgcagaatggagagttcagtgtttcacagttcagaagttgatcagttgatgaggtgaatgaaatttgtacggatttgatgcaggaagctgatcggtgcgaggtacttcaacaaggggtacctgtcgacggtcgggcaggcggcgaacccggcgagcaccagggacaccgacggccacggcacgcacacgctgtcgacggcggcgggccggttcgtccccggcgccaacctgttcgggtacggcaacggcacggcgaagggcggcgcccctggggcgcacgtcgcggcgtacaaggtgtgctggcgccccgtgaacggcagcgagtgcttcgacgccgacatcatcgcggcgttcgacgcggccatccacgacggcgtggacgtgctctccgtgtcgctcggcggcgcccccgcggggtacctccgcgacggcgtcgccatcgggtcgttccacgcggtcaggcgcggcgtcaccgtggtgtgctccgccgggaactccggccccggcgccggcaccgtgtcgaacaccgcgccgtggctcgtcaccgtcggcgccagcaccatggaccgcgagttcccggcctacctcgtcctcggcaacaacaagaagatcaaagtaaatcgaatcatctctcatcctaccaatcttttttcagtcctgattacatcagaatctcaccgtgtcgcaggggcagagtctctcgccggtgcggctcgccggcggcaagaactacccgctgatcagctccgagcaagccagggcggcgaacgcgacggcgtcacaggcgtaaagacgagcacgaaccaatcctcgagctgaagctgccatggatgatgccatctcatcatctaaatgctgtgtgttcgatgtgtgtgcaggaggctgtgcatggaggggtcgctggagagggggaaggtggaggggaggatcgtggtgtgcatgcgcgggaagaacgcgcgggtggagaagggcgaggcggtgcggcgcgccggcggggcagggctcgtgctggcgaacgacgaggccaccgggaacgagatgatcgccgacgcgcacgtgctcccggccacgcacgtcacctactccgacggcgttgcgctgctcgcctacctcaattccaccaggtgtgtgctcctatttgaattttttattttgaattatactcctatttgaatttaagtcttggtatttttggaaatagtttgacgcagctaccaactggcctattagctcagctggttagagcgtcgtgctaataacgcgaaggtcgcaggttcgagacctgcatgggccaattctttttttttatttttttttcaatatttttgggtacatagtaattttttcttacattcttttgttattatctaaaaaaattcttttgtacattaatttttttagaatatcttaatgttttgccaatctttattagcacagtattttattttttccgtcccaataacgcagatcgccgtcgggcttcatcaccgtgccggacaccgcgctggacacgaagccggcgcctttcatggcggccttctcctcccagggccccaacaccgtcaccactcagatcctcaaggtccaaacctttctcccaaattaatttcgcaacacactgtcactcactcactctcactgtgtccatcgtgtcgagatcgccggcgagcttgacctgtgtgtgtgtttggtgtagccggacatcaccgcgccgggggtgagcatcctggcggcgttcaccggccaggccggaccgacggggctcgccttcgacagccgccgcgtcctcttcaacgccgagtccggcacatccatgtcgtgcccccacgtcgccggcgtcgccggcctcctcaaggccctccaccccgactggagccccgccgccatcaagtccgccatcatgaccaccggtaagcgcccgttgcagaggccagagacgtaaaccatttccattatggccgaagacataaaccatttctattatctatttctgcattgtagaggccgaagatgtaaaccatttcttccgtggagtaatttataaggtgtttgtttggttgcagcgagggtgaaggacaacatgaggaggccgatgagcaactcgtcgttcctccgggcgacgccgttcagctacggcgcagggcacgtccagccggggcgcgccgccgacccgggcctcgtctacgacatgaacgacacggactacctcggcttcctctgcgcgctgggctacaactcgtcggtgatcgccacgttcatggcctccggctccggcgcccagccgccgtacgcctgcccgccggcgcggcggccggaggacctcaactacccgtcgttcgcgctgccgcacctgtcgccgtccggcgccgcgcgcaccgtgacgaggagggtgaggaacgtcggcgccgcgccggcggcgtacgtggcgagcgtcgccgagccccgcggcgtgtcggtggccgtgcggccgagccggctggagttcacggcggccggggaggagctggagttcgccgtcacgttccgggccaagaaagggtcgttcctggccggggagtacgagttcgggcggctggtctggtcggacgccgccgccggcgggaggcaccgcgtcaggagcccgttggtggtgagggtcgtggacaagaaggggaagaatggcttgcccatctcttgatgagttcttgccatgatttttgtaaaatctttttagataagttcttagtttgcgtgtgtttttttttttgggtgggatggtttagcctgaccaaagaaggtttggctagtttggtgaacagacttagaaatgataaactgaaacttacaaatcgcccttctatcacccacatacatgtggattaaaacttttttttagaatattttgctgatagagttagaatagcaattcatgtcatcgaaaacggtgacattaaattggttattcatagtatcgatgacattttttcgcgaagtctaggtggcatttccttccaatcggggtgtaggatttatcagcggtcttaagtgtgtggggttgtttggtttgtaccttagcattggtggtgcgtaacatgtagctaagggtggacaaaaaactcatggctcggataagctcatagtgagcttggttcggattgactcgaacttgtagccttaatgagttgagccacactaggctttcaactcacgaactactcatttaacccgttagcacaagagatcatcatatcttcgtgtacttggttcttcttaactaatatttagtcacttaattacatccaatctatttgtattcaatgacttatttagtagttagtgtttattgttatgtttatatatgataaaatagtaaacttaaaattattagggtttaataagctcactagccgagctagatttttaactcgttaaggttaatgagccgagctgagctagcttgttaagataacgagtttagacgagtcgagctgacttgttatcctctcgattcatggctagttaagtcttttgtgctgcgtaatctgcaattaattacctcatggagggtttgcagaattgcagacggaggagtagaaaagatcgccatttcttccgtgcttttttggccggttaattccacaaacacttgtggggggcattcatggcaacgtcgccgttgcaaagccaaacggacgtgcaaggcaaccaaacccaaacttttcggtggatttcccaccaatccatcggttgtactccaactgctgcttgaccattcgatcgcagaatcgcagcagcagcagcagcagctgtagtaggctagtagcatctgtagacatcagtgcacagcacttaacccagatggattcgcgtaaacgtcactgaatcccaatccggtggggaaagcgcctgttgactaactcgtgatggcgtagttaggagtattatctggttggttaattggtttggttcgtgtgccaagccgaacccacccacatgctccggttgccgtcgccggaagcgggaggaattcggatgaacggacaggcgagcgaccaactccggcgaggcctggccggtcatgtgcgccgcctcgcgattcagcaacgacgagattatgatacaagattatttgcgagtaatcaatcaagatgccccggtttgtcccggagcgcaggcaggcacgccaaccaatcacacatggtggttttttttccccaaagaaatcaaaaaagggacaggaatgggaggaacaagagaccaaccattaatcaatcaatccatggattgcaaccaaaatgcaggtggaaataaaataaaatcaaatccggcgaattcttctttacaaacgattagtactactactactcccggtctcccctactatcccccatggatagatctcgggagggagagaagagaagaggaggaggggctagcagctagtacggcggcggcggcgcgaagaattggtgggcgcggagggagccggcggcggtggaggaggcgtcgtggatgctgctggtgagcttgtggaagccgcgggtgtagacgccgaagccgaagccgatgccgacggcgaccagcaccagcacgatgagcgtgcagatgcagcacgccttgctcgggcagcagcacatctcgccggcggcggagcacgagaaaggcgatgcgcttttgcgtgtttttttttctctttttggtgcgggagcttttgccgggtgggcgtgcgtgcccggggacgcgccgcaccgcgcggctataaagggtggtggctgggttgggggatcgccgagtcgggtgcggacgccggtgtgttgggttgggttgggtggcggtttccgtctcggtcccgtcccgtaggggcgacgcgacccagacgctttggctggcggtggcggcgcttgccttccgttccctgcgatgagaaaaatactactccctcagcttgtgtcgtttaccttttttaagtatgtttaaccggtcatttgtttatttaaaaaatttaaataattattaattctgtttctatcatttaatttattgttaaatattcttttatgtacacatgtagttttacatatttcacaaaaaattttgaataaggtagacgttcaaacatgtttgaaaaattcaacagcttcaaatatttagaaacggagggagtaataatattttatggacgtaacatggtctgcagcctactcgggtccggggaggaaacggctatggcaatgtgaagcagaggcaaggtcgcaaggacgtgattggttgtcagatgtgggccaccaagacgtgattggttgtcaggtgtgggccaccggttgtagatgggttggagcgggacggcgacctaacgtatggccgtattggtcgtccttcttgaaagttgggctggaagtggatcgtgagttaacgggagtgaagcgattggcctggaacagaaaaggaataacgcaaaacctaaactgcatcccttatttcttgctcgtgtttgaatagtcatccataaaaccggatctaacgcctcctccatcttctaaaactggtgcaaggttttctgctgatatgaaaaaaaagtgggacccatgtgtcaccaacctctttctcctcccctcttctctctccctcccccttctggccatggcggctactacacgagcgtactcagcatgacggctccttgcaagacagcaacaagctcggcgagaggacgaagagccatcccacctccctccctacgcggctacgctgcacccgtcagcctcctcccccaccatgttgctactccgcgctcctcctcccgtaacgacaacctccatgccatcaccaccttcgagctcttccattgtcgtccctggtgagcctctctgagctcacactgtcgatggcctccatgtcgtgggggtcgaggtgtcgctgcctcgtcaagctctgcctccgcctcctcaagctgtcccttccccaagcgttgccgcctcctcgagcttccccctccccaagtgccaccgccgcttccccctaactagtggtaccactgcttctccacaacaagaatcgcctcctttgtcgcggtgaaaagaacaagatagagtgaattctcttgggggagatatagggggtggaagaaggagaaggggttggctcctccttcacaacctagcccagccatcgccaccactacctggttcgttgcccagatattactcggggcggcatgatgcggtcggtgactggcagccagatgtagagctcagcagtagtgaaacctcgttgagtcccctaatttcgaggatacgagcgggacactatggctcacactgttgccgccgaggtccatcgactcctctgtccaacgagcaccaatagtaatgatgccagtgagcgtgggcgcgaacaaaggagataggaatagaggcgaagaggacaatgcaccgtcgcagaggggctcgcaggagacgacatggtggacttgaggtgagctcggaggggcttgctgaccacccccgtcatgcctggcttggttggggaaaatagaaaa

SEQ ID NO: 67298 - DNA, 4485 bp, Oryza sativa
  unsure (1)..(4485): unsure at all n locations
tcgtccatgactgccgccacctccacgagcaccgggaccgccatctccacaaactccgccacctctgcctcgtctacgaccgccgccgccaccttcgcaagcgccgccgccggtcctctcagatccgggcgccgccgagtgcctccgcccctagacggcactaacggtgagtacaaatccgtccatcccatcccacctcaatcccttctaccaaacaaaaaactataaccatcccataccataaaccaaacagacaactggaaccatcccatcccacaaaactaggataggtctgacccatcccacttcgtccccaaaccaaacactaccttagcgaattctactccttaccattttactctttcctagagtgacaaatcagggtgcatttttatcatgtttgcaaaccagaaattcttcctacaatgaaatatctgcggttgcataaacagatttacaggattgatccattctgcatgtctttttacaagagagtaaaatttttcagcattttttcatgtctttagatgtcagcattttttagtagtatatagtacaacataacatgatttaccatacaatcaaacaataactgcattgttctctttttattttcctcaacaaacttctaacaatatgaacttctctagatatatgtttgcaatctttagacttatatacaaatatggcctaaaagtaactgattgtagcttatttgaagtaataaaggccagaatgaattccgttacctagaaggagagtaaattttgcaaaactataaaaactttcgatgaaactatattacaaaactattaaattccagcagcggcctaacaaaacaataatgcaccaaattattaggatactacatatgtaaattacgatatcacaaaactatatatttccgcgtaaattcaccataaaacttcaaattcggaggttatagatctcttgcgttattgccaattggatttcaaaatttatgattttgcgatactatgatttataaagttgtagtgtagtttttattactgctccctcggtttcagattataagatgttttgactttagttaaagtcaaactgcttcaaatttaactaaatttatagataaatatagtaatatttatattaccaaattagttttattaaatcaataattaaatatatttttataataaatttatctttggtaaaaaaatattactattttattctaaaaacttggtcaaacttgaagtagtttgactttgaccaaactcaaaaacatcttataacctgaaaaaaaaaagagggagtagttaatttgatgctatataggcatgtaattttacaatatcataccttaaatatgtacatacttaagttttgtgataataattttattattaggaaacactactggagtaatttctgaaatttactctgtttgcgattatttgcaattttattatctcaactcatattcttccttcccctgcaggcaatcctgacctccacgcaggccacatccatcccgggcacccccaccgcgccgccgccgccgcgccgggcctactccatctcctgctcgtcgccgcctctccgccgcgaccccgccgtcccgaagaacatctcccagacgctctacctcgcgctatcctcccgcccagcctgcgcccgcgtccccgagccccagccactcccccctaccaccaccaactcctcctgcccggcctacttccgcttcatccacgaggacctccacccatggcgagccgcgggcgggatcacccgcaggatgctcgagcgcgccagggacacggccaacttccgcctcgtcgtgctccggggccgcgcctacgtcgagcgcatcgcgccggccttccagacccgcgacctcttcaccatctggggcatcctccagctgctccgccggtaccccggccgcgtccccgacctcgacctcatgttcgactgcgtcgactggcccgtcgtccaagccgatcggtaccagggggagaacgccaccgccatgccgccgctcttccggtactgtggcgacgacgagacgctcgacgtcgtcttcccggactggtccttctggggttggttagtctacttctcctggtcttcacatcattgtatttttcttgatggagtgcttgcagattaacattatattctactggttaacattagaatgaatcccaatatcccacaatcaaatcacaggttatttcctatgctgttattgctacgctactgttactagaagtagcacaatgattgtgttcttcatgatagtcaggtccagtaagcataccatcagtgtgcattgtgggaggatgcacatgtttatgtctgctgctgtgtttctgacacagtaaatatatgtgcttgaccattgcagtgcttagattaaagatcattcctaagactgcaccaaaattaagtatgttctttttacgctttcattcggacaaagcaccagagcttaaatagactgtctgtgatgataggccagagatcaacataaagccgtgggatgcactgcagaaggatttggatattggcaataagagggtgaaatgggtggatagagagccttatgcttactggaaagggaatccagatgttgcaactaaaagaaaagagctggttaagtgtaatgtctccagtaagcatgagtggaatgcacgaatttacaaacaggcaagtatttgtgcctatgatttactgtgcctagtcgcacttcaattaagtttaatagtcccctgttctcgcaagtttagtccttcatattccttttaaaagaataattatattttagtatgtgagttatttatcaagaaaacagttatgatgatgtttatgattgattagctattttgcgcatgtttctcatatacaggattggatcaaagagagtaaggcaggatacaaacagtcagatttggctagtcaatgcacacacaggtgtgttttcttttgttaaaaggaatataagagtcattttgctttgttgacagtactgaccattgtgtttggtgacaggtacaagatctacattgaaggatcagcatggtcagtcagtgagaagtacattctagcgtgtaattcaatgacactggttgttacaccaaaatactatgatttcttttcaagggtgctgatgcccactcagcattattggccagttcgagatgacaataagtgcagctccataaagcacgctgttgactggggcaattcaaacaagaaaaaggtatcatcttttatataacatttaaatatcaagcaacaaagttatgtggcactagatatcagttttgatcatgattggctatttctatgagctgaaacacattggtcaacaactattaatttgagctgaaactccatattcacaaactacttcgtgtgatatgctcaccctgatagtgtgggaatcttttgcaagataaaaaatttaaagcttctaatgttctatagaaagtgatgcccttcctttatctatttaatataagcacattgatggagctgtaaataattgcattgtttttctcgtgtatttcatctgaaagttttgtgcaataaccaaagcattgatgaactaatattcaaaactcgaaattatttcttgatgggaagttatcaaccgtagatcttaatccgtgctgacttgtccaatatttagtgaactagaaatttttacttgtcttttcattagtaatgatcatgtttggagtcaaaggttacatttttctataacatagaatattttaccatatcgtcctgtgatagtaatatttatatgaaaagcatactctcatatctcccttctaaaaactgttgaaggcacaaaaaataggaaagcaagcaagcaacttcattcaacaagagcttagtatggactatatatacgattacatgtttcacctgttaactgagtatgctaagctcctacggttcaagcctaccaaaccacctgaagctattgagatctgtccagagttattggcatgccaagctataggccgtgaaaggaagtttatggaggactctatggttaagtctgccaacgatgcaggcccatgtgatctgccacctccattcagccctgaggaattcaaagaattacaacagaggaaagagaagtcaatgaagcaggtggaaacatggcagcaaaaggcttcgcaaacctgaggatagcaagcattgagagttcactgtttttcctttcctaacgacatgcatataaagttttggtcaattatttagggtcaatggtctatacacatattctgtagtggtaataatgaagagtttttcttattcgattgaatcaaatgcataacatctatagaacttacaaatggttgnnattgtgtgnnannaaccccccccccccccccccccctccaaaaacaaaaggaaaaaaaacacccttcatgcttgttaaggaaatttttacttctaactgtcattttttatactttgttt

SEQ ID NO: 67299 - DNA, 1339 bp, Oryza sativa
cttggtgtgtgattagaagctagtccctagatcatctttttctttgtagcgaatatgcaagagatgttctaagtgcatcctacctaaaagtttgcagactttggccctgctatttgaagtttctgatggctgagaagaactaaataaaccaatgcctattgagtgttgacttaaacttcaagaacactgaggatggtgtctcggcagcaccagctcttaccagtcgaactagcaaccaaaaaaaactatcatgacttccgattggcgtcaagcttctggtcatcattagcatgcattatggcatcgtgattaattgcactctgagaaaaatggaaaaaaaatatcattttcagaaacaaaagccgagacaaattatttgtgttagggataagaaataattgcttacatgaatccctgagcatcaaaaagactcttcaaaatgtgagattcttcattcatgccgagatgagctatggtctattttttttccgcattccatgcctggatgagtttggttcagtctcggaggtcgtctgcacatacctgatcttgccgctagtcatttggaaccttggtattcacatcttcagacaactcgctgaaaatattggatgtttcagtcaaacatctactgaaattattggatgatcagtctatatactatcacatctcctctcctaccctatcttaataatgtttgaagacattaagcttctctctctgcttatgaaacggttttcagattattgtgcgcatggagtatgttgtatatggaggagtgttacgaagtaatcgaactatttttgcaattggttcaattatcccatgagtagctatgagttcaacaggggaaaaaaatctaatgttacaaatttcaaaaagccaagcgctagtgtctagcgctgcctccaccgagagacccgactgtgtgcctctatagggcatctttttggcagggggtcgcctgccgtgccccagtaggggatcttttcactgctttttttttttttttgcagctgaaacggtagtgcggatacacgccctaccgctgcccattgcagtcggggtgggtgcctctggggtggcgatggaatggaatcaaatcgagctaataaacaggtcgtgttgtctcagaatcggcgatatggtacaaaactaattgttggatggattcagtcggagccaaagaacagcggcgcagaccgacctaggagtagaggcggaagcatacctgctctccacggaagcccggcggcgaggggcgccatcgatctaagccggtgctgaatattcgcgccgccgatgtaggcatgccacggagactacaccggagatccac

SEQ ID NO: 67300 - DNA, 23997 bp, Oryza sativa
tctgggcctggggctttatctgcaggaataattctaatgagagtatccatttcctgagtgaagaaaggatccacagggttgtccagacaaacatgatcagggaaaagctcattcaaatcaaaccccattgtgggcgaattagagacacccattctttctctaaaacttttatagaacaaagctgctttctgctcatgcagggtgaccacctaaccatcatggtcctggatttgggagattgagttagctctatatatttatgtagcaatggactgaaagaactttgtgttttcttcacccagcaacatccatctattggtgcatctttttttccagtacattttcctgaactctaagagcttaattatgtggcactacacaatctccctgaaactcctctcttgtcagagacctggcctcctcaacaaggtctagaaaatcaactgctcgattgcaatttgcaagcagaacatttagtttagataaatttttgctccagcttaacaaccttttcctaagcattttaagcttaaaagagatgcattttgcagggtcctcaaagtcaggatccaaggcccaagcagaattgactatatcaaaaaagccctccacctctacccaatagttctcaaacctgaaaattggggaccttggaattttagtatcaatcttgaccacatagggcacatggtctaaaatgtttctagtcatgggtagcacagatgtattggggaagttcagtgtccaggaggcagaagtgaaaacccaatccagtctttcaaggagagggttttgttgcatgttactccaagtgtacctcctgcctttaagagggatttcaagaagacctaaggagctgataatatcattgaaaatgaagatgtcattcatatcaactccagccttattcgtgtcctccactgacctgtaaaagttaaaatctcccaagaaaagccaattctgctgactttctatgtgaacattctgcaaccaggcaacaaaatctgctcttgcagggccagtacaagaaccataaacacaggtgagagaccaaggctgtgaggattgtctggaggtgaagtcaacagtaaccgaaaattgattgacctcttttgccacccccatgaacaccttaggcaacaaatcatattgatatgtgttaggattcaaaattcccgaatgaaattttcaaaaaacatttttgtgaatttagcaaaatatatccaaatttgatcacattttgttcaaattttaaattatttttggaagatagaaattgccaaaccgatagattaaacctttatctcggttgtgttatataactactagcgcttatataggtagctaattacaagaagtaaaaacaagataatcggtataggttggtttgctttgtgtaactaactaacgacaaagtcagaccagctaatcacgcatgcatgcactttacctccagtgaagaagttaatccagctaatcacgcatggatgcactttttacaacgagtgaaaacaaggcaatcagtgaagaagtttatcatgcatgcatgctatttaccaccagctaacggaattgaggtatggcgagtgccatatctcgtcataccggaagctccgccactggcacaggccatgcacatcttatatagtgaaagcagcaagctttcttacacgagaatgtgccacatcatcaaaaacatattagccgtcggataaatagttcggataaataatagtcattggatcgaaagagtgcatgtattaaaaaaatcacaaatgggctaaacatatggaaatttccagaggtttcgagtatctattgtcctagcaagtatagatactttgtaaacaaattaacttatatcaaaaccttattaagagctaaggtaaactaatagaccatatataaaagttcttaaacaggaccaaaagttgcgcaaagcgtgactatatggctagttttattgaatatagtggaagaaaattgcattccctaaacaccaagggttaaagaaatccacaagtttgccatgtacagatatagctacgatcaagaagatgttttaccgctgcaagcgtccacatccttgtcttctcctttatatttgcaaaaggccaggtgttgaggtctttttgtgctcgaaggtttttggttccttactttctatatctcccacacgaccaacaggatgagcgtgcacatttctctcttgggcatgccttggtgacttgcgagcattttccaacactcaaacattgatctcggactccattggcttggtgtgacttgttgataaactacaattttgtaactagttcccaaattctcctaatgtatttgtattgaagaacaggtgagaggatgattcatttgcattgtgatagagatgaagtgagtgttgttcggtcaaacacgactaccaggcatgcatctgatgtccacgctctattttgtatcaccagctaagtgaagagcttgcattttgttggcgcctaaggcttccaaatgagggcattgaagtttgtggtaactcagccaagacattgtgctttgtaaacggataaggacgtacattcaccgtggttggttagcttctacggctatgttcttatgtcaaggttcccaacctctactcattcgtttcccgcgcacacacttcccaaactactaaatggtatatttttattttaaaaaaaatctatagaaagatgctgtaaaaatcatactaatacatttttcaagtttttgttaactaatacttaattaagcatgtgctaataagtcgttctgtcttcctagattggttcccatccactggtgacgaacacaaccttatgcatgttggatcacattccataaggctactaggtccaggatggtttgcagatgaggtcttgtatccaggtcttattcttcaagtcttggtgcattgtcctttttttttctttagatgttacattcattggtcgcttatgttgattttggaggctacaacaaagagggttttgtttgtctcgtcacaaggcgtttccatgcccacccatggcttccaagattctacccatttgtgccacaaccatttaagccttagggatttgtaaatttctcgagatcgagcgtcctcaacccttcatttgccataggtaagtgtgttctctttcagtcgatcttgcatttggctccaatgaagtttccggagccaacccatatgaatcgctagcattgcttgccaatcttctccaacgacttcttgttgactgtaagagcagtgattacatctgaggtggtggcatttacatgcacaaatatagttttagacgatatttgtaacggaactctggctacaaggtacaaatgctcacttccctattaagtacttgggcatgccgcttgcgtcgagaaagttgtgcaagccacctttgaatggatggcggggcatctaggaggatggtaaggaaggaacatcgggttagcaggatgcacaacccacgtcaaatcaaagctttccttttttctttgcaaagaaaatgatatcttcaaagaacaagcccacaagagacttgtagtctactaagtctcgtcatgactaatttttttcctaaaaggcgacaattaatcttaaaaaaatgtgttatatatgccaacatcatgtcatatcatgatattcatgaggatgacaacgcaaacggctagctacatgagcgccacgccgtcacgtcaacctaatttagattttcatttttttttttgaattgatcgttgttaaactttgtaaagttatgcatgataaaaacgtcctaccattcggtaagaaaaattacgttgtgaagacaatacttacgtatttgtctttctagcagaccgacagattaatttcctgccaaagtaatagccctcgtgctaatagaagtatagaacttctgtaacttttggggaacttttgggtggtcaaaaaaaatgtgaaagaaagtcgttccaaagaattttagttactgttataactgaactttctaatactgccacttggccagtgactcggcgagaggtacataacacccagtttttttgtaagtattccatgttaatttggacgtcgacagatgcaaaaattattttgatatgacgtagaggaagcaagaccacagagaaattagatttatgtattacaacaaatcaccggcctcgacacaaattatttttcgccgtacttttaagtcgtgctcaacgactggctgcattatatgcacagttactttgggcccattaaattattaaaatgctttaatgtaaaattttgctgctaaaaatgcttagtctattcgttgcatcggtggaaaatgccctcaaaaccagaagataggacggtgatagataatattgatgtcttttctgtgtttgttaccctccatttgtagttctcgatgtcgttttattgagttgtgggacatttgtgtcttgtgccttacgtggaactgcatatgttcctgatgattgcatctgatgatctaataagtcctttggttttggtataagcagagtttcgctgtaaataattactcccttcgtcccactcactatgtcatgtacgtattttaaaatttaatttatatttgatcaatgaatattttattataagttaaatattatttgatgaaaataatatcattgattatcatttaaatttacttttatatgattatgattttgttgctacaaacattgtagtatagtaataaatttaaatttaaagattagttagaagattgtgccaaatttaaatgtatcttagtgagtgggacagagcgagcattgttttacaaatgttaaaaactacttaattctattcaaagagatttgctccggtccagcacaaagtatctcaaagtaccggtaactcacggtaccaaatcgttttcgatcattggatctagctgggcaggatgggcattgttagatccaatgatcagaaacgatttggtacggtgaggtattgatacctcgagatactttttattggaccggagcaaatatcttagagtggcattttccttttcaagcttcagactagtagtatttcacgaaattcctccttttcacataaagttagcgtttcttttataccgaaagcaaacttgaatttctcgggactattcggtggagtagtaccaaaatctccaggatgccctgagagcattacctattccaatctgcaaacagttgtacttcgttccaatctcaaattaaagtccattagtccaagcaattcatcagtacagaatacgagtataacagctctgttgacttccaagttcaacatgctcctcctccatcttgatctggtcctcctatcctgcattgtattgatacctgatcaagaatctatgggctttgctaaattgattgcctctatcccggctgtaccgccgtaccaactaggcaactatgtacaattcaaaaaggaaaaaagaaaagctatatatgcaaccatagaaattggagcatgatattattagtacttaggagtgtatatgaattcagttgttagtgactctaaatgggcagagtttctcccatttttcaaaaaatatcacttctggcattattgtccttgtaaataagtaagctattgtgctcgtgagtaaacgccaattggggggtgtttaggtaggctctgcatgagaaagtcttgaatgtcacgtagtagcggtcagtgtcatagttgttagtagttactgaccaacccagtactaggtacaaaatatgaacataacagatcagcacatgacgcgtctggatcatggagtttatgcacgtctgtctgtcttgagcccctgacttacaagaagagattgcctactggctactgcgataaccctgatttgtctacctttttgtatagtgagcaaaaataatctgatgagtcatgagtttctttcttcaaaaaatatctgatggacttaacattagcacttcttgcccacctttcacgaacactgacgtttcctgaagttgtgcagtggcttcggtttcgttctctcgtatggcccttgatcatagttactctgtcaaagcaagccggatgcgttacaacttgcaacactctgaacacaagaacaagaagtcagatcaaagaagaagaatctgctagtaccatgcatggaccaagctaaaggcatagagaaatgccatgtatgtttagtgtcctagacgattaaggcatcccatcgccacagataacgtagggtcgtcacacaggaagactgtcgccaataattgcatctgtcaatataaaattgctgggatatcatcggaacaagttgtgttaagccgccaaggctcgtgtatcgatcggtttcggagaagatcggaagaatgcatgtctgatttgagttgttgcacttctttcagtataatgcatgtgctcaattgtgtgattgcagtgatgatgtaagatacaagcacgtaactcttgaagtttggcggcttcctactctttgcgaactgcggctatcgatgacaatatgggctggtggtcaggcttgtacctgctgctgcaattagatgcagtaggccggagtaatcaatctgcagttcagtaacagtttgttactgtttacagaagcacgggggaattggaggttcaaatcaaacttgagcagcatcttagttttcgtcccatagggaacttgattaaaccataaaggctgcacaagggcacaattatctttttttaaaaaaacgatccggcactatacatgctaattttattgaatagagcaggactaaaaagttttgtacaaatataaaagaaaaatataaaaaaaaaagtaaaactaagtgataagctccgagagacgttctgctaaagttcaggtcttggtttcctcctccattttttgccacgagcactattgatggattttatgaatgttaaaatccattggtggagaactttttgatgaactgcattggcttattggtcagtacattaaaatcatcggatcaaatttcacactacaaagtggtagctactcaatcaccgtaaaattactcatgattcaacatgaatgtatcttgatcaattttatggtctgagaaggtaaaaaagatgccacatttgtagtacaaaatttgttaacaaaacttacactaaaaatttaatgtatctccctgtacctcccaaagtccataaattttttctatattttggttccgttttgaacttatttcatttacattatttgatggattattaccgtggattatctacttcattgtaggttatattaaatattttagaaaataaacacacaaatagcttaaaacaacctaaataatataatagcagaatttttttaagaaaaatatttttcgaagcgtggagaaaaatccgtttcaataatctaatgaataatcgaaaaaaagggccaccagaacactctgtccttgaattaggacatctaaaacgcaagagtgagaaaaggtcacagaaattgacactacctactaatgcaactgcataccataagttaatgatcacagtcaggaaacgactttagggagaccacatacgtatattttcttagcactagctagcataagcatatctttctgcagagtccaaaacccagtttgctaccctaacaaaatcccctcttgggggaaggattgtatttttaagaagcatggatctgtcttgtgcaatattaattggggtactagtactaaataaactccgtagagaaatgtcaaagaaaaaaaagtattgtgcaatactaaactccatagagaaatgcaacagaaagaaaaaaaaaaggaaatgattgtcaagcaatatgcattcacctactccacgaggtgattaagtttaagaaacagtcagcaaagccagcagcttagcctttcgtcgtttcccctgccctattcagccaaaatgcaaaagaaaatgctcccggctctcaaacttgagagttgagacaatatcaatcaatcaacaactacgcacatttttgcatggtgcattttgcgtccattttatcttgacgtggtcgtgatctcactacgactctagaaggagtacaaaaatacttgctcgttgtttgcatgcgtacacagcgaaagtcccctcctctctttgtagccgacagaagccagccgacattttgttccgtcaggctataccacttgtagtcagtagagtgatgttcagattgtgacagtgaataccaaatactgcacatgtctgtacaagtggcttgcgtgcttgatcgtataagggatttataattatataaatggagaggctaattcaagaaactagcccgtgaaaggacaaaacattacttcatgtattcccaataaaatactccatccgttcaaaaaaaaaaagcaaaccctggatttctgtgtccaactttgactgtccgtcttatatgaaatttttttataattcgtatttttattgttattagatgataaaacatgattaatactttgtgtgtgacttgtctttttaatttttttcataattttttcaaataagatggacggttaaacgtttggcacgaaaccagggtttatcttttttttttttgacggatggagtatgtgttcagtacaacaaaattctctgaacgtcactaaataggtttattttagttcatcccagttcataggctaaatatttgtacgtttcgtagctgtccgtgagcttttaattatgagaccaacatatatgtggtcgtcatgaagtatatctgtgtatacgaagtgttattataccactttgatacagacactctaccgtgcgccagtagttctctgtcaacgccaagcaggggatacatgcaaaacaaacatctggagttcatgtgtccgcttcaaatgctgttgcggtcaaattttattgaactatcaaccttatgtaagatttgattgagttcttgtaaatattttttcaagttttaatgaatagttgagctctctgctttactttaaagaaaaggaccgagttcgggaaagagaaagacctcgcttcactagaagacatatgtccacataaagactaactgaaatgcacaacattaacgctttgacaatattattatacgctaggtccaatcttcaggcatactggtcgcaaatttgtttatttcttgagataagatacgctctgattaatgaagattgcatttttcactggagacagacgagaggtatacttgagtagtggttcttttgttgagagacaaatcatataaaaataatgagcttggttaactagaaatgatatcgtaaaacacagcagtctccaaaagctagtttttttaacgaaaaaaaaagctagttttgtgtactctcgctattggtggatcgcagaagtccacaaccaacccacatttatgtatgtgaactggcaatttcaaaatcagatgataagggaggattcttgcttaattggctgcaggtatcattcttctgaagtcgtttgtaccaaccacaaaattaacaaaaggggttccatcatctcctgattgcaggtgttgctgaaccgagcaaacgaattctctactgcacagttgtacttcgcctcgtcagaaaagattagccacagtacgtccttaaaagccactttgccattataaactagtactaatcatgagctctgtacaatgcgataagatttgttcccatgagcaatcatgcattttgtggcggccactgtatatatgtcccccacaggttaacaggatgggatggaagtggtgccataaagttacgtataacctaattaggacccattcttgaaatcgacaaaagcaagaaataattctaagcattttttcagagaaaagattggtgtgtgtcatgcagatatgcagttcgctggcccggcgaaaaaagatatgcaggtcgctagttcagatagatttgagggcactagtcggtctactttactgtatcaatagctctaaaattcaaagttagtgattacaaaattcaatatatataatcaaccattccaacatactacttttgatttctgttttcttaaatttaatattcgaaaaatttataaaataatagatacaaagttattatactcctacttgtcatatggccttcattttagtttttcttaattaaataatataattctgaacttggaattaatcattacaaagttgtcctcggtacggactatatcagtttatagtatttgactattgccagatttatttgctactcctattagcatgagatttttctccaagtatcaatttagtgtgcgtgtgtgtgtataatgggaaaagaagtgcacttgaactatttgctcaatcctgtatgtaccttttgttacaaatttctcttttgtagcagttaatgtttgaagaatggtcaactgtagtccttcattggtacatgagaaaaaagaaatactttaccgtgtaaagtccactgaagaaattttcgatgaaaaccgactttttcttaatcctttatgtctccgactacttgaaaatgtggataaacattatagttgtattaatgttcatacgagtaggatacgtagatacctgtctacacttctactgtgtttttttttaaaaaaataagtttacagtctttatgccttggactacttagaaatatgaatgaatattatagttgtattgttcatacgagtaggatatgcctgtacatgtttataatggtatgtgcgtatgtacgagcgtgtgttaatctgtaccgtgctttaaaaggagaaaaaaaaaacataagctgtcctacgagtcctcctgaccatgacaatttgtcactagcatccgaggaggaaaatctcctcaccgttgctagagacttgggacgatgcggggaatcttccttggaaagaggtgcgagagaactagagaagggcgttatcaagatgcagggaaatcctccattcctcccatcaaatgcaaagaacaaatgaagtggcgggaccgcgctcccctgctgacagtgcactcggcagcctacaacagcagcagcatggcatccccttttttctctcgtagcgccatgcatgcacgatcagcacctacgcccccgcaatattattatatggctgtcacgatcccacccctttgatgagaggcccatgcatatgcacggttacatcacggtgcacacgaacgacgcacccctctcgtcctcactgtccctagctcttttaaatttctttatggttccttctcttctagtactcgtgaccttctcgcagctctccacacggatgcatatgcttcacccctctctgtacattcacaccttctgtcggtgtgtcgattttaacctgaatcatctgggcactatcacactactagtagtttattcagctgttagtatgttactgcacgacgtgcacatctgtacttgttcaggctcctgttgcaaacgcacaagtcccactcacatcgaacagtccatacagttttctttgtgtgggggagagcatgaaggggaggatcccccacgatttcaccggggcctagtgctcctcttcccgattcggccaactgggcagctcccatccctgcaggtggccacgtacaccgtatccctgatttcctatgcgtgtccgctggccaccgaaacagataagcttatttcctactcctagctagcttagctatctcctggcaggctggcaccaccaccagctcccggctcctgacaaaccgaaccatccaacacgtacacgtacacgcgcgtgcgtcgtcgctgcaggcgacaccgggcgagtgatggcaacgtccggacgtcgggtcgtaacctgtgcatgccatgccaaccatcctggggatggaccggatccactgctcacgtcgacgcgacgtagcgtttccaattgaccgcggcggcgtcggtggggcgacgacgagaacgtaccagcgcgcgcgcgcgcgtcgcgcgggaggaaacgagacgagaggtcgatcgctagcgcccgcacgcggcacggggtgaaacgctggggaggccacgttttttttttcttttttggccccgttctcgtgcggttttgcgccgtcgggtaagcggttaaaatccccacacctaatcaaacgcgggctcgatccgtagccgggggagatgtggtgctcctcctgctcatcatcatatggcaatcttggcggattgattagcaggggggagggggcagcacaaaagcgtggcgttggttccgggtccaacggccccgaatctgaaactctgaaactttcaacaacggcgatcgatgatgagtatcatcggccagtatggctgattgattacagggtctgcgtggctgcaattcgatttcgtttccatcttttggactttctgtactcgcgcggcgttgaatggatagaggggacgggacagggtgtgagcccctgtgttggttcctgctgtgcctgtgctctgctacatcattcttcgcttctgccacaagtcacaaggcctcctttttctcctatatatggagaaaaaagcgcaaataaatattttccgctttttagactctgctgcgctttgggataaaaacaagtgaggaaaatatgcaaaagaaggaagagttaattaattaatcaacgctacgtatatgcgcgccgtgttacgtatctcttgctgactttataggtaggagtactgatttttcctttttaccgctgatgatagtatatacaaacgatgttacttaccaagtgacaagacgtggacgtgttgctcacaatagtttgaaaaataagtaaagaaactaataatgcgtttttagacgggccgcgagaggccagcaaggcgaagagaaaaacggtgccgtttggtagtctttaagctggctacgtcatcgcacaatttgatcgttttgcccccaccacggggactcggggagaagagccaagccatctctgcagctggcttcgatgattttatgaagtgcgtagtacgaagtttacatgcacggcttgactttctttacgacctctctctcacatctcacctcgtgaccaagctggatatagcaggaacagtgccatgcgcccatgcttgcccgtgagaaaaaaaaggggagaagttaagtaaggtgagaaaaaaaaaagtttaaccaggattcgactggatacgcctttgcgtatttatttgcgaaaaaagagaagaagagagtgagaggaaaaccaaacacttcttttattaatcaccaccgttcacgtcgcctataaaactcgtacctacctgtctcctccctgttgaaacggcacaaagctccatccgttctgaaggctttgtggccgagttctcctcccccacctcctcctcctcctcctcctctgtagccgagctgaggccaacgcgagtagtgacattctcctgcaatggggtgcaagtcgtgcgagaagcccaggccgaactaccggaagggcctgtggtcaccggaggaggaccagaagctccgcgactacattctccgccatggccacggctgctggagcgcgctccctgcgaatgccggtaagaccaatcgccgcccgccgatgccgccgacgcgtaattcactacccctgccggccgccgcatgcagcatttgcgctccccaagcataattcgcgagctctaggcgcattgcaccgacaattatgcaccgaggcacacacacaaaatcggtgaattcgcgtagcctggttgcatgcggttctctttgctgaatttctcttgccgacccgtctgaattatgaaccaaaccgttctctgaacaaacaagactctgtttcttagccaattcgtgattaaatgtgcattgtgtgttgctgcttgagagctggtctcacaagaatttgtccggcgatcggtgcagggctccagaggaacgggaagagctgccggctgcggtggatcaactacctgcggccggggctgaagcacggcgtgttctcgccggaggaggaggagacggtgatgagcctccacgccgcgctcggcaacaagtaagcttttctaactagcaactcccccgacgagtctcgtcccagtcgggtccgtgcccagtccccacacacctcaccggcagcgcgcactcgatcgttcgcctttacacgcaaaatgattgagcccggagacaattctccacgttgtgcttgctagctgctgctgctgatgctgccttttcctttttcagtttagtactaatctctctctccacacttaattaagctacctagtgtagtactagtactactactactagactagactattagtaccaacgcaacagcggcactaatctttttcgtgagaaagctagttactctagctgatttgtcccagtccgggcgcgctagtgccgagctggcaattcgggttctagaacgcgctgattgacagattgtgagtgacagagtgagtgaaaggagaggaggagcggagcggaggagcggagaaatcaaaatatgaaatggtggaaagggagaattaaccggggtgatgctggctggccgccaccgcgaccttttccgtagtggagctgatgctgacgcgcacacgctccaagaacgctcctgcgcattcgaaaaccgcgagatttttcggtgcacgttgcgatgatggctagagaaaccgttgtgtgttttttttttcccctttcttcctttcgcgctagtacatttgtttattgtaaagtgcgggccactctggctgagcatgagcaacaaggacaagttgaggggggacggctaggataatgtggacttgcaacgctaaatgccacacagtacagttgcgtgcgtcccagaacaagttagctcgaattaattttttttttggggggggtctatttcttcgatttttctatcttttttgtacaggaaaaacggacactattcattttagttgtacagcgacgacgataacatgtcgtcgactggttggaccaatccgttctcagttgcgagttaatgaaaacagctgccttcacaatgcgaaactgtcacgtaggagtactagtctcgcgagaagattagattctttattgggcgtcgcaattatgtgcttccttacaaaaataaaatatcaaaggattagtggtccacatgaatagactacgtacacgcttgtccctttcaccccacaagtgacacattacatttctttaagctggtgacagaggaaaaggaaacgagaaattggaaagaaacctcaacttgtcaatgcaaaagctttgggttttccactaacccccaccgacagaaaccaagattagtgaattttaagctgtggcatactactaaccgtaaggcagagagagactgatcgatagatcattccaaaaggataaaaataacctgacttaatcactgacagcaatttttctactgcaggtggtctaggatagcacggcatctacctgggagaacagacaacgaggtgaagaactactggaattcttacctgaagaagcgagtggagagcggcggcggcaagacgagccaagggccaccaaccacgcctgcgtcagccgcgagctctcccgccgattcagacgactcgcacagcctgcagcagaagccgcacgagccggccaactccgactcgtcggagccggcgcacgagtcgtcgtcggcgtcggccgactcgagctgcctgacggtgaccacggaccacccgcccgtctcgaggccccacgcggcagtgacacccaaggtcatgttcgcggactggctcgacatggagtacatctgtgggcaggtcgcggcagcacctggtctggacgctgccggattcgcggtggttggtggtgctgcaggcgatcagcagcagcagcagcagcaggtgatgagccaggacggatcggttcatcaggccgatgggccatcgtgcggcgtggacgattcttccctgcagcagcagcagcaggaggggttcggtggcaacggcggctgctgggattttcaggagcagttcgacagcatcgaccagatgcaggcgagcggcggcggcggcggcttctgcgacctgctctccatgagcgacttcgacctctgggccgagctggaacgtaccgcgtgatgggggaacgacgtgctcaaggatcgatttttaattagagcttgttaattcatagatgtcccgtggaaatcaaattaaggggtgtttgtaatactactgcattgtaaattatcgcggtgtatttatagagctgtttaaattagcaacatatataaggaagatcagaggcatgataagtcacttctgtacgaatttatgtttgccactttgctttggagagcatgggcaccgacagaaagatggaaaggaagaaggaaagctgtagagaattgcgcctatggatgcaattattttggtttgtttattgttgacattatctttgtgcttatagtgatagcattatggaacaatctattcatatctcactttcaaagacccgctgtgaagttccaagttttgttccactccatgaactgtcagtgtatcagaggtcccttcctttacacgtaggctttcatttccacataactcgtaatgattaaaagtgttcttgtaaatattggatcaatttcaactagtgttaagaaattgcaccctcttttataaagaccaatctgttagtgcctccactttcttcccttttcttcctgcagaactttaattttatttctttttcttccattcatctctttaaatgtacatatattagtagaagctcccacttaataaacgtcatagggttcatttgttttaaggaaacaaatcctataatattattgtccccatgacgtggttaatggcatgtgagacccattccccatgggcccacttatcagctaccacgtccctactactctatgttatattttgcattactcactcctaagttgtcttttttttggacggagggagtatatttttatgtttgactagaatatcatcgttacattttttttattacatactccctcgttccagaatataacaactttgagcactcaacatttgtcccaaaatataacaacttctccccagcaatctcgttccaaccaatcataaccctctaccattcacttttcccacctaccttcactacttaaccaatcataactgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggtcccacctaccttcactacttaaccaatcataactgtaacgtcccgccttcccccaggccgggcccgcttacatctgatagctttcataggtcatacactcgtgtgcacccgagaagtgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggtcccacctaccttcactacttaaccaatcataactgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggaacgtcctctcttggccacgtccatgtgtccagtgccagcgcatgcgccatgctgtgtaaccactcccggtctacaccagccatgcgcaccatgccatgtcttttctgcacactttgtcctcactcgtgtgcacccgggaagaatttcccggtcggtcacctatcccaaattgctccaggccaagcacgcttaaccctggagttgtttggagattggcttccggaaaagaagttgcaacttgttgatatgagtattctattaatcctattaagccttaggtcgggatgttacaataaccctccattattcacttctatctattttcttaataaccgtgttcaactctaaaaatgcttatattctagcacggaggtaatactttttatttctaattttccaacagtgtaacaaaaaacaatattaccatatttcaacttaaaaaatttaatctttcggttggatctcccatcaatgtggagtttcagctttattctatactgtaccttcggttgtatggtatactatggttatgcatcatcccgtatacgtgacgtagaagataggaatagacatagagcattatttaagaaggataaagctttcttcaatttaaaccaaaagaaaattgatcgtaaagaggaaaagtaaatggcaaatatatcaatagtcatttcttctttcatgttcttctaaatggctataaaagcatctcctttgttgatcaaacaatgttagagatggagttcaggttcgagttcccttaataacaacggaaaatacttgttttacaaattagacttgacttatcgagccaggaaattcctatgcatatgcaacatcttgtgatgtctcacgtctctctttgcttgccaaggtctaagtgagtgaagatcaagcacacccttaataacaaaagagagaagttatgtttcaactaaatatataaaacatagctcgcccaaagtttagcatctctaaagcagattatttccgacttccatcctctgttaagagggaatccacaaatgccccatagatcatacgcagactctaatttgactaatttgaataataattcaaaactattttaaagagacagtgattacgagacattcatgctagtatgttgccattcaaaccttccaaataacaacggtaagctatggatttttttagaactacggtaagctatgttgatatactctttatgcttagggtgtagtcacatacatgttcttttttaccccaattaaatatcatcttttggcacctaaaattctattttcatattatttgtcgtagttacacttaataataacaattaaaacactacaacaaccatttacgatatatctatattaattatttagtcattatatttctatgctcctgctaatagattaagggttaaacttgatagatggaataccaatcacaagtagattaaaaaaaaagtaaaagggtctcattgtttgccttatgtttataagccaaagtttaattttgaatatgattttttgttttcttcatcatagtttattttacatcatttgtttttgagttgctatggacatgtatataaaattttactcataaataatttttatttgctaacaactgtggagattatgggtaccctatacccacacggcatggttatccgactagttataggggataacttatatctatagaatatgtaacagattatgacttgggtattacgtttccttgtatattacggaacggcctaaagtcctggtttgataagattgtaaagtagatttaggaaaccgataccatattggttaaggtttctatcttgtaatcctgccccccgtcctatataaagtgggcaggaggccctctagggggcatatgagcacatatgatcgttagatctaaactacatctggcggattcaaatcctcaaacaggagtagggtattacctctcattgagagagcctgaacttgtctaaatctttgtctccgcatccatccacttttaggtctcgtgcgctaccccttttattattgccgaattcatgtttcgacaacaacatatttggagtctaatcggtagtgcttactgcagcagcgcagccgcagccaaccagcccaaatctacacaaaacagttgatttgcagcaacatcaacaaggtgtgtgctacttgttggctgctgctgcactgtggcagccagcacaaactcaatgccttagataataagggagtgtttgaagagaaggggattgaggagattgggaagatacgcaaaacgaggtgagccattagctcatgattaattgagtattaactattttaaattttaaaaatggattaatatgattttttaaagcaactttcctatagaaattttttgcaaaaaacgcaccgtttagtagtttgaaaagcgtgcgcgcggaaaacgagagccaatctcccctatcacccctaaacgaacgatgcctaagtactttgagtaagcgaaacaatggaactggaagattgttttgaatttaaaaatacacataaaaaagtttgaaaagaagaccctgatttatcagcaattgagcatctcggcaaggttctcgccgctcggcgtcccggcccagccttttactcgtgggcataaaatagacagggccgatatcgtaatttcctccttcacaaatcccaaaccgccggtgccctagctatcgacgactcggcggcgacgcgcctccctggctccctcccgtcgctcctcctccccgacccacgaactccccccaatagggcagaaaggaagttcaaatttgctcctgatccgagcgccaaacgcctagattccaccacccaagcctcctctcccaatccgatctgccgttccctcttcgaatcggctcccccttctcgccgattaccgacgaatccgaggccctcctcctccttcgaatccatggatccgcgcgccaggtaccctcccggcatcggcaacggccgcggcgggaaccccaactactacaaccgcggcccgccgctgcagcagcagcacaaccaccaccagcagcagcagacgtcggcgccgcaccaccagcagtacgtgcagcgccagccgcagcagcatcaccaccacaaccaccaccagcagcatcagcaacagcagcagcagtggctgcggcggaatcagatcgcccgcgaggccgcgggaaccgacaggaatagcgagccgaaggctgtggcgcaatccccagccgtcgacggcatcgattcgaggtgagaccgtgagacgcgtaggccttagagtttggcgatagattatgtgatgttcaacttcaagggatgaattaaggaccagtgttgtgggtggcttgtttgtttaatttttttgtggcgaaattggaccaaatgcagtttgagacatatgctttccctgcagcatcctgcgaagtgagcactgcaatttcgtattccgtagtggcaatcactgaatgttttttgtccaaatatgtgttcatatgttgcctaggctggtactggaactagggtttgctgcattctaggtttgtaatttgtgaaactagaagttctacaaacagtaggtaggctggtgaataatatatctgatcattggcgcagatatggttatcacattgatcatatgctcaccttttgtgcagttcacaagactggaaggcccaattgaagcttccacctcaagatacacgatacaggacagaggtaaatcgcatttataaaattttcccctattttttcttcaaagccaggcaaccggtgctttgtatgctaaggattacacttgacaattgtaattgcaaaacatgttgactgtcatctgcgctttgccctacctatcaattgttattctgccaaacaattcagtgtggcaggagttcctttacctttatgattttttggtgtcgcacattgtaagctaattactatctccagtcacaaatacatgtcttgaaaattgacatggccttccaaatacagctttgacactaatttctaatttaatgtattaatagaacccactaaagttataatgttatgaaaaatcacctttcaagacaaatttacatatattatgttcatgtatccaatctaaatattgtaaatggtcttgaaagttttactaaatgcttgtccaaaacaagaattatttgtgacccaagggattattaattccgatgattgaaatttaatttgctaaactgggtttgaacatcttttcacacccatgagatatcctaatgttgctaatcgatgctctttatttctgttatccaattcaaacaaacaaagtttaatcctatgtggtcattgtaatatcatgttgataccttcttgtctaaaacaaaataataccttgatgacttaaaacatgcacattaagtgttgttaagctggaatgccccaagctccttactatcctggaggccacatgactcagttaaataattaaagtttcatcttactgagttactgtgctcttatatgttttcccttgtgctctttaatcttatttgtataattttatctttgtatagttcttccccactgtcttgattgaaagaataattgaattttcaaaagaatgtgctctcatggcttgagtttgctctggatatcgacattcttattttcttgctcttattttttttgcctattcttttattttatttggagatattatttatgagtttatatgatgttggtgtcatactctctgcatactttattatattctgctgttgttgcacaggatgttacagccaccaaaggaaatgagtttgaagactattttctcaagcgtgaacttctgatgggaatatatgagaaaggatttgaaagaccctctccgatccaagaagaaagcattcctattgcattaactggtagtgatattctagccagagcaaaaaatggaactggcaagactgctgcattttgtatccctgcactagaaaagattgatcaagagaaaaacgctattcaaggtttgttccagaatccaaactattaaacttattttgtaccaactctcacagtcaaacatgctataaacctgtgcctttataatgcctgttggacctcctttggtaccgtttattttatattattactttttttggggtgttggggggggggtggcctgtaggggatcttctttagtaaatataatattatattgtgcaagaatggttcaatgattgctcttgttatttgtagttgttatattggttcccacaagggagctggctttgcaaacgtcacaagtttgtaaagagcttgggaaacatctgaagatccaggtcatggtcaccactggaggaaccagcctgaaagatgatatcattcgtctctatcaacctgtccatttacttgttggaacgcctgggcgtattttggaccttacaaagaaaggtatctgcattttgaaggactgctctatgcttatcatggatgaggtaattcatctattctttgcaattgatattatattctcatgaaaactgttcagcagttcagtactcagtgccttcccagttgtatatgttatttcatggctcaaaagattattttataaggagaaattagggattgggctaaaaagaatagtaaaaatctcatttacaatcaaacaattagtgacaaaaaaaattagtgtttctatatacttaatgcaagtattttttttagttgctctttcctaagtttttccttcaaattaatgtttgcatccttcttgggttgtgctgaaccaatgaaccccgtttcttgtgtttacaactgattattctgcttgccaatacccatatgctgaattcttgttattacactatcccttgtttgtacttctttccagatatgtttgtctttagtaaatttcacgaaagcccaggttttcaggcatctgtaatgcaaaacccattgtattttaatttgttttaatgaaccccagattttgggaaacacttgactacctattgca

SEQ ID NO: 67301 - DNA, 950 bp, Oryza sativa
ggaagtctgcagtgggatcaaaccagagcttgtaccgcttctctctgccaccttttcctctggcatacaggttagtgtgcagggtgtacggctccgcagtggagttccccaaaaactcaaggtcaatctcgtcgtggaattgccataggccctctgttatcatctgttcaagatcgcaacacaagagaatggttagtctaaaagatctgcaagtgacaccaatgctaatacagtaatctgttcattccctggccacttacataaagagtagtcacggttccagctgagtctccagcaacgagcttgatgtccatgtcgatcctactgaagaggtatgtgctcttcgaccggaatgcggaggtcgtccagcggtcaagagtcagtgagatagtctgtttgccggagttgtcatagaacacctttgagtttccccacagtatgtcgaggtcattggtgaggtcgccagtgaccatggagattgctaggatgaggtagaaagcccacagggaggctaggaggtgagccctagcctgccccatggcttttggtggtatgggagagtgagcagagtgagtgggtgtgctgtgtctcaaatggtgtgccctttatagactgaggtgaagggagacttggttgtgcgagcgcgtctaaacaactaaacaatatctagcttgccagtgactttgattcttggaagatgtaagaaactgaagagaatcgtctggctgctgaataagttgtgtaaaaaatggtgatgaaagtggcttccattaaagccagaatggtgatcaagttgactaactggttctagggttcgatcttggctccaaatctgcgagccgtcccacggggtcttctgacaagctaaggtggttctcaagcaagttgctgaaggcttatgttatgatgacaaaagagttttaggatccctttggccattgtggtgcaat

SEQ ID NO: 67302 - DNA, 66512 bp, Oryza sativa
ctttttcagttgaaatcatttagtatttgaaaatgttgtttaacgttgtcatatttttaaattcaaattcaaacggttaaaaaaatattatatataaaatgaccaaaataaaagttataggtattgatgagttattcaactttgttgttgatgactttttcagttgaagtcgttcactaacaaaaaattctatttgaatttctcaaactttgaatttcaaatttcaaattgtttaaatagagtcagatggagaaatgaccaaaataaaaattttgcatctcgatgagctctacaactttggttttggtgacttttccatttgaaatcatttattaaccctaatttttcttcgaagttgtcaaattttgaaaattcaaaatttgaattgttcaaataaacttatttgtacaaatgaccgatacaatagttgtagatctcgatgagttatacaattttgttgtttatgatttttgatggttgtgtatgtgaatgaatgtatatgaatgggggatgttggggtgtgacatatcccggcctagggcttaataggattaatagagctactcttctggaagccgatctctaaataactttgatattaagcgtgcttggcctggaacaatttcaggataggtgaccgatcgggaagtgaacttcgtgcacacgagtaaggaaaaaaaaatgattggcatgagaggggcggggatggcatggcaaggctagccaaaaataaaatttattttttttaggattatactcatcagtgacgagcattaacttaggcccgattgagatgactcatctgtgacgggctatagttaatgctcacggtgacgggctatagtttaggcccgattgagataggtcatccgtgacgggttatagtttgacatgtcgtctgggtcaaagctatcagtgacgggctttaattagggcccgattaagataggttcatccgggacggcatggcaaggctagccaaaaataaaatttattttttttaggattatactcatcagtgacgagcattaacttagacccgattgagatgactcatctgtgacgggctatagttaatgcccatcacagataagggtcatctgtgacgggctatagtttaggtccgattgagataggtcattcgtgacgggctatagtttgacatgtcgtctgggtcaaagctatcagtgacgggttttaattaggatccgattaagataggttcatccgtgacggccgtttgcccgattgagataacttttcacatcagtgacttctaacctgtgacggacgccgtgcccgattgagatggaggttgccgcccgattgagctgatggtattcgttctagtgtgtactgattttcaaaagtacaaataattttatgcctttaaacacagcacaacgtcacccaaaaccactacaaatctagtgaaaatataaaaggtgaatggtatggaacgttcaatataatgatgagtattgtgcagttttgaagtttaggaaaggctgctaacaacggaatatcatagacggctcaaaagatgagcttaaaatggactcctgacaactaactaaagatgcggtaacaaaaatagcatacatgcccacaaaaatacgcaaccaataacttctaacccatgtgtccacaggtaattaattaaattgtctggctatagtattcaaaattcagctgcacattcgaaagaaatactatatgcttaggataggaggaacagtttatgacagatattttactgttccatatccctatataagaaaaaaaacaatcgacataagatattgcaaggaaatgtcttatgttgtctttttttttaaagtatctatgttttaaaatataagacacattttgttttgttagggcaagctttgagcaacacatttatgtgatccaaaagcataatcatatataagtaagtatttttgaatatgaatttaataaatttaattttgacctaatatagtaattgctagccaaagccttatcctaatgaaacaaaatatggcttatattttgagatggaggggtaaaaagcatggctacatatgtacatacaaattttcaaactaaaaagtaatctgtgctcacatagtcacataaatgaataagaaagttgtgttaaataacatatgaaagaaagagaggtatttttcgtcaaatcatagacaaaaatgtcatctttgaatcttttgcacaaagaaaagtctgaaagctaggctctgagctgaccaacaacacgaatgtgcgataaaacacgtgatgttccttgcaaatggtccagacatcccaacaaatatggtctccatcaaccaatcatcgtcgtactaattaaagtaatagagagaggaattttgtagcatatgcttttgcctaatagctagtgagtagaaacattaattcagaggatatgtgttgcatttgtataaatagtagaaacagtgagaggactatttgtagcgttcgcataaaaagtagaaacaatgagaggaatctttgaatcattcaaaaagtagaaacagtgagagggatctttgcatcattcgtataaaaagtagaagccgaaagatcatccacaaaaccaagtaattaaggtaggacctaaatatattgttctttactcagttagaccagacaatctcatagtagaaattttgtgttgatggaaaacatacaacaccactagggtagattcaacacatatttttgttcatagtcaacttttatattagttgagctcccagcaaccaaaaagccacatagaaaaagaaaatagtcccagcaggacgaggcgtgcaagctgggagtggcggcggtggatacacaggttattggtgctgcagtggttgtggagtatcgcggacgatagccttgatgagtgtgcatggatcaccaatctgtgttccttgccaaatgaccaatgtgagtctccaaaatgagcttctggtgtttaaagaggggactaatgcacatttgcatgggtacaaatccctaagttggccccaatttgtataggaccgagtttcctttacaggaccggtttgactgatgatgtggggccagtctgatcacggtttgttggcctgtcagaccggagtcctagtccaagtcgaatttcgtcggttctcaggttttcttgcttggggaggaatttttcaagttttaattggtctctatcccgagttagtcatggaggaggtgttgtagaaggcaagaccaatccctttataagggccaaggccggttaaattgagcatgttaacctaaaactcaagaagcttgttggcatgttttagcttcagattcggcaccatgcgctacctcccacttggttttccctatgctcgtccacctctagcagtaccatcatgttgcctcttagaaatcggaatagtctgatgaggatatgaccatggctactttatgtattcattaattaaaggtgcatattttctctgtgagatttatgtgttatatatttgaacaagcgttactacactatgagttttgtgtcttctcatttacagaggttcttggttgggtgaagggaaagagaccaaacacaagcaatgcatggattatcaaataagttgattaggtactgttgacgcgaaaaatacacactggcctgggagatctgcttagctccagtgaaggaccaaaggttgatgagatgcggacatgccagccagtttaatcctacaactgacaagatatacaaatagcagatcaatgagtcgatcggctgacaaactgattgagtaattccggccgatgccgatgtcagccgatagcgatagggttttgagcaatcggctatatatccaatgtagattctgacacttgatgtaaataacaatataaaggtgatcggccgataataatataatatagcaataatgtagtccaatagaaaccatttggctaataataatatgataaataagcatcgatccgaaggttaaagcatacatcggctggaggttcgatgtcattaaattctcaagattagataaacagtaaaatctttgttatgatcgactaaatctaatatgtatgcaatccttgtaagccgatgcaacatatctagataactcatcggctgaaaccccgatgaaacccttattggcagtcaaaaagtaggctagggattatggttctaaacacgacttggtagattaaacttaactgatgttgcactaagtatgaaaaaaaacataatatctagacaatcaagcccttgactgatttttagggtggtagatgcattagctaatctaatctagtaaaacaatttatccggtaccggcaggaaccctaaagcgagaaacaaccgatagaactaaattgagatattaagactagattaactaaaatatatgataaatagatagacaaatatctcatccaaaccggaatagtctaagaggtcgaatatactgatgcagccttgaacgacgctgacatagacgagacaattgcctgggccagcggaacgtaggacttaccccttcgccggagatcgaaagtcgatgcagccccgcatcaggtgccaagttccaccgaatagtaagtaaaaacttcggtaaagagggtgacgatgggccgagagtagttgtattgatcgagagatagtttacaatgaccccgggtatacatatttatacccatggggagatactagtccttgtaggacaagaaagaaactttcctaaaagataaaaggaaaacataaagtgcttatgggacactaaacacactttcctaaaagataaaaggaaactaacaaactatttctaattaatagataacttgccatgccgcatcctccttaaactcggtcacttctggataagtttcctttaatagattaatttccttaaccgaatatagcaggaatccgactattggcgacgtgataattctcttaggggcttaccaaatttcactgttaacaggtaccaaaccaatacattttccaagtctattccaacattagcatattacttttggtccatagaatgcaagaggttttatacgttttggattcggatttggcttcctaacaacatcaacttcaaacggaccttaccgccaatctagacaaaatagtacctattgcaaagcttatggagtctacattcagatgattttgatcccacatcaaaattctgaataagttgtcaggaatctgcaaaacaagccacataactcatccaatccgagtctgatttgggccttcggtcttataattgtatcgtggctaagctcaagggatggaaatcctaggctaaccctatgataaccctagtcatatatattcagttgttgtcatagtttcgagttggttttgcttagattatttctgttattacagtttcgccgttactttggtttgtggaactccaacaaatgcaatagtgttgcaattattcttgcttgtgttctttgatttgcatgtggagattagccttctcggcgagatcaattgggcagtgcacagttgataaccataggagacatggtgttgcaattgtagggtttggatcgtgttgatcggaagtcggaccatgtgtgccaagcttccgctgaatcgagtgttatcaatacctatcggatgattgggacctagtttctcatcacggtacagttttggagttagataacctgatgaggacatcattggctcggatataaccatgcttattttacacatcaacaagttaatggtacatatgtgctctattagatttacttaattaatatatgtttgaacaaacgttactgtaccataagtttttgtatattcttatttgcagaaatacttgcgtggatgaaggaaagaagtacgggctcatgaagtactttaaagatcaaagaatttgactagggacataaccaagaccttctccaagtctattcctaaatcaccactttactttcggtccatagaaggcaagagatgaagttttacaccttctgaattcggatcccgtcctcctgacaacatcaacttgagaaggacctagccactaatctagaagcaatctcggagcctataagtacttgttggaaaattatggagtctactttcagatggttttaatcttacgtcaaaattcataccgagctatcggtaatctgcgaaacaagtcacatacctgatccagtctaagactaatttaagccttgtaattgtgtcgtgggctaagctcaagaggttggcgccctagggcaaccctagcatggcctaatgatatttatttagttgccatcatagtttagacgaggttttgattagattattctaccaattgcagtttcgctgcaaagttcggtttgtaaaactccaaattcgagtgattcatcattcatatgcaattgagttacaatctaccttgttcttgcttatgctcttcgattcgcatgcagggattaacgttcttggtgaggccagccaggttgtgcacagttgatacccagaggaaatgtggtgcttcaattgcagggttcggatcgtgttgatcggaagccatatcgtgtgtgtatcaagtttccgccaaatcgagagttatcaatactatcgaaagattaggacctagttctcatcaattggtatcagagcaccagattgcccgttaggtataccttgtctcttctaatcactggttgcttctctccacttgtaaacactcaaaagtagtattatctaatttgaagcttccggtctcaaggccggaagtgctctttcaacgttttcctagatcgcatagtgcgcaatgtatatgtatacagtaccggttgaaagacaaaaaaaaaagattatcttagtatcctataaaacacacactacggctgctcttggtgataaaaaccaaagtacatctcattaataacaacatattattattgaaatggtaggaacttatcgatttgtgaacctagagtagctaagaaggtactccctccgtaaaaaaaaaaaaacccaaccctagatttgactatgtccagattgaaactcaagattggtttttttttttttttttttttggggtggggggggggagagggagagtagaactgtactccttactctttaccaaagttagatggctgaaatcaagccttctcgggagaaaaaaatgtggatgtgtataagttttggtaacaattttgtgaaaaataatctatgtagctttctggctagaactatatcagcaacgttgtacgatggagaatgacatatagaatggatgttttcagccggtaacgatcaagataaagatatagctacaggttcctggatttagctagcgctgattgcaagtgatttgtagggtccaggctagttcagtcatgggttttatgtcgatcgtcagacttatcttcatagttcgacacgacttttctttggctgcagtgcaatgtcctagctagcttccaaaatacacatttcgattgagaagcagagatccatctgcaactagcatcacacttaatttgtacttttatatatcctcaatttatataaaaaagttaataagttgaaagggccgtggtttagagacgtagatttgtatgctaatccaaaaatatccaactttcatatggtagcgtaatttcatcaacacacaaccataaaccacggaattaagcatctattattaggctaagggtatttaccatggagaaattcctctctttttgattatcatttacgagcacatttattcatcgataggtaccccttctcattcaatagcctaaacatttgaattagacacatatatatataggcatagtaagttgcgcagtgcgagtatattaaccttttaggattttttgtcttgtttattttgttgcttcttataggtttgcacatcatagagaggctatataattaaatgcagatcaatatataccagataaacagatggtccacaattagggatatatatctatatggacatgagagtggacaacagtgggcagcaagcagcgatagcttggttccatgattgcatcaaaccaacagttttgctgctccaagtaaattcagataaggttagggctgagtattgagtggacaggatcaaaccaaactgtgcaatatatatattgatggtgatcctatcaaaggagttgcggtttgtgccttaattatctctaattgaattactatatatactaacatagctcagatatattctgctcgtgatctcagtacaagcataaaaaggattactacaactttattctgaaagttgtgaagtactgcattgaacttgttaacctaaatatgtaacttctaggtacacattgttagatttaattgggtaattaatccatttaaatcaattaaatcaaataaattccaaggctcattatgctaggaattcatgattgttgatgcttattcaacgttaagcatgctcatgttgattacattcaccactatcactggatcaaatcctattgtaaatatcatgattattatcttgttattttggattaaaatatgccgaattatgaccaaatttccaacattccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgatgccggcagtgagctgtatgttatggagcagttctatgactacaagatggtcgatgaccgttctgtagttgaacaagctcatgagattcagatgctggctaaggaacttgagaacaacaactgtgagttgccggacaagtttgtggcaggtggcattattgccaaactaccaccttcttggtcggactttgccacttctctaaagcacaagagacaagagttcagtgttcctgatctcattggctctttgggtgttgaggagaaggcgagggcaaaggacgtccgggggaaaaaggttgagggaggttctagtgccaatatggtacagaagaagaaccctcatgcatcccacaacaacaagaaagttaagcctgatgtcaaacccaaggctgcaaccaattttaagaagaaaagcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatactacctacagttctctctgtttttcattcacctgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcatttctttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacagtgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctagagtacccgacatgcatgttggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactattggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgctttcatctgtaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttatagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctagcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgaagagacccttgaaaagagctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaagaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgattattatcttgttattttggattaaaatatgccgaattatgaccaaatttccaacacacatttcagtaaagtgaggtcagaataggtgtaagctcatatagctaacttcacgctaggtttagccatggtttaatatatcgattgggcaatttctattgggggaacctatacgactgaaatttaggatattttggtccaaaaaaatttgaacaaaatgggtcaaatttgagttttttctaaattcatgaaaatttgaaaaaaaaagatctaaaaatttcgggcaaaatagtttcctatcccggggaccgataaaatgaaaatttccaaaactgaaattttgttctggaattttgaacccaagtttacgccttgagcaagttctaggctgcatacctacaaaactagaaaatacattaaatatttatttcttcagaaatgacttgcttcaaattgagacacatgagaaaacgacatacgcttcaaatttagtggtactaggtttcctcgtagcttgtgttttgaagctcccattgcatgcactctactagtgcatgctaaaacaaacattataaataagggctattaggcaattccttttgataaattagggccggcctccacatcttgctatggagcctgacttctgcattaccaaaggatatggagaagctagctatatgaagaactcaaagctacaattttgtatactacccaacttgttctctatgtaacattaccatagtgctattttagtagatacatctacgtatttcatgctaaataaggttgttttctttcattatagaaatagaactacatcaccgacctgtttgtactttccttttcatctttagggtgaaatcatgtgttcatgcaaattagccatctctttaaatgtcagaacctatttaaacatcagatcagcgttaccatggatgaaaaacatctatctatttattatatactaaaagtccattaaacttcctacaaacgctctcatgccgccacacgagactcttacaaacgctcccaagccgtcacgtgttaatctaataatctggtgaacccaatattatatgaaattaaatctatttttggaaaaaaaaatccacatcccacgtccagcttggtctgtgcgtacgggatatgtacgtacgccctcccatgtttcccctttaattatctcctatttccatgctacatgatctcttctatttccatactatattagttcctatttttatgatatattagtcaaatgtaaatcataatttataataatagttttcaaaaaaataactaaatcaccgtcatataaatacacatatatatgtacaaacgtacgtactccctccctcctgttccacaggaattagataagaagtgcattttatttttatccgttcgtgagtatgagaccatcacaaatgatttatcatggatggcttcgcttaagcgtgtcttaaattgaatgtgtagatcggctaaaaaagtaattatttatttatgtcaccaagatcattcatatataaattaaagttcatagatccaataatttttatagtaataaatgatggtgcataaccttaataaaaaataaaaaagaaagagaatactgagggggaggggagcagatgtggtggtacgtgcgtattatacgtacctgtgggtccaagagaaaagggtgatcggatcggtggatttaatctaatggttagtattatcgggttcatcgttttaaataaaaataaacggttagatatctttcttttttcttagaatttattagagtgccacgtggcggcttatgaccgtttataggaatcccacgtgacggtttgagagcgtttgtaggaagtttaatggacttttagtatttttaatttatttgaacagtaattttatttgttattaattatactatataaaagtcaataaaacttcatacaaacattctcaagccgctatatggacatcctacaaacgctcttaagtcgtcatcgtcatgtggcattttaataaattaaaaaatatcacactactccaaccgtatgtacgtatgttttcctccctctccctactcttctttaaattaattttttaatgaaaaaacaattaataatttaatatccatatcacccatattttactataaaaaactaaaatacattatttgaacagattgcaaccaaacaacatccaatttttaatttatttgtaattaattattaatctatctattaggtactaaaagtccattaaacttcctacaaacgttcttaagccgccatgtggcactcctatagatcctcctaagtcgccacatggcaatatctaatctcaccgttgattttatttaaattaatggacccattagtttacactattagattagatttattacttaaaaaataataattttctcatgtttataacgtacaggcggtactactgtccgtacgtatgagtttgtacgatacaaatgctactgctgttctttccatacgtacaaacgtacatgatctttcctaatcttgctgaaaaaaaacatacacatgtacagaaaaagacagaaaaaacatacatccataaaaatcagcggtctttgaaatataatttttgataaaatatattacttcacaaatataaatatatttagttaaacaaagatctataataaatatccaatcaatattctttaaaccatcttctgaatctatctattatatattaaaagtacattaaacttctacaaacgcttttacaccgctatgtggctctcaaatatattagcgaaatcctagaaatctattatatattataagtctattaaacttcctgcaaacgctcctacatcgtcacgtggcgctttaatttagattaatcctagaaatttagagtaaaaaaaaagagaaaagcatccaatcttcaattgtcacttaaattagtgacacattattttaaacattggattagagctcttaaaattcccacgctgctaatctctatcccggaaaaaaacatagtgtgcttacatcgtacgatcgtctccctaccaagaaaacaaaacttaaatacctacgccatatacgatcaaaaaaaataaagctaaaaaataaaaaagaaaacatgcacacgtacatagaacaattggaaagaaatactaatcaggaaaaatcatcggtgtgagcacatatttgttgtcaacggcctttaatctacaattttaagatcttcctccccactctgttatttatagtcctggtgtagatagaacttcctttatggtttaattccgagcggtagtaaataccaggacttagcaatatttgattgatcacaactcattatattccatttattataaatcttccaaagtaattcattataggaatgctttcaagaaatggtttgcttttgcacatcgaaacaaaaaattaatcgcgcggatatgtataattcaaaagaatagatgagtgattcatacacagatatcgggatttttatttaaatctaagaggcattcttatcatattagtagtatattaaaatctcccatgtattttaggataatctaaattcacttacaatatatatatatatagtgatgtattattccttttttaataacaaataagatgctcgtacatctgtacgaaattcctttccgatttatattccggaaatgttctccagtttatattctgtcattatagtgtttgaaacacaaaatataatacatgcccgcgcgaatgcgcgggctacgttcctagttaaataaataaagataaaaagttactgtgtacagtctacagattatttcattctattcaatcgagcctctacttattcttgttgatttgtgttctcctgaattgtcatactttctccacttgtaccctttgccttagcagaagattttcttctgatctgttgcttcatatatatatatccatctcctattagcccaaccagtcacatgcatgggcttcttgaatactccttgttcatctgatccaagcccggttttttactcccttgtctctatttgtacctaattgatcagctctcctctttatagctcatagagctttgctctcatcccacttgatccctctatttgattgctcaagcttcccgttgaccacgatgggttgtcgatgttaagcccccgatggtgtacctttgggcactaggtttgtcgaaagtatatgtatgtagttgcaaaaatgctaccttaaatcgttctaatgattattattcaagtgagttccaatggagcaaaaggattgtgttctttattctagttggtttcttgtatttggtttgcatttaattagttggttgtctttatgctagttggtttcttgtatgttggttttcctttaatttgtaataatattgcttaatgaaagggataggtataactctatgaggatgatgggcgaccctacttggggatgagagaagtaaaataaatatgtgtaacaactttacattatgatataattctatgcccaacacgattttattagaccacctaccagttatataaactagtgatctcttagaactagcaaggtgggactaaataaattattttactatgtgtgcacatgcaaccatgttgtataagctatcagcataggcctagtaccaagcagtcacattatgagtgagagacatgctataaacatgaaaaagtggcaatctatatgaatatgaatgagagacatgctataaagatagggaaaaaatgcaattttactagttatataggctatgttgttgtaatatatgttaatgtcaacggtacaaattttgttgacggtaatggggtgcccgatcttccatcaagtagagattatcgatttggcagaaacttggtacacacaatctggttttcaatcaacaaatataggttctagctaggtcgatcaaggacctctagaagcatcattattggacttcaatacgatacatggcccagcggcccaaaagatggtgatgcagcactcagatagattctggacgccacttctttcagaagaatttttgacgtgagaccagacccattggaaaggtggtctcgttagctttccatatgtgagtctgaatgcggctgcgtgatgtttttagcgcagactactcctagagcctaaggtagactcaaacttgatatgagttggccctccatcttgacttcaacgcctgacatcatccttctagcctctctttttggtcttctccatagtttctaattataattaaatcattggttagtattttatcaaaatcacatgaagaaatacttaggaatgagctcacctgttattgcaatttatgaatgcgagctctagtgattggacctttcatgacaacttagagagttttgtgtgtatccaaagcagtcatatgttctcatcactagtttaactcaaagtgaaattatcttcagattaaattaattacatgtaccatgcatatatttttctagcttgcagtactggtttcccacagttagtcacaatgccatgtatttatgtttgctttgaatgttagggaaaggctctgcttcagacaaaaccgatgattgaaaaggccattaaaaaagtacacactgctcttcaaccaatgatgatacttgtagctgacctaggatgctcctcggggccaaataccctaatgtttgtctctctctaccatgattagagagatcgctgaatattataacaggatcggtcagtgccccgtggatgttcagtttttcctgaatgatctacctagcaatgattttaatcacctgtttaaatctttagaacagattgataattttgttgctaaagatcaaaacagacaagcaactacactgcctcaatactatgttgctggattggcaagctcatactatagaaggctcttccccaaaaatagtgttcatctgttccactcctcgtatgctctgcactggcgatctaaggtaatcagacaagcttatcacagttaattgcagatgtccaggtgaagcatacttttagagtagtgcatttagacatcaatctcatttgtatttagccttttgagatatatgctttactaaaattgtagtatttgttttgaatttatatatgaatatatacaccttggccatcgatatagatcatgcaagagtattgatgaataatttacctgctatcgccagatcttgtcaaaggagcatttttttgggatatattctaaatgttatttttatttggttttaccataaattttgatcatagtactagcattcaattattgagataactaggtgaaaccccgcgcattgctgcgggaatttagtattataacaataaaaaaaataacgtgtaagatagctatgatagctagataacaccagattaagtaaattaatgtggtttatgataatttaaatttaaatagtatgtagaatggtgattcaaacgtaaaaagtaaggtggtatgattttatagaagaagaaaaatagggagatagtttaggtgtgtggaccatagattaatcatctaaaggctaaaaacaattgatgggatatgacttaattagagggaaaaaggagaaagataatctggaccatagattaatcatttaagcactaactaagtgatgatgaactatataagtatataggatatcataaaacataataaagatgtatattgaaacattatgtgaattatgttggatgataatttaacatgtttgtatttgaaaagctcttaaattataaaaactataaagacatagcatgtttgcatgatgtttaaatgtgatgattgttagtggatgatgatgtggcatcttgttaattagtagattagtgaatgatgatgtggcatcttgttagtggatgatgatgtggcatctttgcatgttaagcttaagtagttagtgggggataactttatagtaagatagaataagttgggacttgttatcatactttttctttcacctatgatataaaaagagtaaatttcactttggcctacatttgtgaccgatgtttcacttaatttggatcacccttcaattaatgctttcactttggactgagtaattttacctttgtattactttggactaacctgactctttttcgagcatatatatgaatgatctcaagtacatcggctcctactcgtcaataaactctcacagttatacgcaataccatttctttggcatatgataaattggttgtagatagataaaagagttaagggtggttgaaagtgcctcaaaggtaaaaatacctgatacaaagggataacatagtttaaagggtggtccaaatcataaacaaaaactgatgtagtaaatgcgtatatcttgtatatgcaggcatgagatatagataactgttattattgagggatcaaaattgctgttagcactatagcaaaatatcaagattttgttcttcatatccagatgttcgaaatgaaaaatataaaggagcccctgaacgaaggcaatatttacatctccaagactacacccatatcaacagtcaagttatatcaggagttatttgagaaggatttctcaaatttcctcgagttgcgctcaaacgaacttatatctagtggtcagatgctactcactttccttggaaggaagaacgaagatgtatctgatggagatcaatgtactcttcatgtattaatttcacgagcaatacaatctcttgttatggaggtctacacaatccatattactcatgatatattaattactatacattgtcatatatatatctagctagattcttcaatgaattaatgtgcttaatttccactttcaacacattagggtctgatggagaagaaaaagcttaacaacttcaacatgccggtctacatgccgtcaacgcatgaagtgaaaacaatcatcatgcggagcaagctgttcatcatcaaccagatccaactctctgaatcaaactgggatccttacgacgatgacttagaaggagaggttgtgctctacccggcgcaaagcgggttgaatgtcgcgaggtctttgaggccagtgttgaggcggttgttcactacctattttggggaatcggttcaagatgttctcttcttaaggattgccagtaatgtaagcaaataccttgacaaaaggaagggaaagcacaatgtcattgcactgtcattggcaagaacatatggagatggagtgctatagatgatgatgatctggctggtacatcttacttcctatgtttcatattataagttcttttctaatcaagtttggttaagtttgactaagtttgtagaaaaaattagcaacatctaatatattaaattagtttcattatatctaacattgaatatattttgataatatgtttgttttgtgttgaaaatactactatatttttctctaaacttgattaaagttaaaagaagtttaactagaaaaaaagttaaatgacttataatataaaacggatgaagtaactatgttagtggccagaatgacgatttttggctggtttgtcgtttgtgccaatctgggcagaggtggagaccccacagtttcaaaatttgcattgtatttactggagtttgaacaaaatctgaaaaaaactaaagtattggcttcgttcaatcgaatatttttagtggtcctgtttccgccgctgattctggctattttgatccatacatattccatttttttttcctttttagtgattattgcaaggctcacatgcacaaatttatgtgacatcaaatttgatcataaaaagtataggttctacgatgaatttggtttattcatggatgatacaagttccatgacaaaatttgctgattcgtcgtgactaaacgaatgtcacgctccgttttttacgaacacgtacgaatacgtcacagaaattttcttatgacgaattcgtcatcgaccatgacattaaagttttatcatagatatgcacatttctactagcgactacaagctgccaccagcccaccaccacacctctgaaacatacgtcgagcaccttgtgtgcgtgcccaaagcactaccagttcaatgtacatatatgacggctagattcctgatcaattatttccgatcataccatatcgccgtgaagacccttctttcctcccacgcatggccgccatgcaccggcgaaactaggagtttgccgtcgcgccaacccatttggaaaaggaaaaattggaaccatgccattataattttgtaaaatttgtaaatttaagatatgacatgctgacccacatatcattgactcatgtggatgctacatatcattgagataccgatggcatatcttaaactttgtataattacaatggcatggttccaatttaccctttgcaaaatcaaaccaactctcacaggcgcaatatgctcgtgcgctaggttgaaattaggctgtttggttggctctcaaaggttgctatatcaaacgttaagcataccataatttgttagtatagtatttggttagttgccacacctaaatcatgcctcactttataaattattgggcctgcacgccatatactcaaattcttgccaaacttaattatacttgtggctaacaaattgctagtctcactttgtatggcataacacacttgtgacagagtgaggtgtggcaaacttagtcatcaaccaaacaacccgttaaaacctatgatccgagtcagctctgcgcatgtcgtgtcgccgtcgctacagtgccttgcgagggccatatgccatcactgtcctgtccggtttgtcgtggtcgcctcgtcgacatgccattgcgcgtgcagacggcgccatgccgtgcctgtgccgctcgtcatgcacaacatgtgcgagagagggcgagatggagaagaaacagatggaatgggagaagttggcatgaccccacttttgtcggcctccctggtttttttcctctgagagataaatatcatgtggaaccacctgtcagtggtggcaatattttgatcttagaaaaataaatcaagaaatctatatacctaataaaaaaataaggtaaggtaaggttcctaataaaagtttttgtccggcgtccatcgcaagcggaatcaccttcagtaatcggtttatttttacaataatcaatatttttggtaatcacatccgtttcctaatctgcaaatctgcaaagccatgcccaccatcaaacccaaataaatacggtaatcagttttttttagtaataacatttgttcatgatagcatcaagtttttgcaaccgtcggcttgtttggttttagggtttattgtttggtccacgttcaatttaagattgttttttaattcatgtttatttcttgtcaattgaggtataatttccctggtaattatgttatacttaagtttcatgtacttaatttccccccttttattttcaagttctgatctagcgtaattaaggctcaatatctatgtaagttgcatcttgcctttcaaattcatggcttgagtagcacttagaagtaggggatcacgaatgggattgaaatcaagcaaatttccaatattccccaaattcaaaacccaaaactttagttttcctcaaatccgaaatcctaatttcatttcccccaatatcaagaactctaacctcctaaattagacaatcccgaacccaaaaaaaccccaaattgatcaaatcttgaaacaattagggcctttgctaaccgaattaggacttacggatcgtccaagataactacacgaggcatgagctatgtcatcatgcgcatctccgatatcctcctccgttatcatgcgggtgatgtgctacttcagctgcgccgtgtaccggccatatttcgccgcctggacaatcccgcgcatgcctgacttggccgtgtgacaatgaggctcgcctcttctacagcctcaaccacaccaaggaggagaaccatggttggggagcggaccattgacctcaggccaccgtgcgccatcgccgccgtcgtcatcaccttgacatcgctgtcctttgtgcatatgggcaccctgctcgggtagacttggtgatgtcgactcacggcgcactatcggcttgaccttcgtatccgtgcacggcctaagcccgccacacacaggcacgccgttgcgaatcatcgccaccgtcgcctagctcccttgctcacaccggagaaatcggggaaaatgggagaaatggcctaagattaaggtttttcagaaaaccctgcttccatgatcagtttgaagcaccctgcaggactgatttattaaagtttaaccatacaaacagaaaactaagcgcacaactgtcatgtaaacttttgaaatattttgtaacgtagtttatgctgccatcgaaggatactatggaatttcaccctaaaatatgacctgtgtacaaggagattttttttagataatgtgtacaaggagatatcggctaaaaagagaaatatgctcataatctggagtgatttgtagcttttcctttcttttatttttgggggagtaaaatatgtcaaaaatagtttaggggccggtcaattgtaaaaaaagtaaatagattgaggtagttttttttttctggcgacctaacccattataaaaaaatcagcgacttacgtaaaatgtataaattaagcgcgctgctatttaacggcgactgatggcggaaacatgaattagagatttttttttagataatggaactttttattgaacttagactagatcgccatccatattcctgggtaaaaaacaaagactaaattgccactcatgaacaactcattggccatttcctctaaaagcacagagttttaagggccaccaattctaagactagatcgccatccatattcctgggtgaaaaacttcttaaccatcttctccaaatattgacataccacaactaccatatcctgcgaaccaggcaaccaaacttctataggatagcctatgtacgaagccaatggataagagaatatataaccttcaaatggatgtgaggatactaattaaaagtcatggaggaagcctaaacactgtatggcctaatcagtttgatgattatatgtgagaaaaaaaatgctggatcggagggcccaagctactgatcgttccaccctgcagtctccgccactatggaatgtacctcgttgctgtctagctgcctgaagcatgtggatcacacgccacaaagtttatatgtggatgagatttttttcaggattataatcttgggagtgttgcaaattaatgtcatatatatatggaccatatgtgatagcccttaattttcgcacttttcggtggtagagattgattgtcctgaatgcggacaaacacagcagcaatatatacgtggggaaacaacaattaattaccatcccactttgtaaatatatatttgtatatatatcattaattgttgtaggcgtgataaacgtgtacaatcaccatttgcatctataaatataatggcaccatgatttctatatctatatatgctacttgtgtgttgaacctcccagttgtatacactcctaaaaagaagttattaggtctcctcctgtatcacattatccacactcttagtcttagctatatggaaattgactttggcatggttgaaggggacggagaaaatagctatgcgaagaactcgaagcttcaagttagtacacactacacactaactctgtttctttgagaaattgcagattcatttcagtagatatatattatatatatttatagggaaatttacttttaattcggtatattatgttgatttgatttgtctaaattgggctacacatatttgtattttcttggatcaagttgtttcgtgaggacttctgtctatattatagtaaaatttttcagtccttccgaaagtctcaaggtagtttcctctggtaccaaatattggatggtaaaattgctcaaattttatactaaaaattttggtatctcgatacacctactacctgatactacaaaatatggtacatcccttaaggatggtaaaatcacttttatatgcatgcaagtccaatgtaaaatcaaacatcatggttctgggtgaaaaaaaaaactaaaaatagaaaacatgcataagctaggttttgtttagataagggattttcattaatccggccactatgcccacgaggggtatacatatccaaaaaggatacaagagtatttaaactcacacctcaatagagaggagaacacaaacccaaaaaatgaaaaacctacaacctctgcatatccctgtatcccgacatcctctagtgaacaaaattgacgagtggaagttgtcttctcatcaccgcccctaatgcgttctcgctgctaatctccactggtgccatcttcatccactttaagtgaaccggtgccacacgccaccgggtagcccaccttcatccatcgtcgtccagtcagaactagccgaccaaatgcgagatgaaaggatatgcttatgctttgccggattcctaagcctttgcagccgatagggccgttgccaacgttggaatcctctactacctctcggactctcagcctgccgccacctctaccggcgtcctctgccgtggtgatcgagcatatcatctttcgtccggacacccaggcctccaccacccctagggctgccatcaccgacgagatccaccttcgcctgtaccaccttgcaccagtccttatgccgccgccgcccctaagaccgcagctgccgtaactaaggagatcgctgctcggactcgcaggccgtcgcggcctctagggtcgcagctgcctacgacatcaccttcatcggaacggccttctccttgctgaggactgagcatcgaagcttaggccccctgctgtcctccgctgcacccgctgtcctccgctacacccgccgccgcagagacgtcgcggccgacccgctgtgacaccgcctcccgacccctccgctgccgcatgccaatctcgggttcagccactgctgctgtccaacgcttgcgcctccatccctcccaacaacctccgctggcacgcgcggccttgaccaccactgcccatggcccctccgcctcccacgtcgctagatttgggggctggaacccgcagacccgacactcccctccgccgcaccgaggtctcctctggaaaaccccgtcgccgctttcctcacagctgcactgctcaggtggtggcaaggccatgggaagaaatgagataccagatatggggaaaaagccgaatcaggccagtagtatgaccatataaaaagggttaattggatggatgtcattgcaactttactattttgaaagaaatgttactactagtcgagtgaaatctattagtatgtgctactccctctgtattttaatgttgacaccgttaactttttgaccaatgtttgaccattcgttttatttaaattttttatgcaaatacgaaaatatttatatcatgcttcaaagaatatttgatgatgaatcaagtcacaataaaataaatgataattacataaaatttttaaataagacgaatggtcaaacgttggataaaccactcttctcaaagacctgctaatctccccccaaagcatgtaatgagaataaaacatgcaaaagaaattgaaaattcatttcagtagatcagaatgtgccaaaaaaaagtgaagcctttatctcagtaaagccgggcgtgaagcctttgatctaaaaaaaatgtgcaaaaaaaaaacagatctggtgtggtttctttctttcctccagcaaaatgtagggaaaaacaaccatggataaaatcgttcgccgtttgctgaagaattgaaagccctagagttcttccgtggcggcggcgacaaaagaatgcgtgcttgtgcggcaggggaagaaattgattgttttgctgaccttaacgtattgttgcctcggctcagctcgtgtcgtcttgccggcatccgctcacagcacggatgaagaactgcacatcaagaagctcaagaatgacaaatggggcggtataacttgattgctggcccgtgatagctcgccggcgtctatgcacggaggcaactcttgccacaggaggcttcgcgcagccgccgcaggcaacagggcctccatgtgcggcgatggaagctcgtcggagtccaggacaatgactcaaggagtgtgatgtggaggaggggacgggggatgagggcagaagggggttggggaagaggggattcctagagcatacctgatggaagtcctcggccggagactcggcgagactggatggagtgccgcttccgccaaaggaagatgcaacggggatgcggccggctagcggcgagcggccgcggcggcggcgggtggcgattcggtcccgataactcttgagaatctggacgagaataggaggtgtcatacacacgtattggtcccccccccacaacaacccacatacgaatcttcaggtgggccagcgctgtatttcgagcgtgcactcaaaataaagaaaatacgatcctaaattcctaacatctccgtatactatttgacgcacgaatctttaaaccatcgtgtggtttctagcctaggtgccgcagcacctaggtgctaaaaatactttccgaactatctcctccttccgcacggccgcaagtctccagtagatcgtcgccatcggcttctcacaggcacagctcgcctcgtcgcggagctgcagggagacacctgccacgccaccaatggttgccgcacgcatggggtggcgacccgccgccgccgcccgagccgttcttcttcgcgaagctcgccacctgcgcccaggcccagcacactacgtacgacgtggctcgcgcgccggagtgaagctgtagctagccatcactagactagaaggcacgacgacatgtactctacccaacggcacgaacagctagcaccagcatgacgcgctccttgtagacccgagaagttggtgctgccgcacgccagcacactcgccatgccgatcgaacgtcgactaatcaaaattgaccaagaaaccatccacaaattcaacaaataagtggtagaaattgaagcagttcttgcgtgcgatcgagaggggcgttcgatcgaccattacatacgagaagctagggaagcgccggcagggggagctagcttgccgcatccacaccacgttcccgcgcgcagtacgccgctggccaccagctgcccgcgcctgctctcgcccttcttgccggaaccaagaagcagccaccagcggcacgaacagagcttctccatggccatgggattgggggaaggggacagaaattgtgacggcagtgacgtacggtagtggtatgttttcaaatttagaaaattttgatggcacgtagtaggttttcgttagtaccgatggtattttttctagaaaatatataagaaaaaggaaaaggtgtaactaaatttatagaaaaaaatagtaacatctacgacaccaaaatagttttattaaatttaatattgaatatattttgatgcaatttttgtttcgtattgaaaatgttactatattttgctacaaacttgatcaaacataaagaagtttgactaagaaaaaaaatcaaacaacttataatatgaaacagatggagtagtttgtttactagtatgcaactgttaattccaaacaatttaacttgatttaatataatgtgcacatgaattttaggagaagactttggttgctactaagcctatgattcagaaggccattcaagaactatactctgcagttcttcctaggacgatgcttgtcgctgacatgggctgttcttcgggaccaaatacactaaactttatcttcgaggtgataaaagcgaccagcgaatattgtcaaaggataggtcaccgccctgttgttttatgaatgatctacctggcaatgactttaactacctatttaaatctttagaacaactagataacttggtcgccaaagatcaaaacagagaagcagcaatactgcctaagtactatgttgtaggcttgccaagatcctactatacaagagttttccctgacaagagtgttcacctcttccattcatcttattccctacattggagatctcaagtaagtctgtctctgaaaacctatcccagttgagtggtaactcattaaataggccatgcatttttttttactgatcgaaagagtacaaataaactggttattagttgctaaagatttctactgaattctagtattctacaacaaataaagtagttatttctatatgtacattttgtaagttcccatcgattatatactcccataatttgtcgctttttttgagaaaataatttctctattcactcaattcatacaacatacaaaacagtgatattatgaaagtagtaaagtgaatgcattttttgctgcaatgcatgagatatccaaaaagagagaccgcattttctgtaccagcattaggagttcatagcaccaataattaatatgtgtttatatcttccactgcttttgtgcacagatgtttcaggagagcaacaatggggaattcctaaatgaagggaacatttacatcgccaagactacccctaaatcggtgataaagctataccaagagctattttacgatgatttctcaaagtttcttgagttgcgctaccaggaacttgtgtctggtggtcagatggtgcttagttttcttgcaaggaagaaagatgacctatatgatggaaacctaagtgttctttacggattaatctcacaagcattgcaatctctagttatggaggtacactaaaccactaaccctactaattacgaactagcattatacactcccattttcctatagcttaactaatttctatattggtggatatggaagccatgaaatttagaggtccgtgtatatatgaacatacacacattttccaattcaaaaaaaaaaactttgggctttcctcaggacatattctgtaaaaagaagattttcaaaccaatttgattaattgaaatgacaatttactcaggacaatgcagatttgtttcaatctaaaatgagccacttagcacttactactatttttttaaaaaaatggattaaaatccggtctctatatccaaacattattacaccttgttttctacgctgatacttcacatttccagtcttatgtacaggatgattggttgatagcaagaagagtgttataaaatgaacaatacatattattttcctcgcctgatcagtatattataaacagagtctctaaaatgaaagaacttgctttctgctttcaacatggcagggactcgtggagaaggaaaagcttgactccttcaacattccaaattacgagccatctatccatgaagtcaaaacagtggtgataagcagcaagcttttcaccatcaacaaaatttacgtctttgagtcgaactgggatccttatgacgactcatcagatcaaggacaagcaactaatattaatcctatcaagagtggcttgaacgtcgccaagtgcattagagctgtgcttgagccgttgatcgctagccattttggagaatctatactagacgtgctcttctctaggttcgcacgtaatgtcacccagcaccttgagaaaaggaagggaaagcacagcgtcattgtgctgtcgctcagcaaaagaaagaattaatcacaagagcggatggagcatgagaatttagccgttaatttcctcttattttgatttgtaatggtggtaatggcctggtcattgtgtagtttgtgcttgttcaagccttttgtgtgttctggaatgcaccatagtattttgtagtttaataattcttaaatttagaattaataggtattgagctgtatctgtgttggaatttgcttgtattatattgtacaaggaaatatcatttctctaaaattaatgattatccggttgtacctaacatgaactgctattgtttttatctcaatcatattcatctaatatttttttctttctttttttttgaatttccgttagtttgtacgtagtaaacttaattactttccatggctatttaattagtctgcatataatctttttgtcagacttttacaggagaaatctgaataggaatgctagcaaaaacgtcatgtgtattatcatatcagacatatagaagtttttctgtgacttctacgttggtaaaaaatcagattacgcctctatcaagcccacatttaaggaaacgaaatgtcgtaccgatatccgacctagtaagtaacattgattttagcgtttctcttaatccgttaatcgaatttgaatgaaacaagccacattacaacgacgaggacagtgcctaaaatttctgtttagactacataacccaatttcaaaacattttttcagcatactggttgataaattaaaatctgaacgtttgactatcgaatcaatttctattcattttttatacgaacagggatgaaaagtgtaagatcaatctgtgttttgattcttattctgtgttaaacagttggcatctgtgattattggttttgatatttgcagattatcgtcgaagtggttttggagataatcaattttcaggtgatgaacatggtttactgttttgttgggaccggtcagaccgggcggaggttgccggtcagaccagctcatgtgtagtggtcagactggccaggcccgtggtctgaccgggcaacgctgtgtcggtttcggtttcgggttgtttctttggatatccgtgattgtttcaaggttatggcttttagatggatactatacgtatgtaatactgttgtttgctaataatgagtcaagtgggggatagtttggtctcgaaatatagtttctttgtttgtttcatgtgtaggtgactcgatgcctcgggagagtatttgtggtgatggaccgggagtcggattggtggtaagacgatgtccgtgatggtcagatatcatgcgggatactaagactagagttgatgcacgtggttggtgaaaattccaaatggcatacgatagaggtattgtgtgcgtatgggatgcggagtcgaatttggaagtagtccaaatttggtatgattggttatgtaaagtttgtgtcttgtactagagggtttcctaaggtgtttaggactcttagtatgagtttggttcgtggctttaggctgcctacctcatgtataaatatagggggagagtgaggcttcccggtatcgtttttgagagcaattgagttactagtttagttagggtttcgagtttagtcgagatttttgtaaggagtgctattggtgcactttgtaaacacagagagaagcaataaagttatcatctactttaagagttcttcgatttgtgtttcatcgggttcggcggtctaaccggcgacatatcggcggtcagaccggcggcaggcggcggtcagaccgacggaggagaggcggtcagaccggtggtgacttcacacgcggcaggcaatctttaggcggttggaccggcggatcaacaccggtcagaccggtggcacgagctcggtcagaccggcggatcaacctcggtcagaccgatctacattgaatttgagagtaacttttattcccgctaaaagtttgggtttttgggtatatcaaccatttacaccccctctggttggcttagtttttgtgattcgatcttaaaaaaaggagctacccattgcaaattaaggacaaactgcatatttgaggttgaggcaaacccgctaaatctctgcagaaaatacccgaaatccttcagttctcgtctcgatctgtttcccagacgaaagcctctggctgttgcagcagctagcagcaaggatttacggtagcagcagcaagcatgcatcaagcatcattggcagcagcaactcagcgggtaaggaactgagtctaaaccaagtctaggcgattgattagtagttcgattttcattagactttatctttttaactaacagaaaaaaaaataaaaaaagatggaaaatgagagatcgatagcgctgctgtgcgcttgtgccgcttgctgtcctctgctcagttccttacctgctgagttgctgctgccaaaccaagtctaggctcagagttattaatttcgaggctttctatttgaagtggcaaaatatccgtacattgcaacgggtgaagataattttaatacattgaataagatggtgcctaaaaataacaaagtaggaatcatgcagctgtttccatgtttttttgtgttgcatgggaacctaagcttatacgggtcgaccctacgctctatttcacggtatcagcatatagtacttcgtgatctaattttgttaaaacaagagaagagggaaaaaaatctacatttatagtatcataaatcgattatgcatgtaataaacaaacacattaatccttttattatttttttcgagttcaatacatcaattagtcacatgcaattaaaacaaacactattcaaatcatgtctaccttttggatcccctccagacaaaggtcacacatatatttttttctcctataaatactaattagccaaaaaaaaaactgataaccggtgtcgatgatcggtaatttttgaagtcaccacagatgtcttggtgtcaacggataagtcacttataaatgaaagaataattagccgtaaatttgagcacccatgtcaaatttagtatttaaacacgggttgactgattcaaccacaaggaagctaactagttgaactacgcttactttgcaatgctaccagtttatttctagtggaatatattttgacactatatgatatcggtgattacatgcaacacaatttgccatgacaaaagaattatttttgatagacccacaaataggtaataagaataaaacaatacaaagaaccgtaaaaacttttctaattttaacctagaaactctaaggacttagtcttgttttaatatggttccagtccttttgcctatcagctaacattattcattttgtattttttacatggacttctttttttcaaataaatagtttctgcccgtgcaccccaagggcccaccttgggagagacagcccagtagcccacggcatggctttcaagcagcagcaccagaccgaggcccaagcgacctaacatatgttgccgacttctatacggacgggtagacgtccaagtcaaaaaaaaaaaaaatccgtattagaagcggcttgacggacgaaaagtcgaaaaaagatgtgtaaacgaggtgatgagtttttaaaatgtactggcaaaaatgcccgtacgttgcaacagaaagaaaaaacaaaaaagatgaattaaaacatattaaattctaattaaatgaaatacaaactttctagaatatttaggtattttttaagcaggtaggtatataattaaattaatttacaagtaaagtaagtgtgaggaataaaatgatatggtaggatttaatttttattaaattctccatattaattacactttttgaaattttcttcaaatttatagagattaattgctaattttgataatgcaaatattattttagtatttatttaaataaaaatctaaataaatatccttcttctctgtggaccattttcagcccattttcttcctcagccagcaagcgaccaaagtctaattaatatcctcatattcctcctttcacttgccatgtgagccgtaaccagaaatgtggtgcggtccggtgatgcaggccagcccaacacgatcgatcgatctgagctgttcgttttgatggacggctcggatcggttccaaatcaattaaaaccataacactaaccctcccccctcccccgaccggctctcccatcccccatcccccctcccaccatcggccgcctccccgcccgacgccgagaaagctaatcggcgaatagtcacgcgcccgccaccccgcgcggtgcgcgcgcggagagaccaggcgctgacacgtgtgtgattttttcctttttctggttttttctttccccttttttgtggttttctgttccggttttttctttctgtttttttatgtttttttgcacttctggtatttaacatatacatatacaaactatgtatacacacagatacaaactttatatacgcatatacaaacttatttttacatgcgtatacaaactttgtatacatgtatttttgggtttttatgcgtacgtatactaattttgtatacatgtatacaaagtttatatgcacgtatacaaagtttgtatacacgtattttttaaattttttatacgttcgtacacaaactttatatacatgtgtatattttttatacattacaagtgtatacatacaaaaaaaaattatatacacacacgcgcatgtatatactatatatacatacgtatacaaagtttatacgtatgtatatatagtatatactatactacatatagcagtatgtatagtagtatagactagagggggggcagctgatcgcgcggtgctccgctcgcgaccagtcgcgtatcagcgccccccgcccgatgtcgcctctcccctctcccctccagcggcgccgctccctctcccctccctctaccctccggcggcgctgctcagtctccccctctccctcctgtctcgccggcacagcgcggcgacagtggggtgcggcagagatggcggcgacggccgtccctccccctctacctctccacgtcggcctcgacggccgtccctccatctcgacaacggtgccctctccaccctcaagatccggcagtgccctcccaacggcggtgtcagcggcgacgacggcgtcagttgcgtccgcaggtagatccatcggtggtggcgatccagcagcggcggctctctccgcggcctctattctccctccagtggcgccccgtggtcggatccaatggtgacaacagcattggcggcttcccagtgatgttttagttttcttcctgttctttttctcaatcgcttgattgtccgattagattttgtatttttttttggctttatttgccttattaagcactcgtacggacgaaaaatcacgtggactgactaaacggatggtgacgaaatgaaaattacgaatattttaattagttaagattaagattttggccggcgtttttttctctttggcttttttttcgctttttttttccgccgcttttcttgctgacggcgttcgggcctttttttttttctgttttttccttccttttccgaattgttttctgattccatatttgagacggttttttcggcgttttgtatttttacttttttgggcgcttttttaaaaaatgcctttttagatggattttttttttctcgccggtgttttttaaatcggaatggtttttctctctctctttcttttcggacgatggaaacattttgcacttttaaaacagtagaatagatagatagtagagaaatagactaacaaaataccggtgcgttgcattctaatctcttttgtttttcattactttactctgtggaattgggctaggaacctatgatgtgttcttcaatgcaattccgtttcaacacacatgcatatttgctagccatatgaaagtaattccaaacataaatctaaaaatgcaacatgcatgacaaaatattactagttaagctattaactttaaagttggtaaatgttgattttttaagaaaattgtggctgccttataataatttaggatagagatagtagtaaattagcgcggagagatgaattaatcacgtggcttcatcactccgccaataattttgaacaagggaaataatagcagcaactttgtctttttccttgtttgttaggcggagaaggactgggagagaccgaccggtgacaacgagatgtagctagcgacgagcagaggaattcccatggcagcgtccatggaggcaaagagggatggagaggggaggttaaggggaagcccttagctcttagcattcccttgacatgctagaggcatatgcctagaaggtcggagatggcacacagtggtgaattgactgcgcgcctgcgcgggcgtggtggcttggagaaattggcggaagcggattgatgtgatgttgctcatcttttaataagtactccctacgtcaatccaaaatcagatgtgacactatatagtacgacgaatctgaacatgaggcatgttcatgttaggttcattctaatatgtagtgtcccattcgtatctcccaatttgttacactacattggatcctaggatgcaatattataggatggagggagtaggtaaaatatataaagttttttttcgaaacaacgtaagatatatacggtttcaaagtcctattgtattgttttgtagtatgatattgcgtttaggtgaagcctataacagcccttcctccagaactgtgtagccaacccatccgatgggcgggcccacttacacataccactccgcttatacttttgtcctcgcttcgtgtaaaagggttaacccgagagtgacatggttggaggaaagaggccttataagttggtcctcactttgtgtaaaagggttaaacctggggtgatatggttggagggaggagtccttgtaagttggaacatggttgtaaggaagaggccttataagttgcttcaagagaccttataaattgcttctcgcttcgtgtagaagggtaaacccgggagtcatatggttgaagggaagaaacattataagtttgttccaaaccttgctaaactagcaagctgtaggccgtgccgtaaaattcaggggtcctgtgcaaaatcactaaattgataataataataataataataataataataataataataataataataataataataataataataataataataataataataataattgatggatcttctttttaatatatttgcatagctcctttcttctattgttttttttcttcttacgcttttcacgaccgaagttatattttgtaatctgatttgtagacgatgtggcttgaaaattaaaatactagataaacttatacacgtatagatacaacatgaaaagaaaaaaaataatttagtccacatagtagataaaccaaataacctatgcaccaaaattgagaaacattatcatcaaataacatatgcaaccaggaggccagaagcagcgacgtaacacgtcgactccaccggtaaggcagaaagacggacgagcgatcaaggagacgaagaggcaacaaaaaaattggaagacgaaacgacagacggatgagcagtcgatttaattttttattgagctgcccacacgcatgtacttggggtattgggcctttgtggcccctcgaagatggggccgggacgggcctggcaaggtgaatttaaacatatgcagatagctcttatgggtcatacaggtcaaatcctagttggaccagaatgtcgcaaagccaaacctattgtgctatagaaatgaccaagatggaccaccgacagaaaaagttcgtattttcgaagtagtagagaaacggtttcaaagttaatttttttacatatttcttttaaatatttttaacttgaatttatattttttcagaaacttacatttgtttgaagcacatggatattgcacctaagttaaatatttcgtgtgcttagcgtgttcagtttgatatgataagacaagtggagagaggggaaggcagagagggcgacatgacaggtatagcggtacttattatgccagttgacattaattgatggcatggcaagctgattgcaacatggaacaaacgagtggccatggccatgtccacatagccgcccaagtcctttttgtaattagctttctcaactcacatttcttgtttttcacgtttctgaaactactaaacggtatatttttataaaaaaattctataaaaaatgttttaaaaaatcatattgatccattttcaaaaaaatacgtagctaatacttaattgatattgcacctaagtcaaatatttcatgtgctcagcgtgctcagtatgatatgataagacgagtagagagaggggaaggcaaagagggtgacatgacaggcacggcggtacttattatgccggttgatattaattgatggcgaacaaacgagtggtcatggccaagtctacatagccgccccaagtcctttttgttagctttctcaactcacattccttgtttttcacgtgccggcttgtgaaactactaaatggtatgttttctaaaaaaatatataaaaaattgttttagaaaatcatattgatttattttttaaaaaacatagctaatatttaattaatcacatgttaatggactgttcttttttgcatgtttgaacggagagttcccaactctaacaaaagaacatagcatttcccatactttcccaactcatctctctcgtttttcgtgcgcgcacttcccaaactactaaactgtgtgtcttttaaaaaaaatttatataggaaagttgctttaaaaattatattaatttattttaaattaatacttaattaattatatggtaatgagttattcgttatacgtgccgaagaggaggagggttaccaactcttctctgaatccagcctagaccctccctttcctcacctacatccctccagcttctctatcttgttgcagtactatttgtgacagagatggtgacgggggctgtgtccggtagcacgaaaaatagagctgtccattagcacatgattgattaagtattagctaattttttaataaatggattaatttgattttttaaaacaactttcgtatataaactttttgcaaaaaatacaccatttagcagtttgaaaagcgtgtgcgtggaaaatgagggagaggggttgggaactagaagttccgaacacaccctgggactgcgatagtgatggcttggtgctttgatgaagcctagtcttgcgctaattctagatccaacgctgataagctgatcactagaggtggatcggccgccacaaggcttgggagtgacggattcgccgccggcgagctgagaggcagatcattgccagcatgttggggagctagtggcctctactggcatggtgggtcctcgcattccatccgtccaaaaactgactctgcctcatcctcgccttcatgttggctattgtctactccctccattctaaaatataagcattttttggactctgatacggtttccaagatgctacttttaccaataatatataaaagtaagatgttttaaataaaaatagttacacattatgatagtttgtttaatgataaatctagtaacattaattttacatgattgatctgtcgaaactagatttcggcaatataaacggggtagcgcatgagacctacaagtggatggatgcagaaacaaggatttagacaggtttaggccctcttaacgagagttaataccctactactattcggggatttgaatccgccgggtgtaatattgatccgacgatctaattgtgaatcctctaccctagaggacctcctatccgccttatataggatgaggggcaggattattacgagatagaaaccttaaccaatacggtatcgattttctaaacctactttacaatattatcaaaccaggactttagactgttccgtaatatacaaggaaatgtaatacccaagtcatgatccgtacatattccatagatataagttatcctctataactagtcggataactatgccctgtgggtatggggtacccataatctccacgtgatcttttttatttttgttctttttaatagtcaaagttgaaaatgtttgatacgtcactgtgctaaaaattcttatattttgaaacggagggattacctcgctctctccttcggactagcttcgaagcagctgaagaccccaatccacatcttgatttgtgctgcgtgtttcccgtctgtgaagatcgatgtttcttaggcctttggttccgtgtggtctgtttacttgtctatgaaaattcgttttcaccgccagcgaaactaatttagtacgtactactccagtagttacacctgctttctgtacgactgtaccagtgttagcttgtgggttggcacagatttctcttgcacaattttagatattctggcttctagctagctggcatatgtatagtactgctggtacatgtcttggtgatggtctatatatgatggcacctcgcaatggagagagtacccacacttgagttgcattaatattgtgcttattgttgctactcaaagacccacatatctaataatccaagacaagccatggtcaatatcgaaggcgatttacacatgaccagtggggaaggagaaggtagctatgccaagtactccaggcgtcaggtgattatattgctcttcgttttattttattttttggctgtcaggttacatatatgtgtacaaataacaacatcatgacgtgtttggtttaccttggtaaattatgtttattgtgatttatcaaatatatataacaattagcttttcctcgtataataattattttctctgcatcttcttttctgctgaaaagcacgaatctctgtcgtctcttaattaattatcctcacagaaaatatatatgtgctgcaattaacaattagccataactattcgtagtactggagaaatttgtttagaagaatggatatatctgtcagttattgataatattaacctagcatctacatactatacaagatatacatgcattagacataggtcgacattgtataacaccatataacgtgtctatatcatgattaagagctcaaaattttcttttctgctcattgctagacaattgttatagatgaaactaagccagtcatcgagaaagctataatagaagtgtacaaggctattctccccaaaactatggtcattgcagacttaggttgctctgcaggaccaaatacgatgttcttcatgtccaatgtcatcaacatcatagcagaccactgtactaagttggatgaacatgatcctatcgaacttcagttcttcctaaatgacttaccaggtaatgatttcaaccaactctttcgatcactcgaaaagatcaagacctcaactacgatgtatcacaagggagattcgcttccatcatactacatatccggtttgccaaaatcatattactctagacttttccctcgtcagagtgttcatctcttccactcctcgtattgtcttcattggcgctcccaggtacgattattgatataaaaatgttgttgggaacatatcctatacacacaagtttcccgtaatacactccatacacagcaactaacaaatatcacagaaaattatatgaaaaattcggcacatactttcaatagtattgcacctatatgtgaaatcttatcttcaaatttattatattttagctgtaaaaaaatagagaaaattctaacagctttgtactctgaaaattgttagatttttcacttttttgttacagctaaaatataatgaatttgaatatgagactttgtcactttgcatatatgtgtcatcctattaggagtacatgtctattttttcgacatttgctagttggtgtgtatgggaaacttgtgtgcataggatatgtttcccaaagttgtttatgcattattgcatatatctgacgtatatacatgatgtgtaccaatcttgcatacatgtgatattgcttttaatttgtagctaacttgagctgtgaaattttctaaattaagtgatgtgtacatataggtgccagagggactagaggctggtggaaaatctctctcaaataaggacaacatatacatcagctccaccacaacaccattagtagtgaaattattcaaagaacagtttcgaaaggacttttcccttttcctcaagctccgccatgaagaactagtaaacgatggacacatggtgctaatattttttggacggaaggatgaggatgtatacaatggaagtctcagccatattttgggatgtgtcgcaaagtcactagaatcacttgtttgcaaggtaagagtagagatatcgctaattaacattctaagaagagatgtgctagtcagaattaaccattgattgatcatatagggccttgtgaacaaggaaaagttggaatccttcaacctacctatctatgggccatcagatgacgaagtaatggaaatagttatggaaagccatatgtttgacttggttcacatgaaactctttgaggcaaactgggatccttatgacgattcagtagatgacgttgttcatgacattgccagcagtagccaaaatatcactacgggcattagatctgtgctggagtctttgatagcaagtcattttggagaaagcatacttgacgtgttgtttcaagagtttagaccccttgtggcccaacaccttgagagggagaagacaaagtatgccgtcatcgtcatgtccttgaagaaaatatagtagcacgtgtggtccatgaatgtcctctctcttaattacgagatgcttttaaagagatcaaacacaatatggtgacatatatcgtaataagaacacttgtgtggttttgtttccctcctttcaaccatttgcaatattgcataatgctcatattctgtaaaactctagctaaatggattgtttctccattgtttagctatatatggtgtttggttacttggctatattgatttgcctcggcaagtatctataggttaatttgcaaaatgaacttcaacatatatatacaaataattataccgtgtaagaccattatgtcaattttaccagttatacatgaaatcgtgaatgagccgctatgcataattgccattgccaaactaatcagctaccatttgttcaagagtggttttcccactgaaaatttggtaacatgcaacgttaactagcggatccaggcaaaatggtcccggggatcatagactagtcaatagcattaataataagttgaacaaactaagaaaaacatatgacgacaatatataatacaactgtatatagatccctaatatatgatctcctctctagctacatcttcgcaggtgaattatcacatcatcatttggaattgcaggtagaaaaaacatcgcaaatgaagcatatacgataaaaatcattcataaatttatcatatatatacagttccataactttatcttcatttttttaccaggaaacagtgagggaagccccacggtaattttcattaattaaaaagaactgtacaaaggaatgatgaacgccacgatgcatcgaagaataatgatatggcctagccctatgggtggctatttcctcattagggttggtcctcgtccccaacgggagagggggcaggtgggaattcctacctgcgggtgagcgaggacgggggagagaatggacccgcaggtctcccagcaggcccccggagctatgagaaaccactatgaagacaatccatttaaagacccggctgatctattttggtggtgaaattgatagaaccatgtaaaagctgaaccctaatcaaccaaacctaacttcctatatccttcactgttccccttccatcgccgccaagcgtgctctccccatccaccaccaatccgtgccctcgccggccccaaccgtcctcaccacccctagacatcgtcgcatcgtctacgccgaccgaccacaactgttgcaagagggaacgactgatgtggttgtccgactgagggttgttgtaacgtaactttgatacgttgtaattatgttggattggggaggagcgtccataatcaatgtcccagtgatgtaggtttcagctggacatcgttaacaaatatcgtgcttctgtgtgttcattaaatttgaattttctatagtgtcggttttcaagatatatatctaggctgcgtcttataacaagctgtattagagcttgcgggagatcccaggtagaggtacgagggaggtgccccacaccacaccaggttacatatgtgtctgagataggactggcacaaggtggaacaaggtgatgatcaacgaagtttaattggtgggtcttcaggtggcgatctgtaccattagatgggttgcaatcaatactgtgaggactagatgtggtgttcggattgatggcagtgggagcgattggcactactccggtggtgtcggaaactttggttggatgactcgaactttcaggcgagctactatcaacttaattatcatatattttttatatgggaaaacctgtaaatatgatgatgaagaacttatcgcagttaattgtcaactggttggattcatatttatgaagtgtcttagtgccacaccaacattttgtgtaaaaaaagaggagcttgtaaaatccttggaataaataaaatctgagtttccatatcattcattgtttctgtccatactcatcttgtatacgattgtatactggagcgtctactttttattgtccaaacatagataaatatagtgatcgaaaagacgaaaacaagatgcaacgcctatagttagccctaataattaaatcttctctagggcttgtagtatgtcgtccttgaggtcctcaaacttttcgatcccaaaactaaacctcacaaggttatccttgatcccattctcggtcttctccgcttcactcttgcccctagtaaaattaagcacgaactaattatgccaacattaattaacacatgttacgtgcgtgcaccagattaaatccgttaaatgtatgaaattgagcgagcagttaattactccatcctttccaaaatgatcgatcatcatatatgtttatacaccaagactaaaaaaatcacctcaatcaagacaccatgcacatattctcccacaatgcatgtgtcgattaaaacatcataccaattataccttagcatgcacacattctctcatgctgcattacttgtattatgataaaatctatgtccatgtggttatatgatgatcaatttaaaaaatattgttttctattatatgatgataaatttggaaagggagtaatatttactgttgtcaacttaataaaacacaaacaagggtgcataccagtaggacatgatggccggctgctgcactaggctctcgcacccgccgagcgaagtcgcgatgaagggcaactccagcgcgtcgacgaacctcatcgccccgcgcatgtccgacgccacctcgaagctgatcacgccgccggcgccggtcatctgcttcctcgcgacgccgtgccacgggctgctctccagccacgggtagttgacacgctccaccttggggtgcctctccagcagccgtgccacccgcagcgccgtccggttctgcgcctccacccgcagcgccatcgtctttagaccgcgaatgatcatgtacgctgcattctgaaaaaaaaaatatgtttgttgttgtaacagtatataagtgaactgtaacaaaacggttaggtattgctccccccgtttcaagttgtaaggcgttttgactttatttaaagttaaactactctaagtttgactaattcggtagaaaatagtagtaatatttacatcaccagtatagtttcattaaatttaattgaataaattttcataatatatttgtcttggattaaaaatattactatttttcttgtccacatgagcgcccacagcaaaataaaccggcacctttatgaagaaatagatgtcagttttagagaaaaaccgacatcaataatatataggtaccggttttgttccacctctaatttattatatgtgccaattatttaaaaaaaccaatagctataatatattataggtaccgacacctctaaaaactgggccaagctcctctctctccagcgtcgacggccgcactgccccactgtgagcggcggcagcagcaccctcccccatcgtgagcggctgcggcgtactcctcaccctcaagatctggcggcgacagcggtgtccatagccttccgcgggcagacctggtggtgacgatggtgtcagcgacttcccagtgttttgttaattaatttttgtgatttttgcggtcaatgttgttggttgatggatcaatattgatgaatcattagaatttttgtgatttgtgtgggtgatgttattgaatgtgggctgctttgcgagtgatgtggaactgctcgatgcattagcttgaatcgagatgtattttttttttgcattatggaaccttaaggtgccagttcctaaaccgacacctttgaggaggactcaaacatacgtgatgtctaccgggtgccagttaagaaatccaacacccataccggttgtaaaatccgtcacccatggggtttcccaaccggcaccaatcaccttttgcatagtagtgaatacactttttaagttttagttaattcttaattaacgatgtaataatcaaccgctccgttatatgtaccaagggggaaggttcccaatcctcttaaaacaagaaagctagccaaagggttactggactgatggcgccgccaaggtcgtggtgccacacgcgtatgcgcgagatgagctcctccgagccgctgacgcagccggcgatcacgtcgtggtggcctgcgatgtacttggtgatgggagtggaggacgacgtcggcgccgagggtgagcggcttctggttgatgggcgacgccagcgtgctgtcgatgcacaccagagcgccccgctggtggcacagctccgcgacgcgccgcacgtccacgcacttgaggtgagggttcgtcagcgagtccgcgtagaacatcgttacctgcacacatgtacattctcgatcgttagaatattttatccatgtgtgtgtgtctgtgcatcggaatatcgggggttcgtgtgtcacgtacattgccctgatcaagaacggattgcaacgcctccatgtcgtccagatcgacgaacgtcgtctgcaaattaatgaaacaatcgacatcattcaatctgcaaattaatgtcatagtaggagctatatattgcaatggtgcgtgtatattaatatgagatttactctggtccaacaaaaaatatctcgaggtaccggtaccgtacggtattaaatcgtttctcaatgttggatctagctgggtaggatgggtattgttagatccaacgatcagaaacaatttggtaccatatctcaaaatactttttgttggatcggagcaaatctctattaatatagcttaccctaatgcccattttggagagcctgtcacgtatgaaggcacgcgcctcgctgtagcagtcggtggtggcgacgacgtggccgcccggcgggacgacggccagcagcgtcgcaacgatcgcgttcatgccggaggaggtgacgatcgtcgcctcggccttctccatggcgctgatcttgtcctccaggacctccacggtggggttgccgtaacgggcgtactcgaagctgtgccgccgccgccgccgccgcccgccgccttccctgaaggcgacgaggtcggccgagtcgcggaaccagcgcgccgtgccggtcacgatcggcgtcgcgatcgagtagtccgtcacctccgccgcgacgccgccgatcgcgcgcgcgccgccgctccccggcgtggacgacgagcgtgtcgtcggaggtgtgccgccggcgccgctgcggcgtcggagcgtcatcatggcgatctacgtcgtcgagggtagtcttggaagtccggcgaccgagggcaaagcgtggcaccaaagatatcggcagctccatcaacggtggcgagaagaaccacgtacacctcggagttaattaagctcagggtcagggacgagcgcggccgtggctacgtgttcagccttgcagggacaaacgacgagggcacggtgcattcagtgcatgtgccgttgtagtgggagtggaattgtaattagctgtttgacgtccacctgataattgtttattaagtactaattaaatagttatgaaattgctaaacactattatataaatgattttcttgcatgagcatccattagatcgccggtgggccataagtggctgcacctgcaaaaaaccaatccccaggaacgggttgacctaccacacgtcaaggggggtggctgaagtgcggtcagccgcgagcggttgcacccgcgcggcgcacctcctccctttagcctcttacgtatctacgtatgtagataatacgaatgttatacatatgtatacaaagtatatacatatatatatacatacactatatatatatatacacacacacattgacgtataaaaatgtatactaaattgtatatatgcatataaaaattttatatacacatgtatacaaagtttgcatacatatgtatactaactttgtataaatgaaaaaaatacaccatatatagttcgtatacatatgtatgtatacaaactttatatacataaatattaaaaaacaaaaaaagaaaaaaaaccaaaaataccgaaagaaaaacgacaaaacagaaaaaacctaaaaaaatgaaaacacctgaaccaggctaccacttgcgcccctcccccgcgccgttccaccgccgccctctgcatgcacgccacatagctgcgccgcacgggagaggcggcgcgcagatatccttgtattagggatttcgcaagcgaagaccgattatcatcagcggtcgcttaagaggcccgcacgcgataacgcggccaaatctcatgcgaccttcttaagcgaccgcatgcaataatcgatcttcgcatgcgctcccttaattaagatacttgtaggtgattatggaccatatatcttctcctagcctaagttgccgccatttgaaagcgatgtttctctctctaaaacgaagatataaatagggggaggtttttcaactcgaaatatttgcttgcaatccatataaaaagttacatgcttcatttcctctttcatttgccgccttttatttctcagtttattggtgaaatgtgacaatttttatagtttttttaatggaattttaaaaactattttgctatatttagtgcaaatatattgtttagatgaccaaaatttttattctaatcactagttcttgatgcttcaatgtattgtagtttaaatttttaggagatatttgtttttccatgatgtgtgagaaacacatgcactaaaattttattcgtactgtaattatttataaattgattgggcatggatgtacgagacgtggataactcatccggcgttcatgaaggaagcatcaaaatttactgatcaggcaaggcatatgccccgagggagaataagagggatatttttctgtccgtgctttgattgcaagaatcagaaaatgttgaaagatccgaagataattttgaagcacatagtgaagtgtggattaaggatgattacaagatatggacatatcacgaggaagttgccattcctaaagagactcttgatatatatttccttcgatggggcagaaaattttacaatagaggacatgtcccgtgatatggttgatgaatttggtggctcggatattgatgatttagatgctgattttgatttagaggatatgttatgccatgctgaaccagaggttctaactggtacaatgcaatggttagacaattgggaggtgttttataaatgagcgaaggatcttctttacgacgaatccaagacatgtgataaggattatatggtgctatgttatgtgctagagcttctcagattgaaagctagacacggatggtctaatactagtttcaacgatttgatgggtctattgagagttatggttcctaagcctaacttgttgccattcaacacgtatcaagcgaagaaactgattttccattatctctaggtgttcaaaaaaatccatgcatgtgttaatcactatactatactacaaggaatacactgacttggacatgtgcccaacttgtgggacgagtcggtacaaaagggtaacggggcctctgatagtgatgttgtcgacccagttttgttggtggatacaaagagaaagattttggccatggtgatgtggtacctgccaatgaaagatcgcatgaagcacatgttctcaaaccctatcaatgtcgagttaataagatggtatctaaagaatcagaagatagatagatgatatgattctgtagtagtgaaaaatctgtagtatttttttttcaaaatacttccaaatcaaatgcaactacttgtagtgtaatacaatataaagttgcattggaatctctatataacttataacttaggaacaaagttgcatatattttttgtaacatttatatataggttatattaaagttatagtatagttatgatataattatattacaactatactatactgtagtacatttgaaagttttccacttcaaaatacttgtggtgacattttagatagtcccaatggttattaaaaagtttcgaagaaattgacaagatagattaatatgaagtatatcacttcacaaatatgctagatcaaattcaaattctacaagttgtaacaaaaataataaatttaactgtaaatatgtgtatactaattagaatttaatctgtcatttttgtaacatcttgtagaagttcaattcaaatttctatgtttgtgaaagtgacatatttcatataattttgttcatagctgtttagttgatataattaaatgggtggatgtccacgtaagttgaattcaaatcaagcgcgtaagtaagacaataataatgccaaagtattccatgtctccatctttttgttcgtttgcagatatggatattataaaaaattgatggaccaaaatgtataaatgcataaattactctcacggtgcaaaatatttggtaaggtcaaatagataaaataatatttagttttggtgtagcaacttatctctggtccgtgcgaaccaaggcaaaaatagtgcacataaacgaaaattatctgaggtggcactcatattgatggtacgtagacctgcggtacatagttgtacactactaagaaaaagacacgtatagatcggcactataggtgttggaatagctaaaactggcagccgagccgggagcctagtctgaacttttttagcgcaaagcggctgagagaggggggcaagtggataagccccacactcgcccatctctctctctccccctcaccccctcagcctctcctcccctccatctcccgtctccgcggtccctccacctcccctatccacagctctctctctctctctcccctaccctcctcctcccctctatggcgtcaacaacggttgggcggcgtaagcggtggctccaagcatggatctggcgttgttggcaagcggggcggcgtcagcagtggatccagcatcggtggcgtgtaagatagaatcggtgacggatcagacatctgtggcatgcgaggcggcatcagtggcggtcgggaagcagcgacggcggctcctagcacggatccagcgtcgctggcaagcggggcaacatctgcggtggatccaacatcggtcgcatatgggatgatgtctacgttggatctggcgtctgtggtgtgtgaggtagtgttggtggtaagcgggatggtgtccatggtggatccggcatcggtggcatgcggggtggcattgctggtgtgcggggcaacgtcagcggcggcaggggcgatgtcaacggccattcccacaacatatcaagcatcatctgcgtcggcggcgggcgagatagtgtcggctaccgttcccgcagaggatggtgaaatgttcaaatacagcaaagtgcaaaatgaataaattatggcctacaacaaagcccatcatgcgtcgtcttcctctatttcaatgattggatccgtcttcttcctatacagtggttatatccgccttcttcctccactatggtgaatggatccgccttcttcctctggcatcacctcacgtgtggccagacggagatcattggcagcaaagtagacctccataatgagagaaatcaaatcgtcacgatacgagaggacttgcttgatttgtcgccatggtggatgagatctgcccacacacaacgtatattgtctcacttgtatgaattgaggcaccacgggaagtgcggaaatgtagtggagggtcacgtcttatttttgttcccgtgtcggatgtgggacatacatcatttccctatagcaaaaccaacatcttttatacaagtgaatttcaattattgattttctttgttttttatttttttgattaatctagatgcataattgtgcttatatacattatattgtctaatttcacattggtatgaatttaaaccaaagcatacattatttcatattggtaagaatggtaagaatttaaaccaaaacattcttttttttaacatttaaggatggaaccttatttgtttcaccataagaaagaatatatgtaagtgtgaacttgttgatcacgccaaagtatcgctgcctcgattaccagctatgtttcttcaggaatcctactttgtgcacgttacctagcaacggaattagtgcaagccttatccacttatcctttccccccatcgctcgatccctttcatccatggttcctcctgtgattcttttcttccttctacggttctcgctttgtcacctcccggccggtgacgcaactagcttgggcaccacctacttacccctctaccttctcttgaactagacgatggcgagctaatagcatcctggtggcatgcagcacatatctttttcatctcttcagcaacactttgcttcaccctaccccgcctcctccaccacggcatacatgtaagcctagacttttgtgtttcgatgacctcctacctagcatgctgattcaccctaccccctcttcctctaccacgacacgaagagatgcttacaaccgtaggctcatccttccgagtgacatgtaagtgcctcttttttttcctcctctttatctgatccagataggagtatccctagaaacttccactgatttgagtataaagttttcagttgaaacatttcaaattgaaataattttgatttgaaagtttaggattttgggtagaaacttttgaatttttcaattgataagtttttttagaaagaatgaatcggtagttatagcccacaagtttaaaggttttatatttttaattaaaaattttgccattttttagatgaatgttttgagattttagttggaagtttcatatttcagatcgaaaggttttttacacttagttgaaattttaattcagattagcaaaaatgcttgtgcgttgcaacaagtgaacataattttcatgattgataaaaactctaccagtttaaacgacaaaccgaaacaagataaacaaaataaaggtaaagcaaagccagaaaccatatatagtattgaacccggttgcacttgcttcatgcatcatcacacaaaagaaatcccttatctacacatttccatagcctaaaaaatcgatcgggtcgctattccataagttgatacatgtgtattttgcagtacgttatcgactaaagattgagattttgattattcaaattagtgaaattctttttacatgtagatggaaagcatttgcaaagcaacaaactttctgcatacacaacttaataataatttcaaaaggaaaatattcgtgggagaaaattttgggagagaaaaaaagaggaaaaagataaaaggaggaggaaagagaggatatttgtaggagagggagaggacatgataattggaaaaaaggaaaaggagaaatagaaaaaaaaaggagagaaagaagacgttgtcgaggtaggggtgcacggcgccgagtggaggcatgcgggacggtgtggtgggatgatatgggtcagttgggttgggctgagagatggagggggaggggttgggctgggaaggggtgtcttttttttttataatgcaatagagtgccgacatttgatcaacgagctacaaccaattattacataagctcgcgctagaaaagagcacataaacaagtcttaaaaagcacaccgaaaaaacctaaagcaacgacaagctaataaaagcccacaaaacataaagaccctttaattattgaatcctatttgtaaacctccaaccataattggccaaaaactgcaagaccatcgacttaacaatgtgatatctagttttagctcggtgtcctcatcacacttttgtatctaaggctagaaccggagctaatacgttaccctaaagataacctgcatataagatgaattggatacaggtgactaaaactaattaaaaaaccaacactaacactgatgacgtaccaatttttttacgaaaacatcctcaatttttttaatagtaaagaagagattataaataaaaacagtggatctcaagttctatcccctccggggtactgcatacgcgagttaagttcgacgtgcggctgcacgaattagcagcccctatgtttcctcttacatatgatgagaatacgattaaatataaattacctcttcgcacatgatttaccataaaattccgttaaataatgtattcttttatgagtgatatgatcgatgatcgatacttttctgcatgttatttggttctgaaataattctaattaatgggattagcagtacagtatagaatgctagagggcggtacagacgttaggggataatgttacatcctgacccacatccggcggcgccgagcactaaaatctcgtcgcgccggaacttggatgccactaccgtcttcccttgggtcccacggtaggtagctagcgacaccaaacacagctgaatcctccagccaaattcgccgccaatttcttggatctagctagatcgtgccattgccacacgagaacctctcgatgacgcgtcatcatatcgctctcgtacgtccgaggatgcagactgatcgtcctgctatacgtacgcttgaatcgaaactggacatcgttggatagacttgttgggggtagttctcatcttgttgaatgccgtgccgctgtcgattatttctgagattctggccggccgcctccacgggtcgctaacacagcaccaatgatcgatcacctttggccattgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtgatcacatgatccgaacctttcttgctaactaacaccctctctcaatccggacctaaccaggttcagattgcttttgaaattctccaggagtcttactgacagaggtttagtgaatccatctgcaacttgatcattagtggaaacaaaatcaatttctagaagtttctgacttacccgttctctgacaaagtgatagtcaacttctatgtgtttcgttctggcatgaaacactggattagctgacaaatacttagctccaagattatcacaccatattttagcagcttttggacttttaatctctaactctgcaagtaaagtctgcacccacattatttctgcagtggcattggcaatagctttgtattctgactctgtgctagatctagacacagtggcttgttttctagcattccaggagaccagatttgaacccagaaatattgcaaatcctcctgttgatcttctgtcatctaaacagcctgcccagtctgcatcagagaagccactaactaaagtagatcctgacttatgaatttcaagtcctaaccgagtgcattgctttaagtacctaagaatccttttcacagcaatccaatgtacagttgtgggagcatgcaagtattggcaaactttattaacagagaaagctatgtcaggtctagtaagagtcaaatattgcaaagcaccaacaacactgcgatagtgacttgcatcttcaggccctaacaatgagccttcatgaagagagagtttctcacttactgaaagaggtgtattagcaggtttacaatctatcatgcccactttcttcaataaatcattggcatacttgtcttgattcagtacaatgccattctgaaccttgcttacctctattccgagaaaataatgcagctcaccaagatctttgagtgcaaattccccttttagatcctgaagtaaagctgcagtggccctctctgaagagctggctacaatgatatcatcaacatataccagaacaaacatagttatatcacctttattcagaaagaacagagacgtatcagcttttgatcctttaaaaccaaggtccatcaactttttacttagtctagagaaccaggctctaggtgcctgttttaacccatacagagctttatcaagtttacacacatgatgtggcttagtaggatcctcaaaacctggtggctgtagcatataaacttcttcttctaggtacccatgcagaaaggcattttgaacatctagctgtctaagactccaacctttagacactgctaaagacaatattattctgatagtggcagctttaacaacagggctaaaggtatcttcataatcaataccatacctctgtttaaatccttttgctactaaccttgccttatacctatctagggtaccatcagctttccttttaattttatacacccacttacagccaataatatttctccctctctgaggaggaacaagatgccaagttttattcttaactaaagcatcatactctgaatccattgctagtttccaatttttatcctttaaggcttctaaatcatttgtaggttcacctgaagcagtaaaccaagaatgcttatatttaatagtaccatcagtatataccttttccttgcgaactccactttgcaacctggtgcgcggtcctgccggtgcctctgaacctgtgtcagtcacatctgcatgctgtaatgtattagtctcatctgtgacagcctgtgcatgttcctgcgctggtgaggactgctcctgctcctgcaccacctgcgactcctgctcctgcaccgcctgcgacactgagtcttctgctgtctcctctgctagcgatgatgctgccccccgtggcacagaaccaggtgtgggacccggatgacggcctgatgacgtggccgcaggggagtggtggacgacacggtctggttctggaccagaactggcatccagaggaggcgtcgccggcggatcttctgcatcagcgggatgtactgcaccatctctatgtggctcattagcacgattagataaagcagcagaaacatcagcagataatggattagtcactggatgcatgcattgttcattcccaacagaccgtatgggtcctagcagttcaggagtgagaatatcaatctcagaacgaagacgggcaccagcattggcatgaagttcagtgaagggaaaaatattctcatcaaagacaacatcgcgagaaatatagatgcgtcctgtagagacctcaagacacttgaaccctttatgcatagtgctaaacccaagaaaaacacaatgcttagagcgaaattgtaatttgtggttattgtaggggcgaagattaggccaacaggcacaaccaaaaattctcaaggaggagtaatcgggtttttgtttgaacagtttttcaaggggactaatattatggataactctgctaggcacacggttaataagataagttgccgcctgaaaggcttcatcccaaaactttaatggcatgaatgcatgagataggagagataaaccgatctcaactatatgacgatgttttctctcagccgacccattctgttggtgagtatgaggacaggaaacatgatgaacaatgccaatcttagaaaaaaaagagttaagggattgatattcgcctccccagtcagtttgcatggctagaatttttctatcaaattgacgttctaccatgacttgaaactcctgaaacttgtcaaacacttgagacttatgttgtatgagataaatccaagtaaatttactaaaatcatcaataaaactaacataatatttttttctcccaacagactctggagcaggtccccaaacatcagaaaagacaagttctaaggggtgtttggaaacactggaagaaataggaaaaggtaattgatgactctttgcttgttgacaagcattacaaactgactcactagacaaatctgaacaggggaggctaaacttattgactacttgtttaaccgtggtaatggaaggatgaccaagacgatgatgccaccggtccaaagatagtttgatggcactgtaggcttgcttcaaggaggagtgtggtagaggatatagcctgcgccatgatcttcccttaaggagagttttcctggtgatttgatccttaagaaagaaataatcacgatgtaattcaagaaaggcagagttatcattaactaagcgatgtactgaaacaagatttttcttagcttgaggcacatataaaacatttctaaggtggatattacgactattgggattatgaacaatagcatgaccaatatgactaatatccatacctgcaccacttgctgtgtggatttgttcaccaccgttgtatttttccttcatagtgagcttgtctagctctcccgtgacatgatctgtagcaccagtgtcgatgtaccaatttgtgtcaattccataggagttaaccgctgcagctgcaacatgcttggcgtcaggaacgtaatcctcgtcgtacctataccaacaatctgctgccgtgtgcccccgtttgaaacacacttggcaaattggtcttttatcaacgcctcctggtgtgcggcctcgaccacggccacctcctccgttgccgcgaccatggccgccgccgtcgccgccgccgcgcgaacctccttggccaccattgctgttgccacgccccccgtggctgaagcctccacggttgacaacattgacggtgacctcctgtgcgccgcggtagatggcttggcgagcttcaaagttcaacacttgagagtacagatcactcacagagattggttcaacccgagcgtagacagccgacaccacctcgctgtagccctcgccaaggccggtgatgatatactgaatcagctcctcttcatcgattgggcgacctccggcagtagccatctcatctcctaaggatttcatttttgcaaaatactcaggagttgacatgttacctttctttgtattggtgagagcaaaccgagtgttaatcgctcttgctcgtgtgtgggtggagtacatctgctcaatggcgctccacacttcagccgcggtgtcgcatgtagcgacctgcatcagcacctctcttgtcagcgacgagagaaggtaccccagaacttgctggtcggtggcttcccagtcttcatgggctgggttcggctccttcttggtggcgccatcttttgtgacagcgatctctgccggcggccgcttggttgcgccggtgagatgcccctgaagccgcgctcctctgactgcggcgcttacttgcaccttccagagcgcatgatttgccctcccaagcttctctgagattgggtggccttggaacggatttgtggcagccgtactggacgacaaggccatgagtattgatctcttagggaattgatcaacgctctgataccatgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtgatcacatgatccgaacctttcatgctaactaacagccataacttcttttttctttttttctttctatatacaggagacacatgcacataccaatatacacgcaacatgacattcacatctcatgaatgtatctcctaacacacgctataaaagacagaaaccatcatcacaacccctatcttattaaaatcttacggaaagccctgtgtaatcactagtacagatcctatcatctgtgacgggctcaattatatctgtactacttgggccgtcagaacgaagtcatctcaattatatctgtgacgggctcaattatatctgtactcactctaagcccaagtacatatagcccgtcactgataacactcatctttgacgggcaaagatttaggcccgattgagatgacctcgcatatctcaatagggcctagacaccgagcccatcagatatgagggtcatcggtgacgggctccaaatatggcccgattgagatgactttaaagcccgtcaccgatgattcatatcggtatcgggcttttgttgatgcccgttagagataacttttacttaggtcatttttttatataactttttttctgaacagcttgagtttgaatttgaaaatatgacaacttcaaacaatatttttaaatactaaatgatttcaaatgaaaaaaattatcaacaacaaagttacataacataccaatatttacaacttctatttttattttggttatttttctatataaaatttttttttgaacagtttgaatttgaatttaaaaaatatgacaacttcaaaacaacattttcaaatactaaatgatttaaactaaaaaagtcatcaacaacaaagttgtataactcatcgagatctataacttttattttggtcatttttctatataacgttttttttaacagtttgaatttgaatttgaaaatatgacaacttcaaacaatattttcatatactaaatgatttcaactaaaaaagtcatcaacaacaaagttgcataactcatcaagatctataagttttatttttgtcatttttctatataacgttttcttgaacagtttgaatttgaatttgaaaatatgacaacttcaaacaatattttcatatactaaatgatttcaactaaaaaagccatcaacaacaaagttgtataactcaacaagatctataactttaatgtttgtcatttcttcatccgataaagtgctagtaacattgttcacaaaatttacatacatgttttatagtttataaactagatgagagatatgtgaattttgttaacaattttactatcactttgtcggatgaaaaaatgaccaaaataaaagttatagatcttgatgagttatacaattttgttgttgatgactttttcaattgaaatcatttagtatttgaaaatattgtttgaagttgtcatatttttaaattcaaattcaaactgttaaaaaaaatgttgtatagaaaaataaataaaataaaagttatagacactgatgagttatacaattttgttgttgatgactttttcagttgaaatcatttagtagttgaaaatattatttgaagttgtcatatttctaaattcaaattcaagctgttcaaaaaatgttatatagaaaaaatgccaaagtaaaagttatagatgttatacaactttgttgttgatgatttttccatttgaaatcatttactatcaaaaaaatatttgaatttcttatattttaaaatacaaattttatatagttcaatcaaacccggatggagaaatgaccaaaataaaaatggtagatctcaatgagttctacaactttgtttttgatagttttttcatatgagtttcatttagtatcataaaattgaattcgaaatttattttttcctagaagtctgatttgcctccttctcatgataatacttgctaaatatatatttgatccaattaacttggatttgctggtgaaatatgtgatcaaaatagatgttatgtgaatgaatgtatatgaataggggatgctagggtgtgacatccaggcccagggtttaatattattaatagaatactcataccaacaaattacaatttctttctcggaagccaatctccaaataacttggccgatgggtgacctatcgggaaggcacacaagtgaggttcaaatgggtgaccgaccgggaaggcacacaaggctaaccaaaaaacaaaatttattttttcgtggattatactcatctgtgacgggctataatctaggcccgttagagatgagagtcatccgtgacgggtgataatctaggcccgttagagatgagagtcgtccgtgacgtgctataatctagacccgttagagatgagagtcatctgtgacgggcttttgtattggcccgattgagatgtgtcatccatgacggccggatgcccgattgagttacggttttgaaccggatctggcacatatctttccttccaaagaaaggtgccgcaaatagttgccagttttaaactggatctggcaccaatctttccttttaaagaaaggtgccggtttcagctaaaataactggtacctatatatttattagacatatcagctatgagctcagaatatagcttatcctcttccgtttgagctgatcgagtaaagaacaaaggggcgcctcttgttattgctcgaccagctagaggatggggaggttttgccctaaattaaaattgattgctaaaaggttattttttttatttctcactctattccactcttgcttgttgaattgaactgtttgctatgtatacatataaagtgtgcaactgaaacaattatgtgtatttgttttctaggggtatttttttatctgctttttttattaaattagatccatcctcggatgaccacatgacatttttgaatttaagtattgacatgacggtagttgattttgtacataatattaattattaggggctttaaataatattcaaagagtattatagagcacaatgttataataattaaataattgaattgcttgtaaattacaaaatcctaactgtattattctgcgaggtttgtaataaacggtaaattattggatgcgactacacgtcggtcgcccgatggaaagctcgggaaatcgggcgaccgacgtgtagtcgcatccaataattaaccgtaaattacaaacctcgcagaataatacagaaaggattt

SEQ ID NO: 67303 - DNA, 1228 bp, Oryza sativa
ctcgccgcccgcggccgtgtccgcgcgcgccgtggccgccgtcgccaacctcctcgccatccgcgacacggagatgagcaggtggagggggctagggttctcagtttttcttcttcttcttctgcgtgcttaattctcgaatgaataagactatttgttctgccattcgcattgccagtgagagatatgaacatctaacaagtcgatctgtttagcatatgcggttttatcctcggcattgggtgaacttcgatgaagttgtaattccagtaggcagttctgttatgcgtaatgctgttagtttagtaggccaaatagcaggaacatgtaatatgtctggagcacatgctagtttagctttcatgtttggttctaatgcagacaaaaacttagtttgggatgcattattgcaacaagaaacaaacaatttgatggtggagaacagtaatgttaggcttcatactttcatagtgagtgttctggtgattctttccttttgttttcattgttctctgattactttgaaatggtggttgtgcagctttgttgtggccagtgcggacctgtcgctgaggagagcagaggtggaggagaagagggacaaggtgcataaggaatcaaaggcgcttcttgattacacaaggaaggccatcaccaagcttactgagctcaagaagtgagtggaaaactattcactttcagtatacttaaggagatttgtgcaaccacttatatctcttgaggaaaatataatgaacaatgtatcatttgaaggatgctggaaaaatttaaaaatgatgtggagaagcaacaagcagaacagatgacggattggcagacaaagttggttatgatggactcaaaggaacgccaatatatactccaagtctccaattataaggtgactagtttttcttcttttgcaagtggtgtaatcagtatatggttttagttcttcttttgacctgatagttttggccgactaccactaaacaaagcagtttctgttgctgaagcagcatatggtgtttgctagagattgtcaactgttagaacttagaagtatatagtcagttatcatttatcaatacttgtgcttgtgagtttagcaggatgctgcaggacatgacatactattatcaagctaaccgtacaactttgaaatcatttcaatccacatatttcctgaatcttgacctgaagaggctgttgatcagatgcttatctg

SEQ ID NO: 67304 - DNA, 20728 bp, Oryza sativa
tatagaatactcgagctgccatgcttgcaggtggactctaaaggatccccattcagccatgaggaattcatagatttacatcagaggatagacaagtcaatgaagcaggtggaaacatggcagcaaaaggcttcgaaatcttgagtatagcaagcattgagagtcctctgtttttcctttcctaccgacatgcatataaagttttggtcaattattcagggtcaatggtcaatacgcatattctgtagtggtaataatcgagagtttttcttatgagattgaatcaaatgcataacatatatagaccttacaaatggttggaattttaaaaaaaaaccccccccccccccccccccctccaaaaacaaaaggaaaaaaaacacccttcatgcttgttaaggaaatttttacttctaactgtcattttttatactttgtttgagctggaaagaaagaaaggattttgaatcccactggaacagtattcctgaaagtttttaccggtcattttgtaccaattttatgagaaacaaaattgctatgaaattcttagatcatactttctataataattaattatttgaggaaatttatgattaagggcatgtttggggagattctagctgttgcagcttctcccagaatcagaagatcccttaaacagtcagttttttatccagattatgagaagctgtagttgtagaatccagaaaatgaattagaagccagaagctgggtagattatgagaagctgtagttgtagaatccagaaaatgaattagaagctagaagctgggaaacctagctactccatattttcagaagctagctaccaactagttactctcagaatgttaagctttccccaaacaggccctaagtacagcatatcctagccgcccctttctcaagggaaatggcgcaaggctaaaattagaccgttttatttgtcttgccctgtccatagaagtctttaattttagctgccttagcggcttcaaaaatgactcactatgtccataaaagactttaattttagctaggcatattaagtaagatattaaaagatcaatatgacattcattaatatggagagaaaacaagaagcagaggcaaataaggacataaaggaagtgtaacgccccgatttccgcgtggcgttaaaagctaattcaccgaaaaccctaattgcgaaagttttgattcttttgagtgatgagtctaagttgtgccaaagatcacaattaaaatccctcaaatgtctcgataccctgttatcaaagatcgtctccacaaaatttccatcctaatataatcccgaagtttgatcccttctattcggagttccgtcctgaaaccccacccgtgaactttgtcgaatgtccgaaccctaacccactccaatgattcacctccgattcctaaactctctcattagttccttcaaaccgattctcaaatccgaattcaatctctcaggttttgattcatctatctttctctctttatcggttcgtcaatctacccttgttttccttctcgaacttctgacccaagtctgaatatgcaaatcgagaccacttccacccttgaactctaaaccccaaggttcaatccctttcgccttgagttcttcccaaaaggatatccgttccgaaataatctcgaagtccgaacccttctattcagacttctcttctaaatcccttacccgcatatcccgtcgagtagtcaaactcaagctcccaagttacaatttctttctctaaattatccatctccctttgactcgtctctgaatattgttcccttccttgactcctttctattctcccgagaccgagtatcaacttcgaattcgaatccagactccagccctaaaacctctccaattaaacctctctgtgaacgtctaatttaccccccccccatggtggtggattcccttctttcatttcctcccaggtccacctcttcctactcttccggcccatatctctctccctctaaagtctagacctatcaaatctacctatttatttcgcccctctctctacatcgatctacctagcgatctatctatcgatcgatcgatccatttatctatctactatacctacctatctgtttacctatccatccgtcaatccatctgtctatccgtccctctacctatcgacctatctctctgtccatctatctatctatctttgaactctttcccaaacaattgtcccaactccaagaatactaggttccttttgaatccctctcaaataactcttgagccgccaaacacagaaatattccagaaatatataattcccgcctttgaagcccttccatgacacccccatatttgccaggatcatatatccgattggaatccaattcccgactcaaatgctcctcaaattccttaaagaaattcccccgaaagtctatttcacctccctcttggtcgttgggccgtttttccctttgccggcccatctccacctctcggccgctcctcctcccccgcacgtgcgttgcacgcgactgagtcgaaagagagcgccgctctctccctctctctcggtttctctctctctctccctcgatcgatcgatgccgtccctctctctctatttctttctctctctctctctctcacgcgccgacgctgatttcccaccaacatcgctcaaacctccaccgccttcgcccgttcccgcgcgctcgcgcgtggccgaccgcccggccgccgccgcgtcagccctggtcccgccactagccaccaaagcttggaggcagagaagctcgcctcgtctgccgcatctcctcaaaatgggaaaagcaaaaccccccctttccactgcctcgtcctccctttttccttcccgagctcgaccgctctccccctgtcctcgtctctttgcacgcagaggcagagcgccgctgatgatgccgcagcagcttgcgcccccactttggccacactgcgcaaatcctcccgccctcgcgatttgattctcgccgtccaacccaccgcctccaccgcgccctttgcatctacgccgtcgctcgttctcgcgccgctcgtgactgcagccgagcgctcgaccaccaagtcggtttccccctccctaaaccgacctcgcctccgctataaaaacccgagcccctcccatcgccctctctcgttgtctcgcctcctctgcatgccgcaccattgccgccttgacctctcgtcgtcgccgtcgcgcgtgctggtgaagccggcgtgcgcgcggggagcggaagaggactccgggcgccatcccttcttccccttccccggcccgaggccggagagctctcccgcgccgccgccgctcgtcacggcgccctgtcccgacgcggtagccctccgttcctcttcctcgctcaccctctccctcctatagctcgcacagtagctcggatagccctccggtagttcgtagaagcccccccaagccccgcagccgcctggcatggcctcgccgccattgccgcccgctcccgggggccgccgccgtcgccagccctcctcggtgcctctcctccccatccggcgcctgaaacggattccccgagccccatagatactcccaccgccttgaatcgaatcctcatcgcccctccgccgtttcccccttttctcgtcgccggcgtgcgccgccgcgattcgtcgtcaccggcccctcttcgaaggatccgatccgttggctcatcccctctcgtgctcccctttgtaccggtgaactccctctcgatcgaatctccgcgtcgtgcttcggtgaagccccgccgtcagccgccgttggttggagctcctgtgcatcttcctcctctcgcgcggcccgcgtggctgccacgtaggcgccacgtcggtgccaccttggcaagaccgagtcaaggcagcccagtcagcctccccctccgtccctttcccctgtgcgcgcggtccacgacaagtcgagcggctgcaagtaggcccgccgcactcccgtccacaccggcgcaccacccaaaccgcgtccacccaaaccctagcgtcgcatcccgcgtgcaccccttccaccgtgaaccttgccgccgacaagcaggccccgcccgggaccccgcgcggtggaccgcgtacacccggtcgaactccccctcccacgcgcccctaatggaccgatcacccgcgcccgcaccggcccaatggcctgaccgcactgcgcatgaccccttgggccgcgcctaagccgcccgaggaagtctaaatgacatccctcctatccttttcttttccaagggatttaatataaccttttccctttgttccataaatcaattccttattccaaaattccataaaccatttcctttggtccagcacgtcagtgactgtcaataatgttcttgagaatattatttctataaattccataaaccatttctctattctagaaattccatttaaacttccgaaattcatatctctcaatccgtagcttcgattgactccgttcaacttccagtaattccgtaaaattgagatctatctaatggtactattaattagtctaaataggatctttcttttggtcttttgtttaggttttcgattgtttgcgtatagttgcggttgcggatttttgtcgatcagggatttctcgaagattcgtgagatcaagaccctgagcaaggcaagccacctttgaacatcttgagcctataattgaacttaattatattgcttgcaaaatattatgcattgataggattgcacataatatgtttgccccgtctgcgaggcagatcagtgggcatacctaacttgttgcatttgatccttccattgttaaattgttatatcatgtttccttgtaaccacctggtcgagcctcggtattcgtgcactcggtgcgagtatcgacggtcgccgtcaaacttaaaatatggtaaacatcttgggtaaaacttggtttacaaaacgattggaaaacccgacgcctggatcggtgccttgtgaaagaaattgagatttaaaaataaaaatcgtgacacaaggccattcctgggcggaatgcttgtgcggtcgcatttaaggaccgattccttcataattacatccgagcatataatagtgcaaccacatgggtggagtgggacacccctggctgagtaattagctaatcaggggagccttgatgccgagagacaagtggattcgccggggtagtgtcggggaggacccctaggcttcctggcacagtatggtctgggacctaacctgttgttggtctgggacccttctcgtcggcatatggtaaacctgtgttggctttggaaatgccttgtcatgaaagcttggaggtctcccgacgtggctgatccccacaggctgggtgatccgggttagtaatgtcatgtgggtaaagtgtaccccctctgcagaggttaacaaactgttcgaacaaccgtgctcacggtcatggacggatgtgaggtgattccttagcgtagtttttcgttttacccagttttatgaaaaagtgataaggtttgggaaacccgatatttggaaggcaagtggctgtcagggagacagcgggacagggagtccctaaaagtgactggttgtttggagacaaccaaaactctgaaagtctagaaaattggtttggtttgggaaaccagctttgaggccaactctgggagttgtgcaaatcttgataaaataatattgttcactcctcacccccggccgagttgagacttgtcttgctctggtcgcggaatgcacacacttagattgtcaaaatgcttgcaaataaaactgattgaaaaataacagccttcccttgaagcttgcattaaccacctaagttcccctggcttgttgagtacgtaagtactcacccttgctctctatataaacatagttctgccagctctgaagatgaagttgaagcaaagattagggtttcatcctagttcccagccttcgcctgtggtgttgggtgttagaccgttggttccgctgctgctgttgttgttgttggtgtttcctcgtccgcgtcgtcggttgtattctcgggctgttctgagctgtaacctaagttaaggtaaataagtcctctatttaatttaaggattgcaatgattcatatttatcaccgtgggtaccagcgctatatcctaggactggtactgagattgcggtttcgtaggaagcggttcgcaccgtttttcctacgacacgctcctgtcaggtgccgttgtacgacggtaccgaattggggtgtgacaggaagtaccattggttcgatggctaaaataaaaagaaaaagatcaagtagtatttaacggatttaatgaacaaattttcaagcttaagagagtttttagggaccgatggagtatagaggtatattcaaccgcttcaattaggatcatggttttttttacctacttcattggattattgttacaaattatatgttccatgcttctaaacatatgttattttttagactactcgtggcgtcgctgcccaggcgccaacttgtgtgcgtgccaatttgtattgatctgcgtgttcaccttcatttcttttctctagtaataaatattaagttcctgcttgttatccatttatttgttttaaaataatgttttttgtgaaaaaatgttcttctatttgttaaatttatttattaaaatatttaatttattctctataacatagataattcgacacaataatcggatggctagtctattttaagtggaaaatctaggtatagcatagaaagccactccttccatccgttctaaaatataatcgtttataacatttgaaatttgtactataaaaatataagagcaagtataataaagagttataagaaagctgaatgctgagctggatgagagaggagaggagagatattagaagcggactgtaagtttacagccggcttaggcacatgaacaaaaaaaaaatatgtgagacagacaggtggaccatgtatgatggttcccaacctctccttctcgatttccgcgcgcacgcttttcaaactactattttgatgtgttttttataaaaagtttctatacaaaagttgcttaaaaaaatcatattgttccattttcgaaaaaaaattagctaatacttaattaatcacgcgctaatggatcgttccgttttccgtgctagagccaaaagttcccaacctgctctctagaaacagaaacagagatatgctataaagctctagtattagcctttgctctaagcatttgtaagcattattgagagcaatacttgtcccatcaattaatgagccagagggacaattgacaagctagagatgcttgtactactttcgtcccagtataagtgtagatacggtttccgtatccaatatttaatcgtccgtcttacttacaaaatatatataattagtatttttattgttgttattagatgataaaatataaatagtaattaatatgtgactatttttttagtattttcacaaatttttcaaataagacaaacggtcaaatattggatactgaaacccacaactgcacttatattgggacggaagtagtattttgaaatggaggaattgacagcttagcatggccattttatgctttaacccattgttttgtttgttatacagattgtccgcattccaatccgcagaaaccttcttggtataaagctaaccaattgaacaaacacatacagatgacaaaagctggggccataattttgaagcaacactgttcatatatattgaaaaccaacagtaacgaaaatcctgctccataagattcacaaggatccagcatatacatatcgcaagccataatgttaagggaagtgtcatatttacaggtgtcaaaagatgaatacaattgaccaaaaaaaacttatactcaaacatgctaaatggacagacgacttattgactggatgcagtagctactgattggaatttgatagtcagaaattacaagaggaatcaggtcctaagataagacgatcatgagttggtacaaatggctaacacaacagacaaggcccacgactatcaactctttcacagaaaagtggaacaagatatatgatcacagacgctcatctcttaatgagaaaaccaagcaggattcccagaatagcaataaccagcacaaaaactagtgagaaaccaccgtgctgactccccatttgcctccttagaagatcctgttcaattccaatagaagataaatgaaactacgtgagtgttgcagtttagattcagatttcattgatgcacaaagccataatagacaaacaagatgatatttgtagataacgaaatacatctgtacttgtagaaattagtgggttgcaaataaacttgacaaaaaagtaaagaaaaacataaagcgcatgtaaactggttattctgtctatctaactcaaagctaaaaaacgtattagtgtttttttcgggtggactggtcactgctggcctcagtaaaagaacagggaatgagtaaatcatgtggtgattatttattggagatgcaaatttatcgacatagctgttgcttaaacctaactagcttatgcggggggataaattaatctatttcttactgccaaagtaaaaaaatatattgggtcactaaatgtttgcataatcaagctaaccagttcttctcgaagcttcatgttctgttgaatggcagaactcttctcctccttcaactttgaaatcaaggccaatggctgcacatagttgtgaaagagatcagcatattgtgctttggcatcattgtcaggtagcataggaagtcggaatcctctataagaagacctctcagttcctcagtttgtaacaaaagtaaaatgctaacaaagtcaagatatgctagaggatgaagcatccctcagattaagttatcattggcatctaaatatgttgagatgaagagccatgatttatgcaaggagaacattaatcaaaagatcatacatgtagagtggagcaagaagattgacaagcaaaaataaatttatagtagtatgtgaagttaggatttagtgataacatagcattgtcaaatttaacaagagaacattgcaacacatatatcaagaaaagtacatagttttcctcagggaaaaaacaaagtgcatagcataaaacagcacacacatagttctgttggatcagagttctaaaacaagtgtcatgcagaggactaggaaataagaagagcacagcaacactgtaaaatataattaaacaacttctgaagcaatgctcttggataaaatcacacatagtatctctaaattatgacacctatcacaagaaaacatagatgtttcccatctgaagatgcatacctcagaggttactgtttctgattctctagatccttttgttgcctgcaaagagaagttcgcaatttgtttcagatgataaggcaatgaaggatcaatgcactaacaagaaacgacggcggatagctgttagacatgaaattgatgaaagccttacttcttgataactcaagcttcctagaccttcctcagacccgccattgagagatgtcgggtgaggttgagtataaacaacctttaacttcacctcatccaccacattacctgattctttcgtaaactacataggatcactcattaggacacaaagaaagcagccaacataagctacaaatgcaggacacactagaaactagaaagtcggttggttaccatgtctccggtgatatccttcggtgtgagctcttgtgtcactatggcactctgcacaaggaatttgtccttgcattgcatgtccggtggcgcctcccgctgagcttgcattgttactagatttgataatcaattgataactaaattcttagcataaaaggcagtcattcagaataagataatactgacgcaattcatcaaattaccaagaacattggatgtggactggggagccacaatgccgttatttggacggacgcagtacttctttggactagttgtcttaacctggagaaacgatgttgaattaatttagttacttattactgcaatgcatatttcctcggaattagaggccaaaaagattttattaataccttaaacgtgacatattcatctgtcttgtttgttaggtgcagagaacacgagatttgcttctttaattcgactgcatgattaaaaaaaggatgcgaaaggatgaatattctgaacaagacaatattatcatcacatattaaagaattaccaaaatttgcacaaaagaatatgcttaaaacaaaggcaaatcggactatcggtgaagtgaacaatcaatattagctcaaaaaagaaggaaaaattccccctgagaacaaccctgaaatttcttcatacataaatttctcgaatgaggccgcattaaaatacacccggaaatccatcggaaccaccgaatgaactgcaaaactcccttcaaaaaacccccaaaaagaaattctcgggacaagaaaacgcacaggggaagatgagctccgggggatcgatcccgagcagctccctggagtcggagctcatcgccggcgaatactcccgaggatcaaacgggaagcgatccgctccgacgggcgccccagaggcaaggcctccaaagatcgaatcttttttcgcctcctgcatccgactattctccagcaaaatattattcctggagcagaggaggaagcggagcaaaacggggaactcgttggaattttggaacggaagagagagagagagagagagagagagagagagagaggcgctgctgtctggctgcttgcaatgctaatcctgaagggaaacgatgcgacggacggacgacacaacgctgggaatcctccaagtgtgctgtgctgcgcagcttgctgccactagaggcacacggcgaaatgcgcgtcgctctctgggacccaaaaaaaaaatactcctgcaaaaaaacaacataagagaggctttgtgtttctcttctcttcgtcgtcttcgttttctggaggcggcgagaaggaaagggaaaggggagagctgggcttacttatcgttatcgacgctttctggccgtatttttctgctcaatggctgcttagctttgctccgcgatcaagacatgtcaaaggtgtggtagggatgtactcccccgtcccgaaaaaaatgaatctagaactggatgtgacatattatagtacaatgaatttagacagaggtatgctcaaattctaggttggttttttatgagacgatgagtcgacatgtttttgggaatacgcgaggtgcgcatttttattaagaaagaataaatgtatgtacaagacgggccgaacaaattaaaaatgaagaggacagggtacaggaggggggaagaaaaacagaaagcctaatcttctagggaatttggtgacccatctatcaaagaaggaactaccatggccggtatggctgccctagccatccaccaaaggtccgcttcacccgtcatagccctagcgatctccggccaggttctgctttcctggttgaagagccgattgtttctttacttctagattgtccaagctaccagtgtggctatcgtgtcaaaccctcggctatgatccttggtcatcctcttgcggctgtcacacaaccaaacatggaaggactgctcgttgattggaagacattcggaatgtatgtaagcgggtcgacatgtgaatctacttatatatatatcaaataagtgataattaacaggttttcatatcatggtccggcttattatcatacctagaaatataagtgatcgatccataaacttatttatagattaaattagtaggtaatccacgagttaatctacggccactaaattttacttataagtgggtttatgggttggtaacttgatacacttacatccctagctagaattatatggccagtgggaggaatacgatcgctccggacgtactgagagccggatctactcctgttgcaaatctgatgtgaacaactgcaatttagtccggtgaaattgactaagctcctccacaattacttgttttagataggtcatcggtcaatatattgaaactttgagtatgaacataagatgttttttctttcctcgcaatataacatggacatgctttttaagtggatttgtatacctcttttgcgctaataatttggagagcatataactctttcggacaattctagactctagagtgcaatgtatgattgtatctgctcttgtcaagctaacttgggcgtgcagcctgctctttgaaatttaatcggcacgcttggcaggagtaggttctctactgtccttttcagaagagatatggtgcagcgtcagaatcaataacatatgttgcccatccaaacagtaagtgtgtacacaaatcagcgtcagccttttccaagttctccaagtttggtggttccttccaactactacctgtaagtcagacagtccctctaataaggtcctttttgtttcattttaaaattattatactctagattattaagtccaattgctagctataagctgaataataataaactaaattagaataaattgtaagttgtttgtttctctgaattatttgatacatgaattattgggtttgaaatattaatgtctatcatcttcttggctattttggatgcttgttcacttttttatcactgtatataggaaatatataattggtagtggctaaaaaatattgtcatatatatactacagtggcaatataaatttttcttggtagaattttgtgacatcaccattcacggttactcgtattagctattgtcgttgtccatacactgcatacaaattataggagtactcccagttcttttattacacatgaagaatcattgtctaaaacaacccaaatctacaatggcatagagcaccttgaaaacctgtatagcctattttgttttctaattaggatgtaacttttcttgcgaaaactttatagacatgaagttgctataaaatattaaataaatactttttcacttttaaaacttaattaattactacctccatattttaatgtatgacgccgttaactttttgtttaacatttaaccattcatcttattaaaaaaaattatgtaattatcatttattttattgtgacttgattcattatcaaatgttctttaagcatgacataaatatttttatatttgcataaaaattttgaataaactgaatggtcaaaggttggttgaaaagttaacggcatcattcattaaaatacggagggagtataagctaatggtttttctcctattatttgtatcacgatatctctgaataccaggaagtcaagtcaactagccatcgtgacgacaacgacatgccacccataaggagttagtactgtacactatacatatacgaatcgtcgtcctatacaaaatccagttgcgactgtaccagttagttcgggaagaaaaggtaaattataggcggcgttagctcacacgcacggtccaacaatgcgacgcaccagcagtccgtccagcaccccaactccccgcgagtcgtggtccggtccactgcgacggaaataagggaaagaaaacacgtaggtgtggtactatttagtatatacgtcaagacagatcgatccagccacagtgtggtacgtggtggacaggtgctacctgcccgatcgatcgctgggtcttcagtcttctgccgccgttgctcgatcggttagttgagtgagacgtgcacgtacggattggagtgcgtagctagccgtgaagtcgttcggggtgcagtgcaccaaggaggcgcagtacggtgttgcgtgacgactccggccggactgccgcccgcctgcggcctgccggagggctggtgtgatgcggccatggcccgtgggggcgcgttccgtttctccagcgagaccccgtattcgggcccaatggaatatgcatatgggccccttctccgaaggcccgtttagtgtttacaggacgattagaggccaccggtatcgctcttgaggaaaaagtgcaccgaaggtccctcaacttatcatcgagttacaaaatcgtcccccaactgcaaaaccagatatttggcgtcccataactaataaaaaccggtcacaatagctccttcggtggttttgaccctagttttgtcttacgtggcagctgagtcagcgtgggacccacgtggggcccacatgtaaggatgccacgtcatccttctctctcccttcctcctctgtctctcactcttctcatgttctctgggcaaagccggctggcgctggggaggagggcgaggtaggagaggaggaggcggcgggcaacacggcagcagcggctcccacatgatagtcccaactcttttctcttctttctgtctcgcaatggccgccagcggagaggggctgttgctggcctccttcccccttctcttctctccctagatgcaattggcgaatggcagaagaggaacaagacgacgccgaccttcccggccttctccttccttgagctcctcaccgatgcccatgtccacccgccttcctcttcctccacggcgcagctcgcagccgtgctcgcctgagcgtcggctgactatgcgcggcggtggtaatggaaaggaggggctggcaccgaggtggtcgcggaggtggcgcccatgcgggccggcctagccgcgcgcagggtggcactcgcggcgtggtggcggccccaagcaagacgaagaaggcaacaatcatggcggcgtgggccgtgaagacgtcgctgtggcgcggcggtcgccacccgcgccggccgtacctccccgccgcccacgccgttcccgtctccccgtcgacgcccgcgcctccttgtcgcccgcgaccatgcggatgccgcctctctgccaccgcgctcgcctgccgacgccgcctcgccttgccgccgcccaccccttctcccgtgtctccgccaccgcgtcgcctcgcccccatgcggctatcgcttttcggcgtcggcagcttcgagaactccccctcatctcacctccagctcgtgctccccatgctcctccaccgggacctcctcctcctcccgccagaatcctccgcccatgctgacctcttcgaccccgtcctccgcggttgagcgcaccgccgcgacggcgatgggcttctccgtgccaggcatcaacgacggttgctgccaccaccaactaggcgcatgtgcctccccgtcgcccgcccgcgccgccgtgcttccccactgcggccgtcaccgccggccgccattgcggcaccgccctcctcctctcccgcctcgccccgccgaccggcgccctacaggcacatagagagagagagagaggaggaatcgaggaagagaagaggggagagagaaggatgatgtggcatccttacatgtgggccccacatgggtcccacgctgacttagccgtcacgtaggacaaaatcggggtcaaaaccaccgaaggacctattgggaccgattttgattagttaagggacgccgtatatctgattttgcggttgggggatgattttataactcgataataagttgagggaccttcggtgtactttttcctcgctcttgattacatatggaggacggactgattgattcacaaaaatttataatttgatcctctccgaaaactaatttcacaaatgaatcgcgaccaaaacttatttaaaaatgacccttttgttaagcgtcaaatcgtatgacgctgaacttagacacctcagcatcacgtcaactggcgctgaatgctgtgccaccgcggatgggaggctgagtcggcgtgccaacgtgcattcaacgccgtgctatttgacgctgatatgtctaagtttagcgccatacgatttgacgctaaataaaagggtagttttggccgcggtttatttgcgaaattagtttttacaaaaggtaaaattgtcaaattaaatgctgattgattgatattggccatccggcgcagagccgatgctctcgatggaagtatttcagattttcatcgactgctgaatttcacggtcatctacagtatacattgccgcgcgcagggaatgcaagcagcaaacaggccgtgcccggtgcactatattcacattgcttgtcatatgacgacggccagtgaggcaggcaggcacacggatggcccacgcacgcactcagtcgaggtagttgtgatcagaggagataagggcaagggcaataaaaaagacgactgcttactctaatctttatacacgttatttggaggtaacttaatagataataaatataatagttgtctctttacatttactgcagcacacatatcaataattatttaattacttctctctcgctccttcccagcttttctctttcctccaagccaatcaggaaagattattcatgctaattttttgttccgtcgatggtgctgtcgatagaaaggcttcaaaccagtgctaggtgtattggtgcccgtgcatgatcgtcgacagattaatcgacgatgtttttctcttggtactctctctccaccacgtaggtataaaatccaacgtaagcttactattagccggtaatttcaagttattgtacttgccgtaagaggcaaagctcgcggcatcaccgtatcactagtcacctcatggggtcacacccgagcgtgattcagggccggccgggctctcggtctagcgctccgacactccgcgcagcaataaaagagcagcagcagcagtactgatcctgtgcgatccactccacatcccggttgaccgcggcacgcgcgggcgtacatcgcgtacgggcggctcgcgctagctagctccacacgtcgcgtcggatcggatggagcatcgtcgcgtcggatcggagacagcatatacatgcgcgcgcgcgcgtgcgggcgtgcgcgcggccggccgccggccagcacctctccgcgtctcggcgtctttctgtttctctcgactcttgctttctgggcctatatacgctacggcagggagggtgtgtgcgactgtgcggtacgctcatcttgggtggggagacaaaaaggcacggagaaataggctttgtatatacgcccgggtccgccgaccggccggtccatgcgagagaaaaaaaaaagggagtatctagccgggcggtgatggatcggaggtatgctatctttgcggcagtgttgcttaatggattactttttttaactttgcttgaaatacaataactatacacatatatcattaccggagactgatctttactgggtcatgtgaaaatcatattagtatagacatagtagtacgactttcaagaaataggtggaattggttttctttttgaagaaattaaattaaatctcgtgaaaacttttaaaataatgcattcattcaaaaaaatatatatatgaccgtaccaataaattagagggtatgtgcaaacgattgtccattttaactatttgtgtcctttctatattgaagtagcagcagcacggaggcaaaggcggagggtggaaggggacgattgtttgctttgtaggtcaagcagtctgttcttgaagcaacaacaaacaataaatagaatacacaacattaagatgatcaccgctccaatcgtagtcgtcctctaggttctggtttgcgagcgtgagttgtcacatgcaacatggacgagtcatttagagggttgggaagatggcatcactactaccaccattgatgtgtcaaaatactttcagaggttagtttttgatgtagacgttgtcaaaaatccagccaccatggctaagctgagatctaaccaaaacaacactccattgatttttcgttactttcgaacaaaacaatttaagatgcacattttgagagcgcacccacagtaatcatgatgaaatatcagaagaaatcaagaatactataaaaattagggtgccaagtcaaaccagtatgtgcattgttttatttggtcaataatgaatatatttatggactacgataaaattttgaaagaaatctaatgtaactacaacgtaatataatggtaatgtaattatacgatggacgaaatattggaagtttttctcttgatttttgatcgacgaaaatttagcaaatccttatattgagattgacgaaaattttcatataactaaattataggtcgttatattttaataattcgagctaaggcatgcaagttcaattaatttattttaaaccaatatctttgcgtaccaaggtccaaaatactactccatacattcctttatattttgttgtgtcttcagctagcaatttaaggatgaaactactccatacattcctttatatttatctctgttcgtactcatcatggaccgctaaaaacttttaaatggttagattatgataaatgaaaatttaaattaaatttatgtttagtatgtaatacactttgataagattcatctagttaagtatttagattttttaagaaaaaagataaatgatcaaagtttaaatatgaacaatgcttatattagcgacgacaaatataaaggaacagatatagtaattaaccaatgtcgtggtagtcgattatatatctggcaagggatttttgtaactatcatagacagagtgtaaaagttttttttagttgaaggaatcaaagaagttatattattctctttttgaaattttacaaatttatttgccaaaatcttagcactaagcacttaatctcataacgaatgtatggtgataaaaacccaaaacattttctattgaagaaaagcacatgaaatattaaagaaagcaacgcatgcatgcatgggtttctagaatttatattgctagatgatgttcatgagttcgtaattaagacacgtcttttgggacacaatcaggcaacggaacagcaacttctctacactctacaggtgaatagggagtacgaagatagtcctgaaagaaagaaaggataaaaaaataaagaaggaaaagaaaagagaaaaacagggaaaaaagtctctacgaggaatatggttataagcataaacctaggcactcaacaggattccccatctctcttctacacactcagaagtactctaattaagcaacacacatgatattaagagatgatgatctgatgctaattaaacccttgctatatagctagaatggcgccacacatgagagcgagctagggccaccaccaagaattcggtgcttgcggccgctttgccaaagctcgctagaacggagtgacgcccatgtttgcggctgcagcggcggcggcggctgccgcagcatacaggctatccttgagaagaatgtcttcagaaccatcctgaaaatcacgacacaggaagcggctacagatgaattgctcgcaaagcactaaagtaaataagagcagtgcatatgcagtgtttgccgggtgggtctgaattctgataaggctatatgagtgttcaggttacacagataactaggttatgcttgtgtctcccatagtagtatacgttaattctctcgggattctggttacctgaggcttgaaggtcttcttgaacccctgatccggcatgaggccaaaatggatgtgagggaaatgggcccactgattgcaagcacaaggaaagtaaagccaaagcaaaggcaggtttggatcagtaaaggagatcgaaacaaatccgaacgaaccctagctatagcagctgtggggctaaaagctcccagaaaccacagccgcttgctctcggcatctcgcaagcggccgggcacaagctgccgctgtgtccgtgctgacaatgtaaggtgtccagtcaaatcaagacacgcgaacagctagcatcaagctagatactacaggatgagtaggagttcattaatgcgcggatcagacgaagaaagtttacattctttgcggctgcactgaacgcctcccggtggctgatgtccgggttgccggccttgatccgctggatctcatccctgtgtagcaattcattataagcagaattaattttttttacgagatgataccacgaatactgattaaccaaagctcaaaggaggatccatcagttttaattaggcagaaggtttatagagaaatcttacttgatgaaccggttgtacgcagatgggactctctgacgcttctccggagctgcaaaagttttggatcagacagcatccgaggaaacatggacaaatgggtaagctcacctaagctatcagtatacatgctgtctgcaaatactgaccggatcgatcgaagcatgggcttacatggccctgccacaacaagacatgatcgcatgccttgttgatctgtactatcatttctagtgctgaggagcgttcttcaagtgaatatagtacatattaatttcacacactcgaaagaaacactggattgaaatttgaaattcaacacgtacactagtacgctaatgtgtgcatatatgcctaagtaggagctataagtagctaattaacccctcttagcaagctttctgttcttaaacctcccaaacaacggtgaataagcaacaagctagcaggagaacacactgtggtgcataagtacctttgactacaaaattctagcgtttcaaagaaagaacac

SEQ ID NO: 67305 - DNA, 593 bp, Oryza sativa
ccttaattgagctaggtaccccaaaatacagatatgcctcataatcttcgtccaatgcaataactagctaggtggtaaccaggtttgaactgtagttacgtagtttttcgattttgctatttgttaaaacaccattgttaagtcttattccttttttttgcaataaaaaagaaggagctgtcaaaacatataaatgtacatgtgcagggatcagaaggatgcattggtctccatgtggcacttcctgaagcgcaatgggctacaaaatctgtacgagtccttctgcgagggcacatgcttcgggggccctgtttggaatcacattctcgagtactggagggcaagcaaagcgaacccaagcagggtgctcttccttagatatgagcggctgcttcaagacccaacagacagcatcagggagctagccgagttcgtcgggcagccattcactagctccgaggaagaagctggtgttgtcacggagatcgtagagctctgtagcatggagaatctcatgagccagaaggccaacaaggaaggcgcccaaggtgtgttcatcaagttctctcacgactcgtatttccggaaggggg

SEQ ID NO: 67306 - DNA, 1519 bp, Oryza sativa
gggcgaggcctacagtgacatgcctatatgcattcattcatgaatatatacatatatattcgatcgatcgatcttgtcacattcaacccgtgcagcctgcaaatcaatcacaagctgcttttgctttggtctttttctctctattgcatgcatgtatccctcacttgagaacccatagctagcatgcatgcgttcacgggcttttggcctttcttctctcgcgcgtggagggacgccattgccgccaacaagctcgcgagtgaacctcagccggctctctcgcctctccggcaagaagggcgccaaggccgccctgcccgacgacgacgattacgagccccccgcaccgccgctcccacccggggacggcgacgatgacgaggagcccatcaacctcgtcttcaagggcagagatgaggccggcgagagagggggtggcacgccgcatcggcgaagaggtcgccgccgaccgctgccgccgctccacagccacacttgcccctccgccgctcgccgaccaagccccccgctccgtcgtaatcgcccgccgccctccgcccaccgctgcttcgcctaccgcgctcgtggaggtcaaccaacacgacaacaacaccggcggtgaaaagctagagcatgacaagcgccgccgttccgctgccactctcgcccgctgccctgcccgccgctcccgccgtcccagccgcctctctccccctctcccgccaccgctggcgcgctcgctccacgccgcccaccgccgcgcccgcctcctctcccctctctcgcttcttccccacgcgccgtgcccgcaccgccgcctgtcgccacgccctcatctgcccggccgcctcactgaagaagacgagaaaagaaaatgtgcagctgacatgtgggccccatgtactttttaattttttttttgctgactaagatgccacgtcagtaaaaccgggcaaaaatactgccgagggacctccggtgaacggtttgagggagtttaggggtacacatttctgattttgtggttaagggaccacagaaaatctcgctgttaagttgagggacccctggtgaacttattccataaaaaatctatgggctggccgactgggccttgtcgagtggaagttttgggctagacaatggaggggggttccttggtttgggctagaggggtgcccatgtggtagagatataggggttacaagctatttcgaattttggaccgggttcctgggcaccccctggtcctattgggctccgcccctgcttttacatagtatggttcgttgtttaccactgccgctacagccaataactgcaaatcactgttttgtactgtagcacaagacacaaattactgtgctactctgcctttagcaccgagaggcagagaagctggatctctttaaagagcactatattcttacccaaatgtgctggtaatatacataaagtgctaatatttgctaagagaataatattcgctatagttatgctttgtgtattatttatactt

SEQ ID NO: 67307 - DNA, 2200 bp, Oryza sativa
aagggaatagaaaactgctgggaaccagcctgcactagaaattctcaattctgtcattctgggattgggctaagtggagccaaatcatcccaagtttcagttagttatgcaaaacaaagttccaggttatgcacaacagaagacccaggttaatgcaaacaaagagagctaggagaagatgtccgtcaagtcactagtgcttgggatatgagctgtggtctggctatgctctcagtctttgtctagctggtgtcccttgtaggtgctctaggtgttgcgcgtgtcagtctgatctgtctagtttccaggatgctgcatttcctgtctttgttttgttcttttgagctgggctgtgctaagtctgatctatctagttttagtttttaagccgggtgtgtgcgcctcatgcctcatgggaagtttcattaaaccgggtgtaaaagcctttcctctaaaagaagttgcacttggtctgatatataagaaagtctatactcggttcctcaattcttcattggtttaattttcattcctcaatgcaataccaaacggaatccatcccccaactatcaaaaccatgcaaataatatccctatgattgttttgcaagtgattttgagtgtggtggcttgccacatcatccttttttaccatgtcatctgccacgtcctgtgtgttagtcctttctcttcctttttaatagaaaacaaataatgaaaaagaagatgcaaataatatgcctagtagatggatgatctaacaggttcctttgttttatcatttcccctgacatcttcatagtgtactgtggtaaacctttgcagggagtaattactcaagatgttaatgcaatatttgttttccaaaataacaataggaattgatcaagtacaacttcaaaagtgtgtatgccttatcaaggaggattgttccataccttaattatgtctagctgcctctcaactacctcttgatctaatgacgtagtaaggtttccagtccaagtgaatacagtatttccatcatgtaggatgtacgaataggatgaattcaaagacgatgccgcctaatgaaagagcatgatcaagttaccttggaagcaatataatctaattccaaaaggagttcaaacatatctttaggaatgaaaatgtgagaacttacagcatcaacttgaattgcctgcatgttttctggtcctgaaccttgaattcggaagagcgcaagtccatcttccaaataagtgtcatcatcaataccattttcagcaataaatttcttgtatccagagcttagaccaccctataatgaaaaagggaaagaaactaagaattggatgttgtgttcaacctgagctaacagtattttatagaagggaaccttaaacacttggaagctttgaaatatgacgaagaattgaattggttcttttccctcatatagtcgtgtctgcatgtaaccaagaacaattagatacacaaggaagtcatgtctggttcactaatgaaatatggagaaactagtaggttacctggacagcctgaaatttcgcagactcaaccatcttgcttgcaagtgaaatagcagttaccctatcctcctgaatccaaattgaaatattttttaacacctacattttctagtatgcactaacagaacatgtaacaaccgcatgctgttatccaaaatgccacttcttaacagaaacagatagatcattgtggcttccagttcataaatcaaaaggatggaaaacagaagcatatgctgtccatagaaccttctaagttctttcttcattgtcctaaagtccggacttcattgataacttaattaaaaactaattgtgagctataaggtggaaactctaaatacaatcttataactatgaacatgaaatcaaagataaattttacctcaatgctcttcttcccaaaccaacttccaataagacactcctccttgtcatctccagggtacatatattgaaatatgtagcaatcgccagtgtaaaattttgattggtcagcagatggcagaagtatcttgtccttatcatttatgcgccagacctgataacagatatagaaaaaagaaaaatgtgtggacattttagctctcagagacccagaaattgaacatatagagcagaaataaaatcttgacaggaaaacattcttgtaaaaattaaaaaatttag

SEQ ID NO: 67308 - DNA, 81479 bp, Oryza sativa
acatattggtatgtgcttttaaatatgttttgttatatagtccttaaggagatactatgagataccaatttttatattgtaaatttggtatcacttagtatctaggtactatgaggtaccaaatagtacaatttggtacttcatagtaccttctcaaagatcgtaaaattgctcaaatttttggtacctccttaaggacggtaaaatttctcatacggtaaagttttcaagctttgaccataatgaaaaaataatttatatttatcgattttacggttctagagaggtatcaaaaggtaacacatttgacactttgattttacactagtaaatgtggcactttcaagtacctatgttcaataaaatttctcttgattaaatcatccatttacaagatattgcctcgttaattctacctatcatacccttaactattgatgattcataggtcaacaatgcaggaattttgggggttacatttgattttggcaacttagatcttaataaagcggtgagtatatcacgagacgacctatattgtggatcaagagtactgtgtgctgcgaagttaagtatgtttcgtgcaacagattgagggcaagagtgcaaacgagacgctggaatggttgatgcaacacaccgtggagactgccgagaatgcagaagaatgcttgaaaataaactatcacggcaacaaaaaaaccatacaagcactccttcctctcctccaatcatcacctgatggaagaattgtaactgtttcctctgtttttggacaactatcggtatgtacatatgcacacattttagttataaatattcgatgtgtagaaaatgattcagtgagttaaaatttcaacatcgaatttaactagaattagcttataaaatccaataaatttatgatattatgatgtagtttttgagacaaatctacatgtactatttttttaaaaaaaactaagcatttgagaaattattgacagttaaaatttaaaaaagataagaaaatcttattctaaacaatggtggactgaacacatcaaagcagcttgctgttctcttaaaactaatctagtttcgatctgctccagtttttcagtggggagaaactcaaagaggagctcaacgatttcagcaagctaagcgaggagaggatagacgagctggcagagctgttcgtcagggacttcaaggacggagagctggagtcccggggatggccagccagagccgacgcgttcgcggcctacaagacgtccaaggcgctgcagcacgcttacacgagggtcctcgcgaggaagcacgcctcctcctcctcctcgccgttgcgcgtcaactgcgtgcatcctgggtacgtcaagacggacatgaccctcggcaccggggagctgacggtggaggaaggcgcggctggccctgtcgcactggccctgtcgccgccgggaggcgccacgggcgtgttcttcatccaaaccgaaccagcgtccttcgtctgagcgtgattcctccggaaaatcagacgcagcttgtttctcatatctaggggtgggcattcggtctaatcgagaaattcggttcggttcctcggtcttctgaaaaattcggtcttcccaaccacaagaccgatcggtcttaaaaaaactcaagaccgagcatttcgatcttcggttagttcggttcggtctcggtcatagaccgaactagccatagcagcagtttaaacagcaaaaagaattaataaaaaaaaactccatacaagatcaatgaatcgaagcaactcggatgaagaactacaatatgatgccactagagcatgattcagaaaaaacaagaagcaaatcaaagcaaatcgatctccacaattccacctcaagctccagatcccgtcgatctcccaccatcgctttcatccccgaccgacctcctcagccatctaggtctccagcgcaggtgaaagggcggcgccgaggcggaggcgtcctggctggaggcggcaccgaggcagaggcggcggccgcggcgagatgggtcggagggcggaggcggcgccgacgcagtgggtggaggctggaggcggagggcggaggcgacaccggcgcctgcgcggtggaggctggaggccgagggcggaagtggcgcggtggagacggagccgcggaggccgagcggaggtgagcgcgaacgtgcgatgaatggggaggaatgcggtgctgactcatgaggagggagggtggggcgtgacgcgtgggggcaggcagtgagagagagggtggaattagggtttatgttactaggcttattgggcctcctaagtttattgggccacaattcggttatctcggttaattcggttaaccgagcccaatgaccgaaatacccgaaataaattcggtcttttgatggctgaaaccgaactactaaccgaatttctcggtctccgtcttttcggttcggtctaaatatgcccacccctactcatatcaataagacaatgagcacctttacggtggtcttcaactctccgtaataacggtattattatcgattataagtggtcccaccgtcccaagggttaatttataagttctacttcaagtagaaaaatggtttttctactgtcaatagttaagtagtactataaagaagattgtaaattctatcaaactataaagctaagctaacgtccattaacttctaaaactcaatatgcaaatatgtgacatcattacctcttagcaataattattatttagagtattttaaatatcatgcaaatatgatatattatttacaattttattatatttttagaatttaatatgcaagcaatgtccaatcattatctccacatcatttcacattatttaaatatatacatctatcatttctattataatacgcgttaatccatatataccgcaatgaagcgcatggtatcaactagtactataaatagttactataaatcattgcaaaatacctctaattaagacaactagcatggtggcccccgcagattgcgcggctagtatcattatattttctctcatataatacatatatgttttctcaatatattattcaaatatattaaaatgacaacataattttaaattttgcaataactttatgaaactactaatgtataatattcatgttgcattttatatacgtattagttattaattatttttaatatcaaattttagttatttgtaaattatatatattcctatatagactctagactcatcttttaatatttcttttttttaattccgaattttctgtaaattgtatttctatatagactctaggctcttcttccaatattatttatttttatttctgattttttattatttcaaattgtatttctatgcggactctaaactcatctttcaatattctttaatttttaatttcgaattttagttacttctaaattgtatttctatattgactttaaactcttcttcccatgtttttcttaatctcgaattttagttatttgtaaattgaatttttatatgaattctaaactctacttttaattttattatgtttattccgaactatagttagttttaaattcctatatgaactctatactctacttctaatattcattattttttaatttcgaatttctatttttttcttaattgtatttctatattgactctatattctacttctaatattccttatttttaattctgaatttctattatttcctaattgtatttctatatggatatggactctataatctacttctaatattcctttttttaattccgaatgtcaactatttctaaattgtatttctatatggactctagtctcctcttctaatatttcttattttttaattccgaatttcagttatttctaaattgtatttctatatggactctgccttttctttttcttcgattaatgtgagaatttttagaccatgagagcgaacgtggagacttctttttatatttattccgaactatagttagttttaaattcctatatggactctatactctacttctaatattacttattttttaatttcgaatttctatttttttttcttaattatatttctatatggactctgtactctacttctaatattccttatttttaattccgaatttctattatttcctaattgtatttttatatggatatggactctataatctacttctaatattcctttttttttttaattccgaatgtcaactatttctaaattgtatttctatatggactctagtctcctcttctaatatcccttattttttaattctgaatttcagctatttctaaattgtatttctatatggactctgtcttttctttttcttcgattaatgtgagaatttctagaccatgaaagcgaacatggagacttttttttctattcctttaataatataatagataattgaacaatgtgttggggcaaacaaaagaagattgcaatgaacagattcttgccaatgtgccaatgtcatggctccatagcctcatacagaaataagtacaacagttgcagtttgtcaaagaaatgataagcaagttttcggtctttaagaggtggaacaaaaagaaagaaagaggaagcaagggaggataatacatcaaattactagctgataattgaggatttttcttatgtctatatatatatatatatatatatatatatatatatatatatatatatatatatatatccggttctgttttccccctaatctttgctctatgtcgcgtcttgtgggggcacttcctgttctttctcgctggcctctgtggccgccaccggtgcagcctcctcggactctttctgcttcgattgtgcggtctggatcaagtggttgtagctgcccttctccttgaacagctgcgagaaatggatcttgcagtagaggatcccgttgagcgccgcgtaggaagacgtcgtcaggatgcagcccccatgcgagcacttgaagcaactcttgtggtaagactcaccctccagagttagctgaacaaaaaaatagattccatcaaatcagattggtttagagcaggtacaatagcagactataagccagctataaacatattttaaagagataaaaaatgagagataagagtagcgggctacaaatttgttgccagttgtagcacatacgtaagaatacatgtgtgtatgacaggtagaaccagacattaattatgtagtacatgtttatgggtaactattgtatgaattagctattaaattgactatagatgatttgtagccaatagttagctatactattaaacttgctcttatactcgttcaatttcaatgctatcatctttttaaattttctttaacggttttgacagattgaaatttgtgtgacgctactttgcggtcgtaactaggcagcattctgtaccttctccaatgggtacacagttttttggcaggctgcacatttatcttgagttccagagaatgctgaagatagcttgctaggagctcttccctggaaaaagtttttgcagagtgaatagtttgcggattatcaaatttggtgatatataactaataaatgcataatgtgtgaattgggctataaacaggtctgtggggtttgtacctggtcgctcttctctgaagatttaccacctgagtaccgggacagagagagaattcagaacacaataacttctcaataatgtccaaacatctcgacagccactgtgtcttagcattaccttgcgagaatttctttgagaagctccccgtctctttgaagagctgctcaaagtgcgtcttgcagtacaggacaccatccatcgaagagtagttacacatctgcagatgcgtaaatgttttgaacgaaaaatgtgatagttgatttaattacctaataaaaactgaacatgttgcagggccgatcgatgccatatatacataccgagagggtccccttgcagtggctgcacttgaagcatgtcttgtggtaggagacgccgtcggcggtgaggaggtcgatgaaatggacggtcttgtcgcacgccttgcacttgtcctgcgtgccggtgaacgacatggcggccggggtacgtatactagcaccgggtgattcaccgatcggtcgatggaaaaccttcaggcctcggtctggtccagctcgaggaatcaccgtagctatagcttcccaactcccaactcttccgatcgatcgacggaggagatcgattcagggcgagacgagaggaacgtgggcgtggcgtctccagagaagggagggaggagagatgggcagacagcaacgggcgatggtttaaagggcggggcggcgtgagcacgggagcaaagataggagacgggatgggctccgggccacacagatgacagacggacgaacccggtcgtgcaaaccgggagagaggcttgtttaattttgggaggggcgagcggacaagaattttctatgcctattctatgcctaggtgtcatggcatccatcatttgcatgtgatttaaatagttatagaaaaaattaaaacaatcaattatgatgatacaagtctatacacaatcatacaagaactgaactagagaaacaaaaataataatatcagacagtgaatagtacccgtacaacgcagataaaatttgttatttttatttcttcatatgtagattgattttagacttacatgtttgtatagtatcttatattatcgcagtctatcttatctaattttataatatttttataaaattatttaaactacatgcatacacctagacgccatgatatttgggtatagaaaatattttcccaggccttcacacgggggcgcgcgctcatgtcgcgcgcgctcaactccggctgtggtccttcttcaggtcgtgcgagccgcgaaatcacaacgtggctccatggatctctgcgagacactgtcgtgcggggcagttcgttcttgattatgcagatctctttctggttgggtttgtgtactgggcttcgatccgctctgctcacgacagtctgggtggacaagcgtacatatctgtcacagataggcccgtataggcccatgaccgaataaaggaataagtccattatacctctctcaattattcccctttgtcgaattacatccctcaaccacaaaaccaggtatattacctcctctaagtgttaaaaccagtacaaaacaactcccttaatggtttctgacggtggttttgctgacgtggcatcctagtcatcgaaaaaaaaaattaaaaaaatacgtgagggcccacatgtaagtggcatttctactcttcctctcctccaccactctcctctctcctcccccttctctctccctggacaggggaggcgccggaggcgcggaagatgtggggaccgccggaggatgcgagcgcacgccgcgagggagaggatccactatcagcagcagcagatgcaggtggtggcggcggtgacggggaataggaggatgcaggggctagggccgaagcggagctcgaacaaggaccggcacaccaaggtggatggccggggacgacgattcggatgccggcgttgtgcgccgcctggatcttccagctaacgcgggagctcgaccacaagtccaacagcgagaccgtccagtggctgctccagcaggtggagccggcaatcgtcaccgcatggggacgggtgtcggcactgacatacaggggccctccctcccttccccaaactgcgccctctccaggtcgcaccaccaccaccaccacatgtgggctgccgccgcggcaccgcccgccgcgtccgcggcgttcgccggtgccacatcgggttcgcgaccatgtttgccggctacgtggcggcggccatgccggggctagaactaggactctcacaggacggccacatcggcgtgctctccgcccggtcgctcagccagttctaccaccaggtcggcgacgctagtgccgccggtcaactgtcgcacccacaccaccatcaccaacaccatcagcaatagcaggaggacggggaggatgaccgcgatgacggcgagtccgatgaggagtccgggcagtagtaggcgcaccgccaattgttcatctatgcgtctcacgttgtctctttggagaagaaaaagagaattccaggaaggggcatgcagctaatggagggggtatgcttttgttactgttgggttgttcttcatggggatttttatgtctgatttttcctcgtgtggtgtcgaagctggaagaggctactacttgctccagcgacttgttgggatggatcatgatcatcttcagttgttactcctgctgctccatggatggtcgccggtttatccccctccaagtgtttaggtgaaagctcaatctttttcactccacagtcagcacatgacatgctctttgaaaggtagcttgatgagcttatgtattttgccggaggttggcggcgcgaatagacagcgggaggatgcgttgccggcgagcagatcgacgctgtggcaggtgaaccctccccgtgcgggcgccgcggccggcgatcctctccctcgcggcgtgcacccgcatccttcggcggttcccacacctcccgcgcctccggcgcctctccttgccgtgctctgttcgaggagagagaaggggaagaagagaggagagtggtggagagaaatgccacttacatgtgggccctcacgtatttttttaatttttttcgatgactaggatgctacgtcagcaaaaccacagtcaaaaaccaccaagggagctgttctgtactggttttaacatttaggggaggtaatatacccggttttgtggttgagggatgtaattcgacaaagggcaagaattgagggaggcaaaatggacttattccccaaataaatatcaggccagatacactttaattgctttgtataagcgcaatgggctagagatatacacgggccataaaatgcacaatcacgtgctttgcttgcttatgcgaagaagaaaaggcacgtcaaccttttctttttctagatctttcatgaacatgtttttgaccgtgatacggattggtagatttgtctagagctattgtcttctttaaaagaaaaaaaacagcacagaccagtggcggaggacgagaaaaaaataaggtgtggcagcatcaacacagcgaaaacaacataatagggcgaacgctatggatttgtaatgtgctcccatgcaccgctaaaagttactgcaaaaattgttttgatgcaacaaatcattttttttgaccgagaaaactaccagggcttttcctagtagtgtattttcattaaaacaaaacgtatgtacaaagatatagggaaaaaggagcttttaaagagttacaaagtttgtatccaatcaagaactatttgttttcaaggctccttcattctacaaatatgcagaagaacttcgtttctgaataggcgtttccacgactgaaaggatggcacaacattctaaaatattagcccatttctctgtttccaaatatgccaagaagcgatgaaaaagatttcgagaaaaccttttcgagcaaaattcaatcttcctaagattatcatttgaaagaatcctatatgatgattccagttaattcccaagtgttgccaacacctaacactgaaaggacaagtgaagaagagatgaagtctggtttctctctggcctgcattgcataggacgcaagttaaatcatcattctcttttgcacaatgcctcctgtccggcatatcctagtgtttagcttgtcactgaaaagtagccatgcaaagaccttgattttcatgacacattttgtcttccatagctagacaagaggtctggggggctgcagtggcacaaagttgagcttgtataactttttttgcagtgtatgaagatgaattccaaataaagctccaactatcaccttgccctggctgcaagtgcaaaaggttaagttcttcttccagcagcaggaattcctcatagaccagggcagataaaggtagcaagaaagaatcctctaggggtcttgtactcatggccaacacagattcctctttatgaatcaccagacagtagagtgttggatacttgctgctcataagaccatcactccataaatcttcccaaaataaagctgaggttccagttataagagtgcatttaccaattcccctgaaaatatcagtgagggctaaaatgtccttcagccagaaagaacccttgttaagacacatgtgggggactcttgcaagatagtaaattttccatactaagtcaacccaaggcaaatcaactccattgtaaagtttaactaggtgtttcataagaagagcacaattctgaagcttcaggtttaccactctcaaaccccccttttcttttggcctgcaaactaagtcccatgaagccaaggatcttcttgtggagtttgggttatttccccctccaaagatagtttttccttgcattatcaatcgatttgatcactgtgacaggtagttgcaaggaacacatgaagtaagttgggatggctgacgggactgaatttatcaaagtgagacgccctccttgggggagaaacattgaacttgttgttaatcttctttccactctatccaccaaaggggcaaagtccacaatcttaggccttgttgtccccatgggcaaacccaaatatgtgaaaggcaaagatccaattgtgcagccaagtaaaccagccagatgattagctttttcagaagagacatttagggggtataagctagactttctgaaattgactttgagacctatggactaagcaaagttattcaaaagagctttgagatagaagatctctctttgtgaggcttttagcagaataagggtatcatcagcatattggattattggaaagcccttaccatcattttcattgttgggtttagagagaagaactaatgagaaagctttattaacaattctctacagcaattcagcacccaagacaaagagcaatggggacaaaggatcaccctgtctaacccctcttttgcagccaaaactattaccaggcactccattaagcagaacaacagagttggctgtggataaaatcatttggacccaattgattcactgtgctgggaaacccatattttgcataacggatattatggctgaatgctcaattgtgtcaaaggccttctcaaagtccaatttaagaattatgatttctctcttagattgctgacattgatgaatgtattcaaaggcccaggccaggcaatcctgaatggtccttcccttaaggaaaccatactgattctcactgatcacctttaaaataaccccttgtaatctgtcagccattagtttggtgagaaattttaagctaactcccatgagagagataggcctgaagtcattaacagtttcaggggaattcttcttaggcactaaagtgatgaaagagttgtttaaagactgtagatcagtacatcctaagtggaaatgtgcagccaatctataaaagtcttgggcaataatgtgccaacatcttttgaggaaaacaccattaaagccatctgggcctggggctttatctgcaggaataattctaatgagagtatccatttcctgagtgaagaaaggatccacagggttgtccagacaaacatgatcagggaaaagctcattcaaatcaaaccccattgtgggcgaattagagacacccattctttctctaaaacttttatagaacaaagctgctttctgctcatgcagggtgaccacctaaccatcatggtcctggatttgggagattgagttagctctatatatttatgtagcaatggactgaaagaactttgtgttttcttcacccagcaacatccatctattggtgcatctttttttccagtacattttcctgaactctaagagcttaattatgtggcactacacaatctccctgaaactcctctcttgtcagagacctggcctcctcaacaaggtctagaaaatcaactgctcgattgcaatttgcaagcagaacatttagtttagataaatttttgctccagcttaacaaccttttcctaagcattttaagcttaaaagagatgcattttgcagggtcctcaaagtcaggatccaaggcccaagcagaattgactatatcaaaaaagccctccacctctacccaatagttctcaaacctgaaaattggggaccttggaattttagtatcaatcttgaccacatagggcacatggtctaaaatgtttctagtcatgggtagcacagatgtattggggaagttcagtgtccaggaggcagaagtgaaaacccaatccagtctttcaaggagagggttttgttgcatgttactccaagtgtacctcctgcctttaagagggatttcaagaagacctaaggagctgataatatcattgaaaatgaagatgtcattcatatcaactccagccttattcgtgtcctccactgacctgtaaaagttaaaatctcccaagaaaagccaattctgctgactttctatgtgaacattctgcaaccaggcaacaaaatctgctcttgcagggccagtacaagaaccataaacacaggtgagagaccaaggctgtgaggattgtctggaggtgaagtcaacagtaaccgaaaattgattgacctcttttgccacccccatgaacaccttaggcaacaaatcatattgatatgtgttaggattcaaaattcccgaatgaaattttcaaaaaacatttttgtgaatttagcaaaatatatccaaatttgatcacattttgttcaaattttaaattatttttggaagatagaaattgccaaaccgatagattaaacctttatctcggttgtgttatataactactagcgcttatataggtagctaattacaagaagtaaaaacaagataatcggtataggttggtttgctttgtgtaactaactaacgacaaagtcagaccagctaatcacgcatgcatgcactttacctccagtgaagaagttaatccagctaatcacgcatggatgcactttttacaacgagtgaaaacaaggcaatcagtgaagaagtttatcatgcatgcatgctatttaccaccagctaacggaattgaggtatggcgagtgccatatctcgtcataccggaagctccgccactggcacaggccatgcacatcttatatagtgaaagcagcaagctttcttacacgagaatgtgccacatcatcaaaaacatattagccgtcggataaatagttcggataaataatagtcattggatcgaaagagtgcatgtattaaaaaaatcacaaatgggctaaacatatggaaatttccagaggtttcgagtatctattgtcctagcaagtatagatactttgtaaacaaattaacttatatcaaaaccttattaagagctaaggtaaactaatagaccatatataaaagttcttaaacaggaccaaaagttgcgcaaagcgtgactatatggctagttttattgaatatagtggaagaaaattgcattccctaaacaccaagggttaaagaaatccacaagtttgccatgtacagatatagctacgatcaagaagatgttttaccgctgcaagcgtccacatccttgtcttctcctttatatttgcaaaaggccaggtgttgaggtctttttgtgctcgaaggtttttggttccttactttctatatctcccacacgaccaacaggatgagcgtgcacatttctctcttgggcatgccttggtgacttgcgagcattttccaacactcaaacattgatctcggactccattggcttggtgtgacttgttgataaactacaattttgtaactagttcccaaattctcctaatgtatttgtattgaagaacaggtgagaggatgattcatttgcattgtgatagagatgaagtgagtgttgttcggtcaaacactgactaccagctgatctgatgtccacgctctattttgtatcaccagctaagtgaagagcttgcattttgttggcgcctaaggcttccaaatgagggcattgaagtttgtggtaactcagccaagacattgtgctttgtaaacggataaggacgtacattcaccgtggttggttagcttctacggctatgttcttatgtcaaggttcccaacctctactcattcgtttcccgcgcacacacttcccaaactactaaatggtatatttttattttaaaaaaaatctatagaaagatgctgtaaaaatcatactaatacatttttcaagtttttgttaactaatacttaattaagcatgtgctaataagtcgttctgtcttcctagattggttcccatccactggtgacgaacacaaccttatgcatgttggatcacattccataaggctactaggtccaggatggtttgcagatgaggtcttgtatccaggtcttattcttcaagtcttggtgcattgtcctttttttttctttagatgttacattcattggtcgcttatgttgattttggaggctacaacaaagagggttttgtttgtctcgtcacaaggcgtttccatgcccacccatggcttccaagattctacccatttgtgccacaaccatttaagccttagggatttgtaaatttctcgagatcgagcgtcctcaacccttcatttgccataggtaagtgtgttctctttcagtcgatcttgcatttggctccaatgaagtttccggagccaacccatatgaatcgctagcattgcttgccaatcttctccaacgacttcttgttgactgtaagagcagtgattacatctgaggtggtggcatttacatgcacaaatatagttttagacgatatttgtaacggaactctggctacaaggtacaaatgctcacttccctattaagtacttgggcatgccgcttgcgtcgagaaagttgtgcaagccacctttgaatggatggcggggcatctaggaggatggtaaggaaggaacatcgggttagcaggatgcacaacccacgtcaaatcaaagctttccttttttctttgcaaagaaaatgatatcttcaaagaacaagcccacaagagacttgtagtctactaagtctcgtcatgactaatttttttcctaaaaggcgacaattaatcttaaaaaaatgtgttatatatgccaacatcatgtcatatcatgatattcatgaggatgacaacgcaaacggctagctacatgagcgccacgccgtcacgtcaacctaatttagattttcatttttttttttgaattgatcgttgttaaactttgtaaagttatgcatgataaaaacgtcctaccattcggtaagaaaaattacgttgtgaagacaatacttacgtatttgtctttctagcagaccgacagattaatttcctgccaaagtaatagccctcgtgctaatagaagtatagaacttctgtaacttttggggaacttttgggtggtcaaaaaaaatgtgaaagaaagtcgttccaaagaattttagttactgttataactgaactttctaatactgccacttggccagtgactcggcgagaggtacataacacccagtttttttgtaagtattccatgttaatttggacgtcgacagatgcaaaaattattttgatatgacgtagaggaagcaagaccacagagaaattagatttatgtattacaacaaatcaccggcctcgacacaaattatttttcgccgtacttttaagtcgtgctcaacgactggctgcattatatgcacagttactttgggcccattaaattattaaaatgctttaatgtaaaattttgctgctaaaaatgcttagtctattcgttgcatcggtggaaaatgccctcaaaaccagaagataggacggtgatagataatattgatgtcttttctgtgtttgttaccctccatttgtagttctcgatgtcgttttattgagttgtgggacatttgtgtcttgtgccttacgtggaactgcatatgttcctgatgattgcatctgatgatctaataagtcctttggttttggtataagcagagtttcgctgtaaataattactcccttcgtcccactcactatgtcatgtacgtattttaaaatttaatttatatttgatcaatgaatattttattataagttaaatattatttgatgaaaataatatcattgattatcatttaaatttacttttatatgattatgattttgttgctacaaacattgtagtatagtaataaatttaaatttaaagattagttagaagattgtgccaaatttaaatgtatcttagtgagtgggacagagcgagcattgttttacaaatgttaaaaactacttaattctattcaaagagatttgctccggtccagcacaaagtatctcaaagtaccggtaactcacggtaccaaatcgttttcgatcattggatctagctgggcaggatgggcattgttagatccaatgatcagaaacgatttggtacggtgaggtattgatacctcgagatactttttattggaccggagcaaatatcttagagtggcattttccttttcaagcttcagactagtagtatttcacgaaattcctccttttcacataaagttagcgtttcttttataccgaaagcaaacttgaatttctcgggactattcggtggagtagtaccaaaatctccaggatgccctgagagcattacctattccaatctgcaaacagttgtacttcgttccaatctcaaattaaagtccattagtccaagcaattcatcagtacagaatacgagtataacagctctgttgacttccaagttcaacatgctcctcctccatcttgatctggtcctcctatcctgcattgtattgatacctgatcaagaatctatgggctttgctaaattgattgcctctatcccggctgtaccgccgtaccaactaggcaactatgtacaattcaaaaaggaaaaaagaaaagctatatatgcaaccatagaaattggagcatgatattattagtacttaggagtgtatatgaattcagttgttagtgactctaaatgggcagagtttctcccatttttcaaaaaatatcacttctggcattattgtccttgtaaataagtaagctattgtgctcgtgagtaaacgccaattggggggtgtttaggtaggctctgcatgagaaagtcttgaatgtcacgtagtagcggtcagtgtcatagttgttagtagttactgaccaacccagtactaggtacaaaatatgaacataacagatcagcacatgacgcgtctggatcatggagtttatgcacgtctgtctgtcttgagcccctgacttacaagaagagattgcctactggctactgcgataaccctgatttgtctacctttttgtatagtgagcaaaaataatctgatgagtcatgagtttctttcttcaaaaaatatctgatggacttaacattagcacttcttgcccacctttcacgaacactgacgtttcctgaagttgtgcagtggcttcggtttcgttctctcgtatggcccttgatcatagttactctgtcaaagcaagccggatgcgttacaacttgcaacactctgaacacaagaacaagaagtcagatcaaagaagaagaatctgctagtaccatgcatggaccaagctaaaggcatagagaaatgccatgtatgtttagtgtcctagacgattaaggcatcccatcgccacagataacgtagggtcgtcacacaggaagactgtcgccaataattgcatctgtcaatataaaattgctgggatatcatcggaacaagttgtgttaagccgccaaggctcgtgtatcgatcggtttcggagaagatcggaagaatgcatgtctgatttgagttgttgcacttctttcagtataatgcatgtggctcaattgtgtgattgcagtgatgatgtaagatacaagcacgtaactcttgaagtttggcggcttcctactctttgcgaactgcggctatcgatgacaatatgggctggtggtcaggcttgtacctgctgctgcaattagatgcagtaggccggagtaatcaatctgcagttcagtaacagtttgttactgtttacagaagcacgggggaattggaggttcaaatcaaacttgagcagcatcttagttttcgtcccatagggaacttgattaaaccataaaggctgcacaagggcacaattatctttttttaaaaaaacgatccggcactatacatgctaattttattgaatagagcaggactaaaaagttttgtacaaatataaaagaaaaatataaaaaaaaaagtaaaactaagtgataagctccgagagacgttctgctaaagttcaggtcttggtttcctcctccattttttgccacgagcactattgatggattttatgaatgttaaaatccattggtggagaactttttgatgaactgcattggcttattggtcagtacattaaaatcatcggatcaaatttcacactacaaagtggtagctactcaatcaccgtaaaattactcatgattcaacatgaatgtatcttgatcaattttatggtctgagaaggtaaaaaagatgccacatttgtagtacaaaatttgttaacaaaacttacactaaaaatttaatgtatctccctgtacctcccaaagtccataaattttttctatattttggttccgttttgaacttatttcatttacattatttgatggattattaccgtggattatctacttcattgtaggttatattaaatattttagaaaataaacacacaaatagcttaaaacaacctaaataatataatagcagaatttttttaagaaaaatatttttcgaagcgtggagaaaaatccgtttcaataatctaatgaataatcgaaaaaaagggccaccagaacactctgtccttgaattaggacatctaaaacgcaagagtgagaaaaggtcacagaaattgacactacctactaatgcaactgcataccataagttaatgatcacagtcaggaaacgactttagggagaccacatacgtatattttcttagcactagctagcataagcatatctttctgcagagtccaaaacccagtttgctaccctaacaaaatcccctcttgggggaaggattgtatttttaagaagcatggatctgtcttgtgcaatattaattggggtactagtactaaataaactccgtagagaaatgtcaaagaaaaaaaagtattgtgcaatactaaactccatagagaaatgcaacagaaagaaaaaaaaaaggaaatgattgtcaagcaatatgcattcacctactccacgaggtgattaagtttaagaaacagtcagcaaagccagcagcttagcctttcgtcgtttcccctgccctattcagccaaaatgcaaaagaaaatgctcccggctctcaaacttgagagttgagacaatatcaatcaatcaacaactacgcacatttttgcatggtgcattttgcgtccattttatcttgacgtggtcgtgatctcactacgactctagaaggagtacaaaaatacttgctcgttgtttgcatgcgtacacagcgaaagtcccctcctctctttgtagccgacagaagccagccgacattttgttccgtcaggctataccacttgtagtcagtagagtgatgttcagattgtgacagtgaataccaaatactgcacatgtctgtacaagtggcttgcgtgcttgatcgtataagggatttataattatataaatggagaggctaattcaagaaactagcccgtgaaaggacaaaacattacttcatgtattcccaataaaatactccatccgttcaaaaaaaaaaagcaaaccctggatttctgtgtccaactttgactgtccgtcttatatgaaatttttttataattcgtatttttattgttattagatgataaaacatgattaatactttgtgtgtgacttgtctttttaatttttttcataattttttcaaataagatggacggttaaacgtttggcacgaaaccagggtttatcttttttttttttgacggatggagtatgtgttcagtacaacaaaattctctgaacgtcactaaataggtttattttagttcatcccagttcataggctaaatatttgtacgtttcgtagctgtccgtgagcttttaattatgagaccaacatatatgtggtcgtcatgaagtatatctgtgtatacgaagtgttattataccactttgatacagacactctaccgtgcgccagtagttctctgtcaacgccaagcaggggatacatgcaaaacaaacatctggagttcatgtgtccgcttcaaatgctgttgcggtcaaattttattgaactatcaaccttatgtaagatttgattgagttcttgtaaatattttttcaagttttaatgaatagttgagctctctgctttactttaaagaaaaggaccgagttcgggaaagagaaagacctcgcttcactagaagacatatgtccacataaagactaactgaaatgcacaacattaacgctttgacaatattattatacgctaggtccaatcttcaggcatactggtcgcaaatttgtttatttcttgagataagatacgctctgattaatgaagattgcatttttcactggagacagacgagaggtatacttgagtagtggttcttttgttgagagacaaatcatataaaaataatgagcttggttaactagaaatgatatcgtaaaacacagcagtctccaaaagctagtttttttaacgaaaaaaaaagctagttttgtgtactctcgctattggtggatcgcagaagtccacaaccaacccacatttatgtatgtgaactggcaatttcaaaatcagatgataagggaggattcttgcttaattggctgcaggtatcattcttctgaagtcgtttgtaccaaccacaaaattaacaaaaggggttccatcatctcctgattgcaggtgttgctgaaccgagcaaacgaattctctactgcacagttgtacttcgcctcgtcagaaaagattagccacagtacgtccttaaaagccactttgccattataaactagtactaatcatgagctctgtacaatgcgataagatttgttcccatgagcaatcatgcattttgtggcggccactgtatatatgtcccccacaggttaacaggatgggatggaagtggtgccataaagttacgtataacctaattaggacccattcttgaaatcgacaaaagcaagaaataattctaagcattttttcagagaaaagattggtgtgtgtcatgcagatatgcagttcgctggcccggcgaaaaaagatatgcaggtcgctagttcagatagatttgagggcactagtcggtctactttactgtatcaatagctctaaaattcaaagttagtgattacaaaattcaatatatataatcaaccattccaacatactacttttgatttctgttttcttaaatttaatattcgaaaaatttataaaataatagatacaaagttattatactcctacttgtcatatggccttcattttagtttttcttaattaaataatataattctgaacttggaattaatcattacaaagttgtcctcggtacggactatatcagtttatagtatttgactattgccagatttatttgctactcctattagcatgagatttttctccaagtatcaatttagtgtgcgtgtgtgtgtataatgggaaaagaagtgcacttgaactatttgctcaatcctgtatgtaccttttgttacaaatttctcttttgtagcagttaatgtttgaagaatggtcaactgtagtccttcattggtacatgagaaaaaagaaatactttaccgtgtaaagtccactgaagaaattttcgatgaaaaccgactttttcttaatcctttatgtctccgactacttgaaaatgtggataaacattatagttgtattaatgttcatacgagtaggatacgtagatacctgtctacacttctactgtgtttttttttaaaaaaataagtttacagtctttatgccttggactacttagaaatatgaatgaatattatagttgtattgttcatacgagtaggatatgcctgtacatgtttataatggtatgtgcgtatgtacgagcgtgtgttaatctgtaccgtgctttaaaaggagaaaaaaaaaacataagctgtcctacgagtcctcctgaccatgacaatttgtcactagcatccgaggaggaaaatctcctcaccgttgctagagacttgggacgatgcggggaatcttccttggaaagaggtgcgagagaactagagaagggcgttatcaagatgcagggaaatcctccattcctcccatcaaatgcaaagaacaaatgaagtggcgggaccgcgctcccctgctgacagtgcactcggcagcctacaacagcagcagcatggcatccccttttttctctcgtagcgccatgcatgcacgatcagcacctacgcccccgcaatattattatatggctgtcacgatcccacccctttgatgagaggcccatgcatatgcacggttacatcacggtgcacacgaacgacgcacccctctcgtcctcactgtccctagctcttttaaatttctttatggttccttctcttctagtactcgtgaccttctcgcagctctccacacggatgcatatgcttcacccctctctgtacattcacaccttctgtcggtgtgtcgattttaacctgaatcatctgggcactatcacactactagtagtttattcagctgttagtatgttactgcacgacgtgcacatctgtacttgttcaggctcctgttgcaaacgcacaagtcccactcacatcgaacagtccatacagttttctttgtgtgggggagagcatgaaggggaggatcccccacgatttcaccggggcctagtgctcctcttcccgattcggccaactgggcagctcccatccctgcaggtggccacgtacaccgtatccctgatttcctatgcgtgtccgctggccaccgaaacagataagcttatttcctactcctagctagcttagctatctcctggcaggctggcaccaccaccagctcccggctcctgacaaaccgaaccatccaacacgtacacgtacacgcgcgtgcgtcgtcgctgcaggcgacaccgggcgagtgatggcaacgtccggacgtcgggtcgtaacctgtgcatgccatgccaaccatcctggggatggaccggatccactgctcacgtcgacgcgacgtagcgtttccaattgaccgcggcggcgtcggtggggcgacgacgagaacgtaccagcgcgcgcgcgcgcgtcgcgcgggaggaaacgagacgagaggtcgatcgctagcgcccgcacgcggcacggggtgaaacgctggggaggccacgttttttttttcttttttggccccgttctcgtgcggttttgcgccgtcgggtaagcggttaaaatccccacacctaatcaaacgcgggctcgatccgtagccgggggagatgtggtgctcctcctgctcatcatcatatggcaatcttggcggattgattagcaggggggagggggcagcacaaaagcgtggcgttggttccgggtccaacggccccgaatctgaaactctgaaactttcaacaacggcgatcgatgatgagtatcatcggccagtatggctgattgattacagggtctgcgtggctgcaattcgatttcgtttccatcttttggactttctgtactcgcgcggcgttgaatggatagaggggacgggacagggtgtgagcccctgtgttggttcctgctgtgcctgtgctctgctacatcattcttcgcttctgccacaagtcacaaggcctcctttttctcctatatatggagaaaaaagcgcaaataaatattttccgctttttagactctgctgcgctttgggataaaaacaagtgaggaaaatatgcaaaagaaggaagagttaattaattaatcaacgctacgtatatgcgcgccgtgttacgtatctcttgctgactttataggtaggagtactgatttttcctttttaccgctgatgatagtatatacaaacgatgttacttaccaagtgacaagacgtggacgtgttgctcacaatagtttgaaaaataagtaaagaaactaataatgcgtttttagacgggccgcgagaggccagcaaggcgaagagaaaaacggtgccgtttggtagtctttaagctggctacgtcatcgcacaatttgatcgttttgcccccaccacggggactcggggagaagagccaagccatctctgcagctggcttcgatgattttatgaagtgcgtagtacgaagtttacatgcacggcttgactttctttacgacctctctctcacatctcacctcgtgaccaagctggatatagcaggaacagtgccatgcgcccatgcttgcccgtgagaaaaaaaaggggagaagttaagtaaggtgagaaaaaaaaaagtttaaccaggattcgactggatacgcctttgcgtatttatttgcgaaaaaagagaagaagagagtgagaggaaaaccaaacacttcttttattaatcaccaccgttcacgtcgcctataaaactcgtacctacctgtctcctccctgttgaaacggcacaaagctccatccgttctgaaggctttgtggccgagttctcctcccccacctcctcctcctcctcctcctctgtagccgagctgaggccaacgcgagtagtgacattctcctgcaatggggtgcaagtcgtgcgagaagcccaggccgaactaccggaagggcctgtggtcaccggaggaggaccagaagctccgcgactacattctccgccatggccacggctgctggagcgcgctccctgcgaatgccggtaagaccaatcgccgcccgccgatgccgccgacgcgtaattcactacccctgccggccgccgcatgcagcatttgcgctccccaagcataattcgcgagctctaggcgcattgcaccgacaattatgcaccgaggcacacacacaaaatcggtgaattcgcgtagcctggttgcatgcggttctctttgctgaatttctcttgccgacccgtctgaattatgaaccaaaccgttctctgaacaaacaagactctgtttcttagccaattcgtgattaaatgtgcattgtgtgttgctgcttgagagctggtctcacaagaatttgtccggcgatcggtgcagggctccagaggaacgggaagagctgccggctgcggtggatcaactacctgcggccggggctgaagcacggcgtgttctcgccggaggaggaggagacggtgatgagcctccacgccgcgctcggcaacaagtaagcttttctaactagcaactcccccgacgagtctcgtcccagtcgggtccgtgcccagtccccacacacctcaccggcagcgcgcactcgatcgttcgcctttacacgcaaaatgattgagcccggagacaattctccacgttgtgcttgctagctgctgctgctgatgctgccttttcctttttcagtttagtactaatctctctctccacacttaattaagctacctagtgtagtactagtactactactactagactagactattagtaccaacgcaacagcggcactaatctttttcgtgagaaagctagttactctagctgatttgtcccagtccgggcgcgctagtgccgagctggcaattcgggttctagaacgcgctgattgacagattgtgagtgacagagtgagtgaaaggagaggaggagcggagcggaggagcggagaaatcaaaatatgaaatggtggaaagggagaattaaccggggtgatgctggctggccgccaccgcgaccttttccgtagtggagctgatgctgacgcgcacacgctccaagaacgctcctgcgcattcgaaaaccgcgagatttttcggtgcacgttgcgatgatggctagagaaaccgttgtgtgttttttttttcccctttcttcctttcgcgctagtacatttgtttattgtaaagtgcgggccactctggctgagcatgagcaacaaggacaagttgaggggggacggctaggataatgtggacttgcaacgctaaatgccacacagtacagttgcgtgcgtcccagaacaagttagctcgaattaattttttttttggggggggtctatttcttcgatttttctatcttttttgtacaggaaaaacggacactattcattttagttgtacagcgacgacgataacatgtcgtcgactggttggaccaatccgttctcagttgcgagttaatgaaaacagctgccttcacaatgcgaaactgtcacgtaggagtactagtctcgcgagaagattagattctttattgggcgtcgcaattatgtgcttccttacaaaaataaaatatcaaaggattagtggtccacatgaatagactacgtacacgcttgtccctttcaccccacaagtgacacattacatttctttaagctggtgacagaggaaaaggaaacgagaaattggaaagaaacctcaacttgtcaatgcaaaagctttgggttttccactaacccccaccgacagaaaccaagattagtgaattttaagctgtggcatactactaaccgtaaggcagagagagactgatcgatagatcattccaaaaggataaaaataacctgacttaatcactgacagcaatttttctactgcaggtggtctaggatagcacggcatctacctgggagaacagacaacgaggtgaagaactactggaattcttacctgaagaagcgagtggagagcggcggcggcaagacgagccaagggccaccaaccacgcctgcgtcagccgcgagctctcccgccgattcagacgactcgcacagcctgcagcagaagccgcacgagccggccaactccgactcgtcggagccggcgcacgagtcgtcgtcggcgtcggccgactcgagctgcctgacggtgaccacggaccacccgcccgtctcgaggccccacgcggcagtgacacccaaggtcatgttcgcggactggctcgacatggagtacatctgtgggcaggtcgcggcagcacctggtctggacgctgccggattcgcggtggttggtggtgctgcaggcgatcagcagcagcagcagcagcaggtgatgagccaggacggatcggttcatcaggccgatgggccatcgtgcggcgtggacgattcttccctgcagcagcagcagcaggaggggttcggtggcaacggcggctgctgggattttcaggagcagttcgacagcatcgaccagatgcaggcgagcggcggcggcggcggcttctgcgacctgctctccatgagcgacttcgacctctgggccgagctggaacgtaccgcgtgatgggggaacgacgtgctcaaggatcgatttttaattagagcttgttaattcatagatgtcccgtggaaatcaaattaaggggtgtttgtaatactactgcattgtaaattatcgcggtgtatttatagagctgtttaaattagcaacatatataaggaagatcagaggcatgataagtcacttctgtacgaatttatgtttgccactttgctttggagagcatgggcaccgacagaaagatggaaaggaagaaggaaagctgtagagaattgcgcctatggatgcaattattttggtttgtttattgttgacattatctttgtgcttatagtgatagcattatggaacaatctattcatatctcactttcaaagacccgctgtgaagttccaagttttgttccactccatgaactgtcagtgtatcagaggtcccttcctttacacgtaggctttcatttccacataactcgtaatgattaaaagtgttcttgtaaatattggatcaatttcaactagtgttaagaaattgcaccctcttttataaagaccaatctgttagtgcctccactttcttcccttttcttcctgcagaactttaattttatttctttttcttccattcatctctttaaatgtacatatattagtagaagctcccacttaataaacgtcatagggttcatttgttttaaggaaacaaatcctataatattattgtccccatgacgtggttaatggcatgtgagacccattccccatgggcccacttatcagctaccacgtccctactactctatgttatattttgcattactcactcctaagttgtcttttttttggacggagggagtatatttttatgtttgactagaatatcatcgttacattttttttattacatactccctcgttccagaatataacaactttgagcactcaacatttgtcccaaaatataacaacttctccccagcaatctcgttccaaccaatcataaccctctaccattcacttttcccacctaccttcactacttaaccaatcataactgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggtcccacctaccttcactacttaaccaatcataactgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggaacgtcctctcttggccacgtccatgtgtccagtgccagcgcatgcgccatgctgtgtaaccactcccggtctacaccagccatgcgcaccatgccatgtcttttctgcacactttgtcctcactcgtgtgcacccgggaagaatttcccggtcggtcacctatcccaaattgctccaggccaagcacgcttaaccctggagttgtttggagattggcttccggaaaagaagttgcaacttgttgatatgagtattctattaatcctattaagccttaggtcgggatgttacaataaccctccattattcacttctatctattttcttaataaccgtgttcaactctaaaaatgcttatattctagcacggaggtaatactttttatttctaattttccaacagtgtaacaaaaaacaatattaccatatttcaacttaaaaaatttaatctttcggttggatctcccatcaatgtggagtttcagctttattctatactgtaccttcggttgtatggtatactatggttatgcatcatcccgtatacgtgacgtagaagataggaatagacatagagcattatttaagaaggataaagctttcttcaatttaaaccaaaagaaaattgatcgtaaagaggaaaagtaaatggcaaatatatcaatagtcatttcttctttcatgttcttctaaatggctataaaagcatctcctttgttgatcaaacaatgttagagatggagttcaggttcgagttcccttaataacaacggaaaatacttgttttacaaattagacttgacttatcgagccaggaaattcctatgcatatgcaacatcttgtgatgtctcacgtctctctttgcttgccaaggtctaagtgagtgaagatcaagcacacccttaataacaaaagagagaagttatgtttcaactaaatatataaaacatagctcgcccaaagtttagcatctctaaagcagattatttccgacttccatcctctgttaagagggaatccacaaatgccccatagatcatacgcagactctaatttgactaatttgaataataattcaaaactattttaaagagacagtgattacgagacattcatgctagtatgttgccattcaaaccttccaaataacaacggtaagctatggatttttttagaactacggtaagctatgttgatatactctttatgcttagggtgtagtcacatacatgttcttttttaccccaattaaatatcatcttttggcacctaaaattctattttcatattatttgtcgtagttacacttaataataacaattaaaacactacaacaaccatttacgatatatctatattaattatttagtcattatatttctatgctcctgctaatagattaagggttaaacttgatagatggaataccaatcacaagtagattaaaaaaaaagtaaaagggtctcattgtttgccttatgtttataagccaaagtttaattttgaatatgattttttgttttcttcatcatagtttattttacatcatttgtttttgagttgctatggacatgtatataaaattttactcataaataatttttatttgctaacaactgtggagattatgggtaccctatacccacacggcatggttatccgactagttataggggataacttatatctatagaatatgtaacagattatgacttgggtattacgtttccttgtatattacggaacggcctaaagtcctggtttgataagattgtaaagtagatttaggaaaccgataccatattggttaaggtttctatcttgtaatcctgccccccgtcctatataaagtgggcaggaggccctctagggggcatatgagcacatatgatcgttagatctaaactacatctggcggattcaaatcctcaaacaggagtagggtattacctctcattgagagagcctgaacttgtctaaatctttgtctccgcatccatccacttttaggtctcgtgcgctaccccttttattattgccgaattcatgtttcgacaacaacatatttggagtctaatcggtagtgcttactgcagcagcgcagccgcagccaaccagcccaaatctacacaaaacagttgatttgcagcaacatcaacaaggtgtgtgctacttgttggctgctgctgcactgtggcagccagcacaaactcaatgccttagataataagggagtgtttgaagagaaggggattgaggagattgggaagatacgcaaaacgaggtgagccattagctcatgattaattgagtattaactattttaaattttaaaaatggattaatatgattttttaaagcaactttcctatagaaattttttgcaaaaaacgcaccgtttagtagtttgaaaagcgtgcgcgcggaaaacgagagccaatctcccctatcacccctaaacgaacgatgcctaagtactttgagtaagcgaaacaatggaactggaagattgttttgaatttaaaaatacacataaaaaagtttgaaaagaagaccctgatttatcagcaattgagcatctcggcaaggttctcgccgctcggcgtcccggcccagccttttactcgtgggcataaaatagacagggccgatatcgtaatttcctccttcacaaatcccaaaccgccggtgccctagctatcgacgactcggcggcgacgcgcctccctggctccctcccgtcgctcctcctccccgacccacgaactccccccaatagggcagaaaggaagttcaaatttgctcctgatccgagcgccaaacgcctagattccaccacccaagcctcctctcccaatccgatctgccgttccctcttcgaatcggctcccccttctcgccgattaccgacgaatccgaggccctcctcctccttcgaatccatggatccgcgcgccaggtaccctcccggcatcggcaacggccgcggcgggaaccccaactactacaaccgcggcccgccgctgcagcagcagcacaaccaccaccagcagcagcagacgtcggcgccgcaccaccagcagtacgtgcagcgccagccgcagcagcatcaccaccacaaccaccaccagcagcatcagcaacagcagcagcagtggctgcggcggaatcagatcgcccgcgaggccgcgggaaccgacaggaatagcgagccgaaggctgtggcgcaatccccagccgtcgacggcatcgattcgaggtgagaccgtgagacgcgtaggccttagagtttggcgatagattatgtgatgttcaacttcaagggatgaattaaggaccagtgttgtgggtggcttgtttgtttaatttttttgtggcgaaattggaccaaatgcagtttgagacatatgctttccctgcagcatcctgcgaagtgagcactgcaatttcgtattccgtagtggcaatcactgaatgttttttgtccaaatatgtgttcatatgttgcctaggctggtactggaactagggtttgctgcattctaggtttgtaatttgtgaaactagaagttctacaaacagtaggtaggctggtgaataatatatctgatcattggcgcagatatggttatcacattgatcatatgctcaccttttgtgcagttcacaagactggaaggcccaattgaagcttccacctcaagatacacgatacaggacagaggtaaatcgcatttataaaattttcccctattttttcttcaaagccaggcaaccggtgctttgtatgctaaggattacacttgacaattgtaattgcaaaacatgttgactgtcatctgcgctttgccctacctatcaattgttattctgccaaacaattcagtgtggcaggagttcctttacctttatgattttttggtgtcgcacattgtaagctaattactatctccagtcacaaatacatgtcttgaaaattgacatggccttccaaatacagctttgacactaatttctaatttaatgtattaatagaacccactaaagttataatgttatgaaaaatcacctttcaagacaaatttacatatattatgttcatgtatccaatctaaatattgtaaatggtcttgaaagttttactaaatgcttgtccaaaacaagaattatttgtgacccaagggattattaattccgatgattgaaatttaatttgctaaactgggtttgaacatcttttcacacccatgagatatcctaatgttgctaatcgatgctctttatttctgttatccaattcaaacaaacaaagtttaatcctatgtggtcattgtaatatcatgttgataccttcttgtctaaaacaaaataataccttgatgacttaaaacatgcacattaagtgttgttaagctggaatgccccaagctccttactatcctggaggccacatgactcagttaaataattaaagtttcatcttactgagttactgtgctcttatatgttttcccttgtgctctttaatcttatttgtataattttatctttgtatagttcttccccactgtcttgattgaaagaataattgaattttcaaaagaatgtgctctcatggcttgagtttgctctggatatcgacattcttattttcttgctcttattttttttgcctattcttttattttatttggagatattatttatgagtttatatgatgttggtgtcatactctctgcatactttattatattctgctgttgttgcacaggatgttacagccaccaaaggaaatgagtttgaagactattttctcaagcgtgaacttctgatgggaatatatgagaaaggatttgaaagaccctctccgatccaagaagaaagcattcctattgcattaactggtagtgatattctagccagagcaaaaaatggaactggcaagactgctgcattttgtatccctgcactagaaaagattgatcaagagaaaaacgctattcaaggtttgttccagaatccaaactattaaacttattttgtaccaactctcacagtcaaacatgctataaacctgtgcctttataatgcctgttggacctcctttggtaccgtttattttatattattactttttttggggtgttggggggggggtggcctgtaggggatcttctttagtaaatataatattatattgtgcaagaatggttcaatgattgctcttgttatttgtagttgttatattggttcccacaagggagctggctttgcaaacgtcacaagtttgtaaagagcttgggaaacatctgaagatccaggtcatggtcaccactggaggaaccagcctgaaagatgatatcattcgtctctatcaacctgtccatttacttgttggaacgcctgggcgtattttggaccttacaaagaaaggtatctgcattttgaaggactgctctatgcttatcatggatgaggtaattcatctattctttgcaattgatattatattctcatgaaaactgttcagcagttcagtactcagtgccttcccagttgtatatgttatttcatggctcaaaagattattttataaggagaaattagggattgggctaaaaagaatagtaaaaatctcatttacaatcaaacaattagtgacaaaaaaaattagtgtttctatatacttaatgcaagtattttttttagttgctctttcctaagtttttccttcaaattaatgtttgcatccttcttgggttgtgctgaaccaatgaaccccgtttcttgtgtttacaactgattattctgcttgccaatacccatatgctgaattcttgttattacactatcccttgtttgtacttctttccagatatgtttgtctttagtaaatttcacgaaagcccaggttttcaggcatctgtaatgcaaaacccattgtattttaatttgttttaatgaaccccagattttgggaaacacttgactacctattgcactattttacttggattgtaaatttattgcttaagacaacagcaatgacaacacaactaggaatattttggaacatcctgcatacagggaaaaataagcacaaaaaaaagatttgagtagcccattcagagtgtgcggtgtgtctatgataggtacttggccaccgggaggtagggacttagggtgcgttcacgaaacgagaaagctcattaacacatgattaattaagtattaactactataaacttgaaaaatggatttatttgttttttaaaagaaacttctacatatattttttttttcacaaaacacactttagcactttggaaagctaatggaaaacaaggaagttgttgcttggagttgaagcttagagcagggccttagtattagtccttctaaaaagaaccagtgtaatggttcatgaggcgaagtagtatcttcaagtgagaactgagaaacatcgtggtttttcttttttgcaccatttaagattctagtgaactatatgaacctctgttttttgagaatctacgttgcatgatttggcttgataacgataatttgttttggttgtgtagcattgaacattttagttgataagaatttttatcttcttacgagtgaaatattgccttctgttcaggcagacaagcttctctctcctgagttccagccttccgtggaacagctgattcgttaccttccagcgagccggcaaattttgatgttctcggcaacgttccctgtgactgtgaaggagttcaaggacaaatacctgcctaaaccttatgttattaaccttatggatgaacttacactgaagggaattacacagttttatgcttttgtagaagaaaggcagaaagttcattgccttaacactctcttttccaaggttttaccgatgagcacctttgctttgtgttcagttagccacttttacctcccttatagcctgtaaatcatgcacatttgttttgatgcagcttcaaatcaaccaatcaataatcttctgcaactctgtaaatcgtgttgagcttctggcaaagaagatcacggagcttggttactcttgcttctacatccatgcaaagatgctgcaagaccatcgtaatagagttttccatgatttccgtaatggggcatgcaggaacctggtttgtacaggtatggaattctccgtgttccgcatcaactcttgactggttctattcttgatggatatttgttactgttcactgtctagtgaaatctcattaatgtcctactagaactaattgtttcagccgatctgaatgtattttgttacttcatccctgcttttgtatattctttttcttcttaaaaagaagcgttgatgacagtgttggtgtgctttatttacccgcaatccagatgttccgtagatggatttatgtgaatacgcatgtgttatatcttattttactaatgtattcattatttgtacatgtgcatatgttgttgttagctggtggtataattaaaatgtatgcaacctttttgatccaagtgtaattaattttcaaactcacaatgtgtcatacatatatttgagatgtgtggcaacacaggtacaatgaaaaggaggaaacaatatgctaattttaatacttcactaccaagttctgtttcttgcaagcctccataattcacttatatggaatagttttgaaatgttgtgattttgtgcaagtatatagaaatgtgtggatatattgcttacggctacacgaaattctgatattctttcttctattttaacttttcatttcttttttctttgcagatcttttcacaaggggaattgacattcaagctgttaatgttgttatcaattttgatttccccaaaaccgctgaaacatacctccacagggtatggcatttgaataaattcagcttttgatcttaggctttaatctaattaggatgtcatatgctgctatgagaataatattctagaaactaatcttaaccagtaagatgtttgtactaagaagaaaatgcacacacaagtgttagatcaaatgtggaaacatgcacacatatgttttatcatgtaattggttgcccctgtaatttgttcatagtttggaactaaataccaactgttattgtcatggtatctctcctttgcaatgttgtgtaggcagtgcagttctttaactgttattttgttggcctttttctaggttggtagatctgggagatttggccatcttggcctggctgtgaatttgatcacctatgaggatcggtttaacttgtatgaacaattacccaccacaattttattcatgtattttattctgacgtttggttcattgaactaagttttctttctgggaacaggtataggattgagcaagagcttgggactgagataaaaccaattcctcctcagattgaccaagctatatattgccaataatttgacagagttccagcgtgtattcactttctctaagggtaataagaagacaattcttgtaaataccagctcatcaggtaacttattcttatgatgaacaagggcaatgcttagcttttaattttgttatttcacaactaccgcaatggaaactattgttttctgttttttttagttagcctggttttactgtcagaaaatgcaatctgcacatatccatcaaaggcttttttagttaacgtatgtccacatgcgaatgtggcatatcactggtcacatttagtccaaaatgaaggtgactgtaagagcgaaatctgctgcatgaacatattagtgacactaaaatgaatgtaactgggtgttttggcatccctcggttgtcaataaccatgcaaatcatccatgctgcagcacatacatctgagtttgatttggaggttgaaaagcgaggtagatggcagatgtcttggaaatgtaacttttcatacataaaacagtgttttcaactttatctttttttctgagtcttgcctactttattcaaagaactaggagttatcactatttctttttctagaatttttttgctgttgtgcattttgtcatggcatgtgcatttgttactttattttgccttaaaagtaccatcatagtatttaaatgtggcagttccatgttcactcttttaactttttaacaacatagcagacatgatctccgtttgtatatgtgttttgcatgctgagattgcttgctcaagagcttataaattgccaaaattcaggagctttagttgacattgtgttacatgtgcaggttttatcatggatctcctgtggcatatgggaacattcatttttggagttttatttgagatgagacagactactcttccgatggacaccttgtgcttatatcattttggctaactaaattcaaacgccctcactgaggcacacagtagtgtatattgctaggtgcctgttcatgtgcctgtcctggcctcttagctcttatgataatctctccccttctctagatttcgttatcggctatttctcacaggacattttaaccctgttagtggttaactggttgtgggctgtgccatgtcagtgcacacattccagttgacgtgccatcgggtgtggacaagttcatccaacttgtgctctgaactgtcaatgaacagtaagcagcacaacaagcgtcttcagatattagcgaataaatctgtcgcaagccgcgtttctgcatccgtgccatgcagctcttctcttgcatgaggcttgtgccattatgtttagattctgcctcttataattgagtctaatggttctacaaactgagtttacctgtcctgagaactgggtaaaacatgtggtgaggcacatgcaacttgataaataaattttttacttaagtgaaattctcactcctggttcattctatgtttgcctttaaccgtgctggaatattttcgctgatggttaccaaatccacggtgctatggttggtgaaatcttgaaaagattatgttaaatagtcccaattaattacagctatcttgaaggatatcatctgttactacttgcaatgatctactcataataccttgtttgggtgtcttaaatcccaagatacagtctgttatacgggttcgtcgaagggatttgtgcaccctgccatgcttgtaccctgcatatgctatcggtggttctgaaatcctagcacatatccctttcgtttcataataaaacaacgtaatattgagtgtgacacgttctaaaattataaatctggatctctatcagatttgtagtattagtttgtgtcacattttttatttgttataaggttggtttttcatgggattgatggagtatagcatactgtagcagccaagaacagaaagggaaatataatcatgcgcaatgaatgggtttgcgtatcaatctcccttccattgctggacaagcccctctgcacagccctcacgggcgtttagcatggtaagctgagagtggcaagtgttctcaagcaacaggggtggggtggtcgtcaatggctccaacgtgtactaggcactactgaaacatacaccccctgattcccatgcggtcgactattatatgcttgtgctgcgccttgcattcaaacagtaacagtattttgtgttcttttctcatagtcgatttttgcagttgcagtgccatcacggtcaggggatatttttctccggcctgccactcttttttagataagtttctactcatctctgatgctgcgactgtgagaacgacaacacctgaccttgctacggagtattttgtcgtaactcttgtcttgcgatcgtcctggaggttattcaaagctcgactaggctagtttgaaattggaccaccaattgcatatccagaattgatgcactggaaagcgacgccctgtatacgaaatgggcagtgttgcagatcttgaccaatactggaggatctttatcctaagaaaattgtgggaactaggaaaattgtgggactaagaaaattatgaaactgaatactgaggagttgtacatctctctaccttgggtgaagtagcaagactctatcctcctctcctgttccatgccgtctcgactccatcatacaccatgaatgagaactgacactgcgtcgccttggagaacaaaaaacgtggtacatttggctcatctggatcgtctggctgaaaagagcgccacactgcatcggaaccgctacagtgcttcgcctacagcatcaacgacagaaacagcaccggtacatgtaccaacagattaaccgaacagtggcactccgagtcccccccaccaaaacacctgtccgtttgagatcatcatggcgacgcccgccccgcgcccagcccacccgcttcaaccacgagccctcccctctccctgcgagcctgcgtctgcgactgccactgcagtgcagcggccacagcgagcagtggatcgcagcgaggcaggaactcatctctgaactccacatttacttcgcccctctctccctctctctatgtgacccatacgctttcccagactcaaaatccgagctacgctcgtttggccagaagcctcatttaagattactccccctgcttttcgtctcggcatcgccggccttgctcgcactattactcccacgcagttgctgctgctacccccactcatcacactggctgtcaacgtgcggcgctgctaccgtgctacgctcaccaacgaaagctgccccgtgaaaggctgtaggggagcatggagttccttgaaatgcatggtaactggtagagatgttttaaaaataatagccatttccctataaatttctataaatttattgaaataatggagatttatagtaaactggtagagatttatagggaaacttgcgatgggaaatagccatttataaattttaaaaataatgatttatttccattatttttaaaatttattgaagattttttttttgaaatttatagtaaacttcttcaataaattttaaaaataaaccatacattaacttttttttgaaacaaaaccttcagctacggttctagccatagtgtttggtgttacatgctaggatcagtgcactgtaatattattagggggctattataccacgagattatgtctaaaccaaatgataccaataaggaattagactctgatacttatcagtatcagatatagtacatcaattgatacatatggataccagccgatacctaatgataccaggcagataactactagtaccagacttggtacccgtcgggtatcatatatgaagcttagaggggagggagaggagcggagatggttaccggctgcgattctctcaccgtgagacgatggcgaaaaacgcaggcgatgccaaatctaccttccttttccatttcccctccatttcctatattcttcctctttccttcacatcttcctcctctgtttcttctaaacgagacccatcccgtccttttgcattgtgtggctataggagaccaaattgccccctatctatcaatgttaaggcttcgtcacagccatcagctcgaccagtccagtccataccatcaccgcccctgtgtgtgaagaacccgcactgcaccaacgcaccacaaacagccgctgcaaaatctagccaccaccgtgcaacaatctcgtcgtggaatctagccatcttcaggtcgttctttgtcatagcggcgcgaggaagtgagagatcccgtcccaaacacgaggaatggatttcctgtacctagcattcccataaatattatgatggagttaattttgctaagagcaatatagcttaaaaagagttactaactgtacccaaaatttaaacatttcaatctaaatttagctagaaatgcttgtattttaggatcggccgaggaggttgctagatgtacacttgcgtaggacggtaggagtaggcccaaatgcgacatgaggtcacggccacaaagttatgatacacttgcgatgggtacccaacaattagtactactagtggtgcttatcatacagtaataaatacttcatctgaattactcacttgaatgcttgatctgatggcccgaagttactcttcggctagtttgctttggtacaaagtactccccatgaaaggacatataccagtgatagttctatctctcccccgcttgcgtatcccggccactcgactactcgagtagtggcagcagcacgactgcacgacgctagtacccgggcgtcaccgtcgccgttgcgcgcgcgcgctgtacttgcaagcaaaagcccccctcgtcaattgaatgcgtgcgtcgcgcaacgcaacgcaagcacgcgccgggttttattttcttttcttcgtcgtctcccacactctccgcttccgttccgtctcgttgttgttgctgccgcagcagcgcaggtgaaaatctccggcatttaaggttgcgccgcgggggatcctcctcggccacaaacaaaaccaccctcgtcctccgcgcctctgctagcgagtactcctacatagactagccacgtctccccccaaatcttttcgcacttcctttcccctccctttcacccactgaatcactcgaagtcgtcgtctcgtccacggccctgctgcctcgtgcgctccggcagctttgccgggggtgggtgggggagcgcgcgccatggggagggcgccgtgttgcgacaagaaggggctcaagaaggggccgtggacgccggaggaggacaagctcctcgtcgactacatccaggccaacggccacggcagctggcgcctcctccccaagctcgcaggtaccggctggcttctctgttcttgcgaggcaatgctttgcttctgtcacgttttcgtgttcgcgtgccgcactagtgctgaactgctgatcagcacattctgagaatctgtcttgatgatttcggccttagatgctgcttatactcgattgcatctgcataccttcaagctgcaataatcacccacaagctcgattggggctaaaatacacaaattatttcatcgtatacaaagtaggagtactgattaagtcgtacactcggcgagtactaggctcactcgtactactccctgctgggttttccttgatcttcactccaggcatcagcattgcctccagctacgaacactcggtcactcactccagggctccaggctcctaccattaccatgcccatgttgtgctactctcttttcgtgcatgagaagtactcggtattattcacaggagctgagagactctagtccgttccatctggataacacttcgttttgcgttgcatgcagggctgaaccggtgcggcaagagctgccggctgcggtggacgaactacctccggccggacatcaagcgcgggcccttcaccgccgaggagcagaagtccatcgtccagctccacggcatcgtcggcaacaagtaaagtcccccttgctcgtcttcatctccttcacctagcgagcgagtagccgagcaggactggcagactgaccagctcacatcgcacagccactgtgtgctagtgtgcactgctcggtgcgcagctaagctagcgcaccacaccgtagcactgtacatgcacactgtgcatggctcctcactcattcaatgttgacacatcgcattctccgatcatcacatcatatatgatatatcccaaaccggccggctggtgtactaccagtatatatagtagtggtacttgcttgtttggagtatgtacatgtctagtttagcttggagtcccagtgtatatttaggccattccactctaaaatttttctccctatcacatcgaacattttacgtttgaacacctacgcgaagtattaaatataggcttaaaaatgactaactgcacagacacaactaatttgagagacaaaactttaaagctaattgctccatgatttaacaatgtgatgctagattaattaggcttaataaattttactgatgaattctataattagttttttttattattgcccaaacaccttatataatactcgattataatacccgatgtgatacgcaaaatacttacatcccggatctaaacaccccctttactcatttactgtagttctatactgtggtaaatattcaatccagttagatatcactagagtgtactactactagcagcgcattgattagaagtggtggcacacacctgctgtttgttctggccaggtggtccatgatcgcggcgcagctgcccggccggaccgacaacgagatcaagaactattggaacactcacctcaagaagcagctgcgccggatgggcctcgacgatccgccgcccgggccggcggcgggctgcccggcggcgcgtcacatggcgcagtgggagaccgcgcggctcgaggccgaggcgcgcctctccctcctctcctcctccggcgccgcggcgacgacgacgatcaccgccgccaccaccaccacctccgcctcgtcgtcctccaccaccgcggggcccgtcgccgccgccgcgacgtcacccgcggacgtgttcctccgcctctggaactccagcatcggggactccttccgcaagctagccgtggtggcggcggggtcgtcgtccccttcgcgggcggacgtcacgaaggacgctgtgaagcaggaggaggaggcggcgccggccggggacgactcgtcggcggcgtccaacgaggtggaggcggcgaccatggcggtggacgagtaccagatgttcctcgacttcgccggcgaggagctgggcctgttccacggccggtacggcggcttctcgctcttcccgccggtcgacttgctcgaggcgtcgctggagacggcgttcaagtgacccgtacgtcgacgacgaccttgctcgccgcgcgccatgtacgacgtactacgtactccgcagccgcagcagcagcatcatgcctcgacgtaggagtatgtatataagcaagtgttctggggcgtccggacagtaggcgcgtccgtgtgaagggtaggacacacgtacgagacgtgggagaaaattttggggatcaattagggttctaaggataatctgtagcttggggtttaggcatggggggaacatcatggtgtgtattagtattacggccttttggatggcattctctggggggcaaggggcttaccggagatgctctaatacattcaatgatgttcgatctttcagtgttggatatggagctggttttatctgtgttggttgatctcagcaggaaaccaagagaagagagagtttgacgccaagaaagaagagaggaattcaggaaagttatctaccaggaaactacggcccttgactttctgtagaccaacaatggacctcgttacttctgctgattactcttcagccttcaagcactggagctgtgctatagcccctagtttatcctcgtgatctttctctgaggttgtgttgaatatatatacataatcggttatagtttagaacttaaatttatattagatattaggatagtagcgaatcttctgtgagcgtatcttttgagtttacttttactgtcttatgagcatgtcgtgactatcccgacgtacggtaagtatactatcaagattgaggagataacttcgatatacgatagaaacaacatgctactttgaaatgtgagacatgtgtcagaactaaggaagagatcaatttcacttgtgagcctgcctacataagaaagagtggtcgtattaggtggattatgatagaaagaccataaacatcatgaataacggaaagactgttatgactagtgagaggatgaggctcatgtttgtgcaagctacatggggacacggttataggtggagtcatagaagatgggtatgttggtgttgcagtgcacgttcttgaagaccgtgaggcaggcaaaggttcgtcgagtggcttgacgtgagcggcgaaaggaaataacttaagtctaggtacacggaggtttgcacattgagtaaattcagatttgcttgacatattcgctaggtggagtttgttaaaatttgtatctaatatatgtacgtaaatgattatgactcagagtcgaactatgttctaggctctcctaaatagagatacacatatgttctaaccacgtagcaacttagcatagatgattcttttaaccatagtggttatagtcaattatccagttccattcattatgcatgcatatcccttcctccctactctacatcttaggctgtgttctttccttcaagttcccaacccctctccctcgttttccgtgcgcacgcttttcaaaccgctaaacagtgtattttttataaaaagtttctatacgaaagttgcttaaaaatcaaattaatatatatatttttttaaaaattagctaatacttaattaatcatgtagtaatgcctgctccgttttgcgtcccctcctcccgaacgcagccttagatagcttgaagatcaaccccgtctccctgacttcccacccttttggtcccgttcgtttctgctttggattaagattaaaaacgggcatgtaaaacaaaaaactattagcgtatgattaattaatatttaagtactacaacttgaaatataaatatatttgttattttaaagctattttcatatatattttttcgcgaaatacgacgttttaatagtttaaaaagtatgctaatgaaaatcaaggtaaaattttaattttattgagaaaaatgtgctaacgaaaaccaaggtaaaatcttaatttcatcctccctcgcaattcttttgctccttgataatgcttctactttgagccattgatcatcttctgtacataatcgtctttcacatggcatcactttttttcatttcccaaggttcgcacatgtaaacactattattttatcaccctttagtatgtaactttggtggtgccattatcattatcaggatttactaaaccattgggaacaaggttactgtcaccccacggtttggtggttaccacggtagccatgcggttactgcgaaaattataaagtatatcgtgattttaaaaactgagaatattatcacctataataaccaccatagcacgattttataaactctggtcactatacataattcttgaaaatccgttaagaaggaatgtactttttattgataaattttatattatagtagtgctaatatgcatgcatcgagatgcatgaatttttatgtaggaatcagattacggttttctttagagctaacattgctataataccactttgcttaaaggatattgctaccactgagtaaaagcgcgtgggatcagaaaaaggggtccctgatgtgcagtggctgactctgtttgacttgtttctattcagaaaaaggagtaaatgcaccggatagccggtggggccagcccgacgagaaaacgaatttattgccacgctcagataaaaggccaaaccagagcagcgaaaggtttgccacgacacctgcagcacaggagcagcctgttgcctgtggtggcttcatcgccaggaaagaacagaaatgggcagggcaagctcgtcgcccctacgctaatgattctcttctgggagatactattaaatgccgtgccattgtggtcctttggatatgattgtcatttagagtttgtatagttcatgttaaaatttaaagtttggttgaaattgaaacgatatgacggaaaagttaaaagtttgtgtgtagaaaagttttgatgtgatgaaaaagttaaaagtttgaaaaaaaaattggaactaaactcggccttaatcaggactgtcgtgatggataacagtgaagaaacgattcttttttaggagtaaagtaaccttcccacactgtttgctcggtttgtgatcgcggcaaaattttcacttcatacccagggagaacgtaaaaattactacgtatgttccagtcatctagtagaatatttaggcccgctttattcgaaagaaaattatatgatttatatggattttattcctatatgatttttttcctcatatagtcctttgaatcaaattaatggtcactatagaatctcataaaatttatgcgaaatatctcattccgtctaagttttggagaaaatctaatatgaggtaaaaccttatgaatttttttttcatattttcatctctccttaaattcctatgtttttttatggtccaatcaaacgatcattctcatcttttttttttcaatcatgtatgttaaacttgatactatcaaaataatgtgtttttcgtgtttcttcattttctcagtcttgcattttaaaaggccctttatacttactccatttcaaaatataatcgtttctaattttatcctaaattaaactttcttagtcccaccgtgtttatagagaagagtattaatgatgatcatttggtgtcgcaaacactattgtcatttcaatacactcgatcaaatttagaataattcgacttaagtaggatgatgcttatgatataggacgaagggtcacaaatctgatccaacaacacgctgtagatggcgagtctttgatcttgtcagagggtagaggatcctagcaacttagggcacctttgaaatggaggattagcaaaagaattttggaggattcatttttctaaggattttttacctatagagccctttgattcatagggagaggataggaaaacttccatatgattgtattcctatgatcaattccataggaaaataagcaagaggttagacctcttgtgaaactttccttcgttgagtgtatactgtggtataatcaaatggctcttctctccatttcctgtgttttcaattcctgtagaattgaaaaaacatacaacttcaattcctacgtttttcctattcttgtgtttttcctatcatgcgtttcaaaggggccccatgtacaatggtctttattagtggtctatctttattgtcatgcaagcatatttggtgacgtggaagagagagaaggacaaagaaagatggttgctacgcatgacaacgacatagagtcgactcttagcattattaggaaattttttgttgcattgagtctaataaagaaaagataactagtaagaaaatattttagtacattaatggttagagaccgtattgtcttaactattgtaacgtgatagactctaattaacgtagagaccatactggtttttgtctttgtacttgcccttaaactccataacaatatgccaatccaaatcattatttgtcatgaataggctcttttggacatccaagtccttacataataactcccatggacaagagaaagaaggcattaatagaatgaacagcctaatatgttacacttaccgaacaacgtctatgtttggtcatgtgttctacaagtgatgttgtagttcccatatggtggagataatttcggtacttgctatatttcactcaagaaggtagaaggcaaattgctttacgcgatccacagagaagtcaacttgattcacttccccggccggggatcctatagataagaagattaggagagttgccaaactctaaccatcatgcatgtaccacacacttctactatgccaagggttgtttggttcaccatcaaactttatcatgtcacaattctggcatcccatagtttgttttatccatatttatttcataatcacacttatgagttaccgcggttaagctaatcatgctacaaacttgtaccctataatttattggcgacactttgtagtttaccataacttggatgcaagcttataccctaccaattatgccctatgttggtcctacagaccaaagacacaccaaggttctagactaataagccataacacctattaacaaaaaaatattttttgtacataaaacttttttatatgtgctattagcgacttacaagccaatgctagaaaataaaatacaatgaaaaataataaaaaaatgaactttaaatttaggttttaaaactcaaattttatttgggcatataggctgaagagcaaacaatagagttgcaaaatgtttaggatttaaggttttgtgtattttagaaaaaaaaactgatctactttcattttatatttcaagaaagcatgggtaatagaacatttaaagggatataactaaaagcaaaatatatattattacaataaatacatatgttgagtatatatactcctttatttaaatagactgcaaaggtggtgacagtgagtttgccaccctatctattcctatatattgtagttttatgtattacaacttgaacttcttaatatgacaagatagctaaatctaaatggatagctatatataaaattaaattaaagtgagtattctctaaaacaaaaggctggtaacatatttgatgaaaattatgccttttagtttcaggaaatattatgatttttttcctttaatcatattaaggcatggacatttagatagtgctacaaatagataaacgataaattacacttactttggtcttgaacaaaatgttttaaacaatcatgatttcagtggttgtatttgtattctactagtatatcctacgactgtaagtgtaacagaagatatcgtaaaaacaactcttccacaaccatcaatctgctagtacaatacatttgtctcggtttagaaattcccatgctatatgtgagatcatagtattgattatacggactacccacacttataaaaaagagtaaatttcacaaaactacaggtgttttgaccaaattatcacaaaactacagatttaaggagttgtatcacaaaactacatatttagcactaaatttatcacaaaattacagattttagattaagtatcataaaatgcatatttaatattgaacttatcacaaaactacaacttttggagtttaaatcctagcaccattgttatggtggagctataaacatcattactttgtgattaaattgattataaacctgtagtttcgtgataatttagttactaaatatgtagttttgtgatacttcatcttaaatgtgtagttttgtgataaatttggtgttaaatgtgtagttttatgatacatcgagttagatctgtatttttgtgataatttagtcatagtatatgtagttttgtgaaatttactctataaaaaaataatgcattcgctctaaaatatagaatattaataatatagttatatggataaattttctttatatttcaaaatggagatagtaacgaaagatatatactacgtgctcaatccttatttaatcttttgaaccgtcctgctttttgccgacccttagtttgtgtttagttcacgttaaaattgaaagtttggttgaaattgaattgatgtgatataaaagttggaagtttatgtgtgtaggaaagatttgatgtgatggaaaagtttaaagtttgaagaaaatgtttggaactaaactagacgtgtaaaatgccacgaaatttgtgggaggacatcacagacgcggcaataccgccaattggctgagatgcacccgatcgttggatgccacgtaccctagtctctatggcattgttggctctgaacaaacccaaagcatggcattttctggctatttactcccagctcctgggctcaaataatgctcaatcaaccagggacgatcggagctgagggagctttacaaacaaccgggtacgagacgagtcgatcagccggcgatcgacgcactctccaactctggggcgaaacgagagaagacatgcatgcagaagttcacgttgtcaaggaggcgatctcagagtaagtttaatagtagtataactctaaatcacctatagataatgtaatagacaattcatacaataattacttactatactattaatatccggtcccactatcatatacatattacgtcttggagtccgtactgcagctggctacaaatttatcgctcgctgctcttctctcttcttttatctttttaaaatatatttataactggcttataggctgctatggtaactgctctcacttttgctcggtgttggctctgggcatcatgcattgaatgcgcctaggacgacgaagagaacggagtcggagggagagaggcgatgcagttggggttggggccgctgcgacgacgcatgcagccgcgcagacaagcgtaggagcagcaggggaacagtagcaggtcagatagcgtgtgcggcgcgagcgagcgcagcattgattgcttgtgaatgtgcactgcctctggcacccacgtcaaattggggaaaagctaggccggtcgacttgaccggacgatgcgccgtactccaactctactactccagtcttttttctcggttgcacgagtactcggtgtaccgatcgggcgggccggcacgacgctacctcccccgtacgcgagaacgtggtgcctgatcggaggagtacgctacactatgagcggggaaagagcgcgggaggcagaagcagaaagagttagcgtgtgcctcagactttgattgcggtacggctccgtctcaggggcggcattcaatggttgtaggcatttggcgtacgtcgtgttttgctcgacgttttgtgcggttattcgttgatgagaaacagccgggggacgacgaggggtggcactgtactggtgggcctggtgtctggaggccttgggttccataaagttcagtttatcagccagattaccgcgaccagaccaggagtccatgccgtttattgagccgtgaagacgccgaagtaaacacacccttggcctacaacaaggtcttcgtcatccattgatttgatttgattgcgatttcagagctcaggccagatgacacgagcataaacatcgtgaaaataattttccagcaagtcaacctgtcacgttgaacgaaactgcttttaaaataactgaatgagtcaatttgtaccgatgtacgaaggtaaaggagatattatatccggttttacggttaaggaatacgattcaatccaaaaggaagagttgaaagtcgaaaacagacttatacgaagtgacgagccatcaaagtgtggacacccaagagcccaaaacttttgcaggctgtagcagcctatccactgcggatgtcaacgacccaaattcccgtgccagctgttgcggtgttgctcccttcacctcgtgagtcccgtgcccaccaccaggcgcgcgccccacgttgttgcccgttgggaccggagagagttcacgcggcacctgcgccgctcccgctccatcgcgacttccgcggcccgtctatgcgccgcctctttttttttttctttctttcggggcgatttcttctctgttagtgcaagataataatagagctcacttactattattagccaatcttaaagccaacacatataataaattagctataaagttggctacaattttcttctcatctctctatctctcacttatacattaattgtatttgtcttggagcttgtgttaagctagctcttgtatgagagccaacacccttaactttttgttacatctctcctccacataagcttatagtaggattatagctaacaattatacttgctcttagaatctttctcaataagctgataagaaaagttcgttttatgagaaaatgcatcgacgattatcaatcttaacgtgttattattaactgcactcgaaatgttttagaccacacaaagaaaaaatcatgagtcaatgacatgtaggacctacataagtcaatgacatatgggtcagatagcatatctcaaattttacaaaattataatggcatggttccaatttttccaaagaaaaaaaagtacacacttacaagttacaacccaacacaaataactttcgaaagagaaagaaaaacaagtatatggctcggatcgatgtttcttatgccccaaaacacccgatatgtttcttcggtgtcactccggttgcacggtacttagctgctatctcctcggccttgatcacttcttcaccgcgccgggccatcaccattgctctcttttcttcagcttccttatggacgattgcttccttgttcttcgccttctcagcgtactctgccttcttcctttccaactcttcctgtgtactcacaggttaattgtagaacagtgtgggtgatacacatttatgttgccaattctcaaacaagcaacatggactacttaaagaaccaatcactcatggattttgagtgtcaccagaaaacagagcaaatttcttccgtgtatcatttttctatgtactatatattgctcgtacttcacacgctgacaagttaatcaggaattcattgcattgcaattaaacatcatatcctttcccaaaataaaacaaaatccaacatcatcacaaaccattttgaaattcttatagatgagatgtgcagagtattcaaatttcaagcaccagaaaacataataaaattatctatctttttttattaaaaaatttatcttttttttcgcgaacgattaaaaaaaattatcttgacaagtgaaaaaacaatgaacttacttccttctttttcagttgagtttttattactgccttctttgtgttctcccatgaaataatatccaataacttcttagaggccctgacacagaaaagaagtgattcggaaggttatgtgctatgtttcctcaataaacacaacatgttgtaatggagccacatatgccctgacagtaagacatggtttcattttggtttacacatcatgttcgcacggagagagattctggccaatacgggcgattaaattttgattatgtacctgttctccgcttttgccttttcgttctcctcccatgctttgatcaacgattctcgcttgtctgtctccacctttgcaagggcaatatctaaaagtattcaggtgttaatttagctagaggccctcaatttgccagtgtgtaaagggaaaaggacagcataagttaatcacctctgtcatttgaggtccttgttggtgttgctgttgctgttgccttctcagcatgaggtttatcagcaacctctggtatgtgaaaaatcatgatcagataggtagaaatcagaagaatgacttaggtcgacctttgcatggcaaacaagctaaaaagctatagcgttcaagaaatcatgcacactagtctaatctccatttcatatgttgtttgaattgaaaaatgaaaagatgtgaatggctgagcattctcaaatagtattactataggtaaaagactgcacgccaaattcgacaaaactgagccagcaaagtactatactcactctcgacgaagacgacgagagccttggagtcatcggccggcggctccgtgtcatcatcggtcttggagatcaccggcgatgtcgaagccgccgggatgacggccttctcctcccccgcgttcgctgcggcgggcgtcgcccccgcctccttcaatgcctccccggccatcttcaccgcgctcacgctacgctactgactcggcgcggctgcttacaatgaaaccaggcaccgtactgcttttggtagctagtatactatacgtttggtcacgacgactcacgggctgctgcgtagtgcgtactgaataccgactgatacgctgaggcctgagctgtgggtctctttatatacagcttctacccggccgggcttctgcctagaagagcctggagtgagtgcgatcggtccatcatcaatacattagattttggatttgaatttgaccgtaaatacgagggatttggagtacaatctttctccatccatccgatcatcgtatttattgctaactggttgtcacatggctaacgtgattttttccaatcaaataaacttttagggacaacaacgtaatttttacttttttacattaaactctgctagaagcctagattaacttagatttattaagccgagcaggttattgtcacatagtattatctacttgattataaaagtaaattaaaaatttgagaaataaactaaacagatagattaaaatacgtgatcttaacaatgcaatggaacgaaatttaagtttagccgtaaaagtcatgttgggatagttcgatgaataatctttttaagagagaaaactgaaaatccattatagttatcgacggagagtgtacttattttagtaagtagtagtaagcagtagtaagcagtaacgtgactggagaaatatgcgggcgcgtacgtgcggcgcacagggtgccgtcctctccagctcgccgccggatcggtcgtgccatccatcctcaaccaagcgtaccgcgcgggcgatgtaccgcggctccgtccgtgtattccttgactacgtgcgttgcctctcagacgtggaaggcaggggagccgcgagttttccgaatgagctattctgctgcaatccgcaagctaatttacgttgtggctacttgtttctagggtgaaaatggactgggacgattggattatgacattcctattatcctatattctaacccatatttttttaaaaaaattcggaaccaggtacggataatgccgaataacatatcactcatctcatatcctatcccatattatttccttcgaatcggatttgggaacatgtctccatttgtatctctaattcatagatattaaatataataaggtactccctccatcccataatattagacatggtaaaagttacacggtctttaaaattaatctttaacttataatttctcatatgctataagagttgtagcaacaaaatctatctattatattattaaaacagccttgaaaggaggcaccacgttcgctgtgggggctagaaattcccacattaatcggaaaaaaaaagaagagtgcaaatagaaatacaatctaaaaataactgaaattcggaattaaaagtaagcaatattgaaagaggagtccatataagaacccaatacgagattaatcaaaattctaaataaaaatgaaataaaatccgaaattatcaaaaaaaagagagaagagttcgagtaggaatacaattttaaacggaattaaaaataaggaatattgaaagaagagtacatacatgaatccaatacgagattaattaaaattcaggataaaaaataaaaaaataaaaatagaaaaatgaaaataaaaagaagagttcaagtaaatacaatttaaaattaattaaaattaggaattaaatataagcaatattgaaataagagtaaatataagaacccaatagtagattaattaaattcggaataaaaaataaaataaaatatgaaattagaaaaagaaaagtaaaatttcaactaggaatataatttataactaactaaaattgttgataaaaataaagactattaaaaaaataccatctaaaacacatgatgagattaattaagtagcaggtctatagaggagcagagtggtggcggttcataggacatctaaaaactattaataaaacgccaaacaaaatcctaatgatgattaaaacgaaggacgacgggcaggtcgtgaatcaatcggtcaaggcggttggcggggcttctagaaagtaaaaaaataatccccaatgataatcatatttgatttttaaaatctcaattacaataaaaataaaaggcagctggcgggtcgtatatgagtacaatggcagagccaccgatggttgtgggtcttctataaagtaaaaaatgaattccaacgatagttatgtttgagttttataatcccaatggcaataaagagtatgtggcggatgggtcgtggaggagtatattggtagcgcttgataggatttctattatgaaaaaaatgaaacccaacaggacaataaactctaaaaactataaggtccaatttttaaaggttcaagcttctaaaaataaaaaaataaaccccaataataatcatgtttgattttaaaatctcaatgacaataaagaagggcggcagcgggcgagccgtagaggagtacagtgacaaagttgctgtagtttcggcggaacttctataaaataaaaaaatgatcctaaacaataattatgatatatttttaaataataatgataataaaaagaagatgtaatggacggtcgtagaggaatataatggcagcgtttgacgggacttctagaaattataaaaaagaagtccaacaggacaataaagtctaaaaagtttttagatctaatttttaaaggttataaggagaatgaaatagaaacagtggtagatcgagttatataataacgaataatatgatagaaataaagggtgctgatgtgatttttaaaaactataaaatttgaaacacgaggataataaggtttggctttgaaacacgaggataataaggtttggcctttcaaaatcttaagacatcgagataactatttaataaattttaagtaaaattatattaaaaaatatataattttatatgggtgctagccacgcaattgcgcgggccacccagctagttataattatatgaaagtaaatttaaatgtcaatctaatgacataatttttaacaaataaaatttatttcatattatattaaatgttggtcaaatgttttaaaggttaaatcttaaaatacgtgtatgccttattatgggatggaaggagtaattaaattattaaaagagatacatcagaaaaaaaacatataatattacgtgtgggcatgtaaaatagtgattaaccaatcttttatcacatttttaggtggacttataataaatttttgtacatattttataatacggaacatacgggtggatacatgtctttccgtatcctaacccgtatttttccaacgaatttggattcgaactcggttagtatcgggtattccttttttctcccatattcctcccgcgagtcttgagttgggtgggcggtcgggaaatacccgccccattttcacccctacttgtttcagccttctgatgatcgatcaggccttttatacgcgtcgtccagtgaaacttttatccgtttatggtgagtatttgcgccctccaagcatctccaccgtttttttttaaaaaaaaagatgcatctccaccctgcgtggctgccgcccagctgccacggcgtcgagtttgaggatttggatcaggtgcagtcacaatagtgactgcaacttaatcagtagcattagcaccattggatgcgaactggacagctcagatcgcgaactgtagcactgtagcacgggtactgttcacatggccactgtagctttacatctaaaccgttgatcagaaaaacggatggctggtgttgtgtgcagtgttaacttgcagttacaactgtaactgcaccggatccgaattccgagtttgagtatagccaatttaattagccacacaaccaatgaggggcagggttttaagttttaactgaattttgtttcgaatgcgaaaaatattacacatcaatatattatattagaaggaagaagttttaagcgagtgatatacttatcgattaaggccatatttgtttcagcttaagattattgtaatctagattattaaatcagattactctaagctgtattataataagctgacataaaataagctatgagttgtttgtttctctggattattagaggcatctaagagtagtggatctttagccactcaataatctgaaaaaagctagcttctctagaggagattattggattatagtaatctggcttatatgttataataatctagcataataatctacttgtttgtttcagcttacagttaataatccagattataataatcctaagctgaataaacaggggctaaaactagacacttgttagttgccgtgtttgttgcagcccatcatttctttcctattccttttccagcgaggtcgtttgcaaatatttagacgaaacaaattaaatatagtgatccaattgctcaaaaacagtggttgttgatacaaatcgcgcgctattaggtctgtactatcgtgcgttagtttttttatattttttctgttgtgtagtactgtatagtctgtatggaactagccctttattcagcttcccctaaactgtacttttttgttggcaaaactttttccgtccttgtatttttttttcagactataaatacaaacttttttgaaagaaaaactgcaaatacaaactatatgcactcccacacttatataactatataggactccctatctcatccttttcccctttcacaaagatgtatgcaatttcgtgctttgacaacaattgtgacttggaagcagttatctaactagcagcttttgattattctatatgcgtgttacattaagcacgtttaattggatcgtcactataatagtataatcaatggaggttggagattctgccagctagtagaattttactccttttttttccagaaaaaaaatgaattctgattctgctgaaaaaaaagagggtgttactcatgtcgaaaccatctgttgccaagtggtggtgatcccattctcatcatctacaagagtacggccctgtttaggggagttttagattctgagaagcagctgtttggtagccagcttctgagaatctagaaaagctctgaaacccagcttctccagcttctgccttcttagttcatttttcagaatatgtaactatagattctcagaagctgtggactgtttggggcagcttctagcagaagcagcttttgagaaaagctgcagctgagagaagctcctccaaacagggcctacaagtccgatgagacatccaaagtcacctcgccatcagcgatgccaatgactgtttggtggcgccaccacctaccgatgcgaaggatcatgagacaaaatacgattcaaactaccaacaaatttgcccttttgtgtgacagacttagagagggtataggtaggctgaactgcaacgatgatgtgagcggctattggatggtggcacaggaggacatatcaaggtgggaaagacaaagccaaagtaaaaaaaaatccacatgctggtagcatgggaaatatgatgtgagcggaacaaacgagtatttccaaaatcaggaaaaatccttgccgcagctgctagacaagatacagaatgaaatcaagctatggaaaatatgtggagcaacaaatatcgtgagatttatcggcctaagatgttttgattgattagtagcttttttctttttttttctctgcctctttttcctctcttttcctctttcactgtttggtgatcttgtaaatactccctctataaaaaacgaatctagaaccggatgtgacacattctaataaaatgaatttggacagagatatatccattgtagtactaggatgtgtcacatctagtactaaattgattttttataggacggagggagtactttcttcttccctacttaatataacacctgctttgctggctttagtttcaccaaaaaaaaaaaagcccaatccacacagctaccacgtagcattttcacctatcctcaaattaaacacgttaaaaaataggtttgtcctaacccgataatccatgtccctccaatcaaacgcatgctttcttactcacattaacacaaggattgttggccaatttgaggaatgccacccctcacggattgaaacgaaagagaaatcagctcggacggctagaaatgttcctttacacgaacatggcatggacggtagtgacacgtccgacgccttctatattaatatagattaaccacataacaaatacacacacaacaaatatgcatatttcctttctttgtatgtccagtatgttctttctttgtttcaaggggagttatatgaacaccagccaccaggtctcactgtggcaacaacaaacttctttggttgtgtttgtatatgctgtaaagttgtaaactacagatgttctaactttcagggattggagcatactcatgcggttcttcaacgcgagcaggagaaacagcagcaaccacgacggaagcaccgaatagcacaacaatcaaagccgtgaagttcaccaaaaatgcctctgcgccatatttgtcgagccctgagctttggaggaaagtgagcttctcaagaaatccgagttctgcggtggccagggctaaaatgtagacgaagagcccaaacagtatatgccaaggaagaacacccttcctcacgcttggcgaagcacgggggaagaagaaagcaacaaacccgaatatccactgcaatagacaggcgcattttacaagaagttgtcaacaatcaagtaaagttatatataaaaaaaactctcaccgggcagatatcaactactacaataaaacttcgcagttcaataaatgtgttgtagatctttcagctctgaaaagcaatccattttttcatgtctttcggtggccaggaaattattggtactaacagctactggtgtctgctaacttattcagattcatgagtttttagttgtgaacagcacaacaggatacagagtaatcatttaaccaaacacattcagaaattgatgcaacatcataattgactaaattgtaaaaaaaaaaaaaaaaaaaaaaaactcttctatgtgcatgctttaccagctattttaccagttggttctgttgtaagttgacggtttcagacaaatcataataattggactaagtcaatggcttatatggaatagaattgctgccatatgcaaggggttacctgaataccatacaaacaaattgttccaatcccaagccaagaatgcagactgtagaggttggcaattccactttcattgtgaaatttgaaagcgcagtatatcccaaccgcaccgaatacaagggcaattgcatggagaattagatggatcagcttagttgtatcatgcttccaagtaggaaggaccttgtataccattatagctgccaaaatggagaaggaatattactaaaacttttccacgaaccacagaaataataataataacaacaaaacaacttaccttcactgcctaggattatatagccaataagcataagaacagggtgaacctgcaatgtctcaacattagagatatgggcaaccgatttgaaacgctaatgtacagtagtatcctgaattactagtagtaaggaatatgcaaatgattagaaactgcagaacagaaaagaaccgaatatacagtttaaattttaaaaggtccatttgccgttaagtccaagtttaacgtcttttaaattgggcatgcaaaattaggtggcgcgtttacagaaatgtgtagcaagttgaaatgcaaaatacgattgctttttaacatctttctgtggaccaattgcatttttaacatgacgtcatgacccgcttcatctgatatgaattcaacatcatgcaatcattattcagccctccattttccccatcagatggacaacatgccaatgtgttgaccaacatggatgcatgagcataagagcatccataattcaatacccaacaaaaaacatgccaatgtgttgaccaacatggattcatgagcataagagcatccataattcaataccaaacaaaaaaccaaataaagaatacaccacatggtgcctagttcaataacctactccatcaagcaatcaaacgatccctgattagatgttcaaactgaacgctcaacactttggctaacttaacacatgcagcaaggcctgcaaacttatgaaagtcaacccaattctcattaagtagtcacaaatccgaacaggttagctaaaaaattgcttaactacatacgtatagcggggaaaaaaagcaatcttaacaacaattcatctgttcattcataaccgataacacaacctcgacaggactaaaatttaagcactatcctaatcaccatggcaaaattaacagcaaaaggtaaagcagatgccatcaacatcctgcttttcttgatcaaacgccaaacggatacgacggccaaagtatttttgcgcttccttccttcctaataaagctacctacccctactggatatgactccaaaattttcttttgggaaacaaaaaaagaaaaaacagcggcacccaaaattgtccatccaatccaatatctcgggacggtatcactagaaagataactagagagacggggggcagacgagaatcaagtactcacgttgaagatgaggttcttgtttgtggcctcgaaggcgaggccgccgcggaagtggatgcaccagaccagcaccatggtggcggccgccacggccagcgcgtgcgccacgtacgtgaacggcgccgccctcacgccgagccccatcgcgccccgtctccttcccctcctcgcttcgccgcggccgcgctgtgccgtgccgctgctaccggcggcgggtctcgggtgagtggagaagagaatgccggagcgtagttgtcccccacccccaacgcctcctataattaatactccctccgggaaaaaaaaaacaaaaaacatttaaccgtccgtcttatataaaaattatataaaaaaattaaaaagataaattacgtataaagtattaatcatgtttattatctaacaataataaaaatactaattataaaaaatttcatataagactaaaatgaacagtcaaacgttgaacacgaaaattcagggtttgtctttttttaagacgaaatgagtactagtaaagggatattttggtcttctttaaaaaatccccgtgttgttttcgtgggtttccgatgaggccggaaggtgccaatgtacaccaatcagttgacgccacggctgtatacctattgatttgtaagattgttgtgtatgaaagcatgataattatatttgaaaatggagattagaggtatgtaaaaatatcatatgccttcgttagagtgaaaaggcagcgaagggaaacggaagaatctggtctgatccgtgaccttcgtgtcttcggctccgtgggatttgggaagaaaggaaccggccgccggcggggcccggcatgacaagcgacggcgcgagagaggttggttggtgggaagtactggaatgttcaggcataacaagagttgggattatgcaccacggcattataatgaactgttaaaaaaagtttatatacacatttctcaacaaagggcatttggtctagtggtatgattctcgctttgggtgcgagaggtcccgagttcaattctcggaatgcccccactttttttttcagaatacaaaatcactttttttttcagaatacaaaatcactttttttttcagaatacaaaatgtgttttcttggacattgacaagttctttttttttagtttataaaatgtgttttcttggacattgacaagtttttttttcggtttacaaaatgtgttttcttggacattgacgaggttttcaaaatatacttgtggctacttatttgtattgtaaaatattatgtcaaaatttatatttatactttaaagcatctgcaaaaccgggcaaacataagatagtacgaaaaatgttttttttcaattcaaatgtccacatgatactttcacaaggttacagaatgtgttttcttggacattgacaaggttttcaaaatatatactgacttatattgtaaaatattacatcaaaatttatattgtatttttaaagtatatgcaaaaccgggcaacacataacattgtataatcatgtgatgattaatcttggtgatgaacaattgtcaaaggtgagtgttttaaaaaaaatacagcgaatagtgttttctgttggtgaacagtgcgttggtactatgtggccgaactaactagagggattcaggcggcctgactgggtgacccgatggttagactagaatactttgggttggagtcggttttaagttgttttcatgatttttttagattgcttcatatttataacttctagattgtttctattagtatgtgatactatcgtgtgctgatgtgagttaagttggtgcgaattgtactcaaatacaatttttttattcatgtgcaggtgttgttggagaccataggagtatagccggtgatggatcgggactaggcctgggagaaattaaggtctagacggcaaatgatatcacgtggaatgctcaggctagagaataatgcacctggaggtaaaggtttctatatgatatatacgtggtgttgtgtatgtatgaaaaatgagtcaaatttggattggagttcaagtttgaaaaaattagagtgtggagttgtatgggaatgttgtttttcaggtttcgtaagcttcctatgtgattaggagtcctagttctagttggattcgtggctaggggcagccacgttgtgagtataaatagatgaggaattgagaccggaagatatcaacttttttttttttaaaaaaagaaaagttagggtttgctttgaggtttcgattctagttcgtgagttaagatatgagtgctttagatgcactttataaacatatattagtgtaataaagttgatatattttcaagagttttgtactttcgtcgatacatgtttttttgcataccgacggtttgatcaaagttcattgggtggtctaataagcagcatggcaacgtcaaaccggcatcaatctagctgtgtgattggtgtaatttcattaagtttaactataacttttatttccactaaaagtttagattttcggtgttcgtaccattcatctctctagtaggtttggtttatgtattcgatcctatcaagatagtacagaaaatgtttttttctatacatatgtccacatggtttttgttatgtgtaccatagttaatattccctccatcctaaaatataagaatctaggactaaatggaacatttcctagtactacaaaactagataggcatcttatcatccggtcctaagttattatattttagaacggagggagtaggatagtaacgatgtttaaggttttaaatggttaactctaactccctccgtttaaaaaaaaaacccaattctagatttgaatttggacacacccaggattggatttttttgacggaggaaataagtcctcagacatgttcaaaacaacatgctttcgtgcttccgtgaccggtatgagtacaacagttatttgcagatagtggcaatgattccctaattttcaacaccaacaatatacgtgcttcttaaactgctaaataatatgttttgttaaaaaaaatatagaaaatttgttttaaaaattacattaacattttattcaaatttaaaataattaatatttaattaatcgtgcgcaaatggctcatctcgttttttcatattctcagctgatattaccagcgtctcccctctccagctctccttaaaagagcctctgtctcctaaaggcctaactagaatttgcttgaataatttgctactgcagcccagcacaagcgacgccatacatgcgcgacaaaagatcccaagcgggcctgctgtgctgtgtacagaagcggtctataaacctactgagccatcagagtttgaatgccctcccggctggcccttctccggttgaccgtgtgccgcgccacctggatgcgccgccgccgacggctgccgcccgctactcggccccgctggtgctgtcgcgtcagacccatcgccgcgcacccccaccaccccgccaacatcagcgccaggcgccactccctggccatgcccgggctcccctgccgtctccggagcagcggcgccactcgcgccgggccgacgagagggaaaccgcccgccgcgtcctcggaacgtcccgccgccgccgccgccgcgtactactgcccgcttcgcgatattgcggatcgggccaaccgcggacgagcgcgatgcctggaacccatgctgcgggtgcgggccttcgtgccacgggtgtccgcgcggcggcggccactggcgttgttggtagccctgaaatggcgcgtgcggcggaggaggcgggtggcggccctgcagcagcgcgtccgggggcagctcgccgatgttcacgaggtactccgcggcgaggcggccggctcgcagcagcacctcgtccctctgctgcggcgtcatgacgacgtgcggcggcgcggccgctgccgggtggtggtggttccgtggggcgttgggtccggtactccctcggcggaagcccgcgccgtggttgttgctgtagcgaccgaacggtgccgcgttgttgccacgggggttttggcctccgggcttcattgcctcgacgatggcgaccgagatgggtttacgcagacaagaagaacgacagcgcggcacgatcgaactcgggaattgatcgcggggcgctggtgattgataaaggcgctggtgattgatcgagtccgtgttagatacggggcctcggagtccatcttagagaatgtatcggacaccaattctgagcctcccatgtatgaaatcgttgctagtatatttgaggaattcaaaattggaataagttcactttgtgaccctcaaaagcgatcgaaatctaatctgtgaccctaaaccacaaaccggatatcttgacccccccccaactcttaaaaccggtgcaatttgactccctcggcggtttctcctacgtggcggttttcaccgggtctcctttacatgtggcgttgacatagcgcttaggtggcattaaaaataaaaatatgtgtgtgagacccatttgtcattcaccaaaaatatgggtgggacccacataaatcatcctccccctctctctctttctcttcccttcggcgagccgcgagcgtgtgacgacggcggcggcgggcaggagccggcagcgacgggcgagagccgccggcggcggcggctgtgggccagagcggcggcggcagaccgaagatggacggagagcgacagaggtaggctcggcccattccaccccggcgacgaggtcccgacgatttctcttcccattcggttggcggtggcggtggcggcaggcccagctcccgcccgtcgccgtcgatggccgccgcatctaccgctctcgccggccctcggccgcccgcccgccgatggttgtcgtcccgtccccactgcccgtcgatggccgccgcatctaccgccctcgccgtccccgccgtcgctccagctcccgcccggcgcccgacccatggtgccatcgtcagctccctccgtcattcacggcgccgccgagaggacagagcctatcctcacctccaccggcacagcgccctcactaggggacaagctccctcacggcgccgccgctattcctgaccgccggccgccgccgccactactcacgaccaccggacgccgccgccgctactcccgaccgccggatgccgccgccgctactcccgaccgccggacgccgccgccatccccactgccactccggtggtgaagagaggcggggggagagaatgagagaagggagagagggaggaggaagaaggggaggagagaggacgacatgtgggccccacatgtcatcctctgtgtgaatgataaatgaattatttttttatttttaatgccacctaagcgccacgtcaacgccacgtgtaaaggagacccggtcaaaaccgccacgtcagcaaaatcaccctccaaaaccgccgagggagtcaaagtgtaccggttttaagagttggaggggggggagggggggagtcaagataaccggttttatggtttagggtcacggattagatttcgatcacttttgagggtcacgaagtgaacttattccttcaaaatttccccttcttccataacgactgaagttccttactgggcctctagcttttgaagccattcttttcaaatctcacggtagacagggaagccctctttttctggcgtaaaatggccttgccccgtaatacaaatgatgcaccatatgtttattataggagctttgccactgatcggaaacgatttggtacattatactggaccagagcaaatctcttattatggttgcctcggatgtcctgtaaagagaagtccacacccgcaaaaaatcatcgacatgcgggctacagcctacagtacatggaataagtatgcacatccgtgtaaaatatgggttgacatttcacagataaatggagtgcactgcaccccagaaataccctttttatcgtaagctttttctttgtttgaacgaaaggacacaagctatgcctattgcaccaaagagtaataaagaggataaaatagaagtttacaagcagaagggaagaaggaagcaacacaaaaacgaaaaactcatgcaaactacgctagaaaatatcctccaggcaatgtcttgtgactaaaggcactggtctcgaaaagttagcctattcaatataccatttaacctataccgccagtgcttttgaatgcatgagcggcttttaggtgtaaatcacttctttacgtaagttaagagtttagacatatcttcatggaatatctttacaaaataaaacaccagcaacttaaatttgaggatacagggacagggagcttatctgacctgacatgaaaatctacgtactttcctctcgaaatctatttgaggatagggcacagggagcttatctgacctgacatgataatctacgtaccttcctctcggaatcttttccggaagccacacccaacaccagggctgttctggtttcgccagaccagcttgctctgtttttccttcccatatgtaacaaatgaaagtttctgcacaaaattattcaggttttatcttcattgcatctcaaacactagaaaattcacaatatcagaaaatgtttcagcacgtacctgtcttgctctcttgtcaataggagtccatgttggatcaatggacggttctatcctctttttgtgacttgttggttgtacattgaaatctttccttgctctgcgattctgtgctttagctccttccttgcctttcccataatgctgagtcccaattgaagggctctggtccctcgaaggagtgtctctatctcctcggtatctgaaggattctttaggtggaggatttagaatctttgagttgctatctctcattcttgggatcgacatacctggtgaattactacatctagatctctcctgacgtgcttttctctttgcactcatttgccttagataatcaatttcccagcatgacccctgtgaagttgcatggctaccaaaatctagtttctgaaaagcaagcgaacttgctggatgttgcataatttcatctcttggttcatgatatctgttgtccatatcatatctgtaagagtcgtctacagtacctccatgtgcaagccccttccatgtttgttttgtacctcctgaaatgttccactcaccaggatcatcgttgatctcaaatgcagttgaaaatactggattgctatgagttctgctgcaagatggtctgcttgtgtgaaaagtgcttttgcttggatgcgtaccaccaaattcaggttgccagggtaagtcgaatgtgtccaccatattgccagtccttctgttatatgcttgattatttggtgtcaatccattgctgaaatcatcattaatgacttgattaccaggtattgcatccacatcatgcttcttttgttgataagagaatccctcacttctcatattcaaactttcgtcgaatgtaaagacatctgggagctcgggaattgtattatccatgtcagagaacttcctcaacttagaaggtgagaatacctcagcatgttctgcatagtcaccaggtatttggtttagagaatcagaaaagaggagcttattagttggtactgcacaagcctgcaatgaacgctgtttccttttcctcggagactgcaggaatgcactactgatatctgaatcgactgaagagcattcagtcattacagaccttgattcacctaactcaccaaatttgcacaaagcattaaatagggaaatgatctttggagacaaaagatactttccaactgcttgaatacggcgctcatgtggccaactgaggaactccacaaggctgcctccagaagaaagtaacatatatgcagacacgggattgatggaagggaaacttgtgagaaatgattcagccaggctttctgattcaggtatatctggaagaggagctttataacagctagtcacatttgtaatgcaattgagaattatttcatctgttgacctgggtgtgtgtgagaagaacagctgcaagttcatgtccaaactagcagctgcagtatacaatgaatcagatgagtccattacagcagaaaggaagtcagcttctccctcaaagacctgcaaaagtacaaggaaactgttctcttatgatagatcaagaattatcacattcacaccaaaccaaaacagacaggtgcatttgcatcaataacatagcaatggcctgtgatgctaactatatacgaaaaagtaaatacttctagagggatacaaaattaattaccatgatgcagccagtgaaagagaaactaactgacatcagaatgttggtcgcaatattctctacattttcttttataccagatgtctctgctgatgttgttagttcattggcctcaaagagcgcagtctcataccatactaggcagacagcagcactgagtatcagatccacaggcagatcaatatctcgctccacgacctgcattcctcctttctccagagctagtatctgctgataagatgatcttcgcgaaacaagcatcgtctttccatgatttccagtatttacaactatcactacatctgggacggacagtcttcctggcatgatgcagtcatttttcacacaggaaggtaagtcagtagtggactgattctcttgagggtctttcagcacattggcagatacagaagaagtagagctactcttctcaactgtgggtacacattgtgaattgacaacaggtttattactcagtgtttgctgtatatgtagctgttcatcagcaagcacaacgttatgtgaatcaaaagtattcttcttgttaagattttgtaatctgtgtggttgatcatctggaagcagttcttttgtagcatcagcagcaaaatgtttgctccgtttttcttgaagaccttgcagttgatttgttgctggtatgaagtttaacgaatcaacaatacgcattttattcatcctctcctgcaaatccttctgaagtgtaagcaaaactttatcctgcaaatagtgaagcattcttaggaagttaggatgttccatgttgatcatttgctacaaacacctactgccctattactaagtgtaggccctcaaaaacaaatatgtggggaaaaaactcatttgtatggttttccctctaacaagatcatgcaggaaactcatgctcaattgaagtactcaactacaatggatagaagttatgattacagagctgagactaagtgtttcatattacaatgagctgtgtgtacaagatataaaaattttcatgtagtgcccccctccccaacacatacaaaggctggcttaataataaacaacatgattggcatatgacaacagaataaatggcagcatggagtgagtgataatcaccaatgtagatttcaaatcctggtctttatggttgtcctcgactagagcagctggaaagtccttgccatcaactttgacatagaggaaatgcagaggtggcaaaccatctaatttaggagcgagagataacaaggtagatgatttattcgggcctccatattccagtatgatgccaaacttgtcaaaagggaatgaagctggaatgttccttcaaaatgatgacaagaatggatatggcataatatttaatatcagacaagcaaaaactaaactgtgcatagaaacaatttttttgacaaaaagagccaatgaacttctggtacatttaagttattgtaaaaaagaccccaaaaatatgtctaaactctaaccacagttgatcaacaatatgaacaaccagtgcaagatgactcagtggctcacaaggcaattgatccttcttaaagggcaagctacttctaaaaacatgatcgtcttgtaatatgtccatgactccatgcactaagaaatgaaagttgtggcaaacatggagggactgttaatgtaacacattcatttagctcaccagaatgaattcaataaatcctgcactaattcttgtacagtagaaaaaggtacagcaaataactagctaacccccaagaaccagcctatctgcttgttgaagttgatttgtaataagaaaatgaaaagcaaggaattggaaagaaaattggcttggtttatttatcaaatggacttacttgttatctagcagaatgcaatctgatttcagtaattcttccagcacccaagctgtagagtttgtcttgttcaccagatccacaaaagttgttgcagggttttgtccaaactcaacaaatgtcatcctcatggatgctagcttttgacccagtggcagccagaaagctctatcagcaactataaggatcttttggtcgatttgtttattagatctcaggatagtctcaatgcatgacaatgacggatgagattcaaacagttgcctctcagatttcctctgtgcttcagaaatggaccatagaatatgttttaacctctcaggagtgttttccaagcttctagtcaggttgctaatgtacaaatgggccgcatgcagaccaaagaaacataagtaatatgcaacctgctttaatgcatacagtacaatgagttccatcttatctttgtgttcgcagtgattgtacgagccttctgaaccttctcccgttatcagttcaagaagtttctgctttgagattcctaaaccttgctcatctgagaaagaatgcctccaatatgtgctttcttgcagagcagatgtatagcttgcatggatttgttctataaggccttgaataagatttgaggggctgacaggatgaatttctatgagtttgtcaaccttagccctggttgaaagagataatgcttgctcttctgaatgcgggacatctaaagtagaagtattctcattattggttccactcttagtggcacttctgacgtttaagtaaaaatttaggtcaccagaatgtgatattaactcagggaaggaagatgacttttctggactcggtcttttcatggaactatggtttctagtaccaccttcttgttcgcatttttgagttgcttccaatttttgtggatcatgagacagtggggcaggaacataaatatcgctatgtttatcctcatcttgaagctttggacttctctgaaaatcctccagaaaatcgctaacaaatactgatgtactctgacaactcctttgcagctcagaacttaaatggcaagtttttgcctcctcaaccatgcttgcataagaacaacaaatctcccggttgcatggtccttccagtaagagatgccaatccaaataaattccatcagatgctgatagagggtgtggttttagggagcatagtatttcttgaatgggagggaccctagacctaactgctatatcatcatttaaaataggtgtaggcaatgacctaaatgtatcatcaaccagtgctaactcgcagctaaccattgattcatacaaacgtcttgctggatcaaaatcatctttgaatatttcatcagatatattcatcttatttgtctctgactgaacaagcattttgaatacattatctgaaggaaaatcaatgatctgtacctcctctaaaagaatggagcaaggcaagtctgaacaggtgccatcaggcttgagagggtagagtgctgaatttttctcaagcagaatattgccattgatcctcacaacatccatttctactgcagctttgatttctgctggtttatctacttgaatgtcatggcatggtgcatcttcacaaacaaaggtcagcatgtccatgtcagttgatctcaagaactcggttgatttaaacactgaatgctgaatctgtgcttcatccaagtgtctaacaacattatcaaaaacaccgtatctgtcagtctcagtcagacaatcgtcgagctcccaagaattcctacttacttccaatcgaggtattactgcaccatgatctagtgctgcaatctccaagcagcagtcttctctcagagaagaatggccattgccatcattgtcttttacagggaccttttctacttgatacactgactctggaagatcagattgatatcttatttttatgtcggtctcaatatcaatgaaatcctgtgagaaacagagacgagaacgtgagcatgatgtatcaaagaatatgtttgagttaataaaacacaagggaatcaaatcaacatgttcaccagcaggcataagcaacttcaactgatttatgtttttgcaactttgatggtatgatagtgatagttacataatacagaaatatgacagggaggatacaaatattactagtgaatccacaattaacacaaaaggtaggagataaccgcttatcatgttattgtgtagaagtatatattttgggtgatgcgcgcattacaatcgaaatacaacatggtataagaacggaagtatcataaccatttaactctaagtacaacatgttcatatgtctcccatagctgaactgcagctccatgcgcattattgatcttttgggagtatagaggagcgaattatttgatattgtgatgagatgatgtagttaccaaatggattttcatatctggaacacgaagcaacaacgtgacaccaccaccagactcctcttcaccaaaggatgcaatgtcttcttgcaaagccttagacaccagaacaatcgagtttgaatttgaaaaggaaacaacataataatatcaaccaatatcactgaaacgctgctcaccattaggagatccacctctacaacctcaaatctaagctccttcaattgttcccacctctagcaccacataatgcataaatcgaacatcaattccctaagaacagtcaaagcatgtacaaggctagcaaactaactactatgtcaccttcataactgaggagatctccagaccgtctgatctagagccctcccccttttcatccttctcgcggttgatcacgccatacccctatagaaaaacaaaaaagtgttcgcaaatgctccataggaaattcagcctacagaatccaaacataaaaacttcacttgccttagggattctgaatgcaccaaactcccatgagctgaaatcctcgccgtatccgcctctgtcgtacaggaagtcgtccaatacctgcgtgaagcagaatctagcagatgagctgttgcaactcacagatgccacacgattttctcacatagaaatatcaatcaaccaaaaacagcacagagcaagcaacagcaaccccgagccacccccaaccaagccccgcacgactcgagaacgcgaaacccgaattcgcaggtggctcgctcacctcgtcggccgcgggcacagtcggcacaggcagggcctgcgggataaccgcggcgaggaaatcggagagcgcggaggcgatggggagagggccgagaccatcgtcggcgaccgtggcggctgggagttcgtcggcggaggtgaacgggaggaagtggggatcgggaggaagggcggggacggggagagaggggaagctgaagaactctagggctagcgctttgccggcggcggaggaggaggacggcgcgaagtagtcggtggcgaggaagcgggtcctcatggcgaatggcgcggcggagaacgaagcgaggggagcaggaggttgaagacgaattttttggttttcaaaatgttttgatacgccaacttttgatcttggcttgcggaatgcggagttgcggtgggtttccgctgcattgccttgtgtgttctactaaaaaaaaatgtgtgctcttaattagccgtttctaaagtgtaggaatccgtttcagaaactgggcctaggattaatgggccggggtggtggtgccattatggtcgacgtgaacactcgtgtttcgtccgggaaaaagtccactgtgacttcctcaaaatatatatagctccaatctaatttatattcttaaaccgcaataccggatatcttgattctctcaattattaaaaccattataatttgaatatctcaatggttttggaggatggttttactgatttggcactttgacttggtataacctgttaaatcatcttgtgagaccctcctgttaatgaccctttttatttcttgttttccttccctttcacctctcacctgttaggagggcaggcagcgatgccctcctccctcccccacccaaccctagacatgtcagtggccaaaaccggcaagtcctcgttgcggtggtcgagggggattgaagggttgaagtgaggagggaaagggacggaagacaacaaaaaaaaagttacataggatgactcaatagtttggaccaagtcaaaaacgccaagtcagcgaaaccgtcctctaaaaccgttaagggagtcaaattacacagttttagtagttgagatagtcaagatatccgatattgcggtacatggatatgaattagattgaagctatatttgaggccatcaaagtggacttgttcctcgtcccgaaagcgagtcgtgagcgtgatcgccaacacggcccatttcaaggcgacgtggtgcggctcttcaacatttgggatggcgtcttcgaccatctccacagcacaatggtagtactacctcttctgttccaaaatataacaacatatctttatcaaaatataataaattttaagtgaacacatgacactaggatgtgtctcattcgttaaagggctgctatattttaaaatggatgtagtagctcataatttgatctgtgcattctttttttttgtacaaatacaaattttgatttgatttgttcattcatcttgttagtattaatttggtttgatcatggacaccaagtcatcaaagcctctgtttagcaatggccgggccgccggggctcacgtgctcgttggatcgatccgaagattcctcgtcaaaatttacaatactactactactccgtgtcagagtcaaaagactcaaaacgcctcctcgtatcgtggattcgtggtacaggggctccccttcctctcagtgcgcccgcggcctccgggtggcctccagaatccatatcaggtgcgtctcccactcgcagctccaacaaactccccgcatgtcgagcatttccctctccatcgatccagtatccccagttcccaactactagtttctttcagttgcagcgcgcgatctcgtcactctggtgaccatctgacaagttctcggcacgtcgcggccgggtggatttcgcatgcgcgcctgacgaattcttctcgtgaagcagggcatcgatcgccgggggcgatcagatcacccggtgaggtcgagctccgatcgctcgagtggcgttgccggccagcctggagtcgccggtgaacggcggcagcagagaaccttcagcgtaaaaaggtttgtccttctcgtacaacccgctcgattcttcgtgttcggttccagcgtcgtcggatgggttaaaccacactgaaaactcctgtgccgttgaaggggacacaggacttaaatccagtacggttatcagcatgcccacgtccacgtagtgacgtgaaacaaaaaccaacacaaactcgttcgcacacgtggacgcgccctcctgagcgatcggcgcgagcgtttttaacgctctccagcgatcgactgccgtgcagcactccctcccgcatccagtgctgtgctcaccgtgttgtttcgtctcaggagcagaaggccaattcaaccagccaaccagaggctgatctcgccgaggaagcggcggcgaacaacgctcggaccgcgtcaacgatcgagaaggcagaggagggggagggaggtgcgggcgggcggcgggtgggaggggcggcgatggcttcggcagccgccgtcttcccggacggccggcggtggtgcaagggcgggagctcgtcgtcgtcgccggtgaccaccgccatcttcctcttcttcttcgtcgtcgtggttggcgtcctcgtgtccgcccgttggatcaccaccaccgtgagttcggagttttctttgttttttcttcgttttcgaaatttcagtcgagcattcatggcgatggcgattcatcaatgtttatctgacactagttattttattggcatgagcgcagagtcatctgtcgatcaccaatctggatgagtggcgcacaaagacggtaggtaagctccatccttttgttcgatcgaaaattgtgaaacttaggtagtgtttggttgcaaggatgggatgggatgggatgggacgaacccacttttaggggtgtttggtttaggggtgggtgggatgggttggtccctggagaggaatattcctctcagatccgggaccaaccgatccgccaaaaactggcggacaaactcgtcccacctgggacgagcgacggcgtcaccgcgccatccaccaccttcgcgagctccgtcgggcgcccacgagcgtcgccgcctcgtccacacccgccgccacctccgcacgtccttctccgccgccgccgcctccttgagcgccgccgcctctgcctcgtccgcgaccgccgccgcctccatgagcgccgccgcttgcccgcgaccaccacctccgcgcgtccacgagcgccgcctcgcctccacggccgccgccgccacctccacgagtgccgccgctcatccgcgaccgccacctccgctagcaccgccgccgctccactcagatccagccgccgcctcgcctccgcgcccggcgcctcctccgcttcgtccatgactgccgccacctccacgagcaccgtgaccgccatctccacaaactccgccacctctgcctcgtctacgaccgccgccgccaccttcgcaagcgccgccgccggtcctctataggtaaaaaatccttagaaaaatgaatcctccaaaattcttttgctaatcctccatttcaaaggtgccctaagttgctaggatcctctaccctctgacaagatcaaagactcgccatctacagcg

SEQ ID NO: 67309 - DNA, 1740 bp, Oryza sativa
ggtttttaaagttaaaggatgtgatatactcgttttatggttgagagatgcgatatacttgttttacggttgagagatacgtttgacgaaaacaatagttaagggaggccaaacatagacttattaaaaaaaaaacaatggaccgaatattcgttctcttggaccgtgcgagatgaacagagcactacaccacgtatcgccgttcgatgtttgcgtcctccgtggtccggtgcagtgcttggacgattcaccgagcccccgggccagcgacaaaaatcctcacgatgcttagctactcgtacagctagcgcaggagaaactgaaaccgctcacttccctgacagcatcgcagcaaaatctcctctgtaccagctaaaatttggtttcgacagaagattcgagagccttacgctcttacggccgcacgcccaagtgcacgtttccttgatcccttgctaacattcaggcattcagcatgaagccatgaacttcggagcatataaccagatatacacaggcctctgttctctctctttctgaattctgtcagttgctcacgcacacctgacggcgcctgagtcccgacggccaccatatcctcgtacgtcctcctcgagagatatatagcagcgatcgatcgatcttctcttctcgtcttgatcatcaagtaggtaggtatccatgcatgttacgatccgtgcatgcaagaaaggtttcttcggttctttgttcctgaattattccactactgtttgcatttgcatgcctgtccatccaaaagaattgtgaaatctgtggttcttgaggtgatcagatcaagagttcggaggctgaatcgaatcaatgttaatccgtgggcgtttgcatgcgtttctgtgtagagtgcatggatcgtcggcggcgggggcagccggagcgcaaggcggcggcggcgacgacgaagaagcgcgggagggacgaggaggtggcggcggcggcgccgccgccgccgtgtggcgcggtggatttcccgttcgaggagggggacgaggaggcggcggcggctgacgtcgtcggggatcaggcaccgggggtgttccggttcccgtggcagagctgccgcggcgggctcggggtggtcgccggcggcggcggcggaggaggagggtgggagatgcgggacgtgttcttccgctccctcgtggacggcggcgcggcggccatcggggtgccgggcgaccgcctcgtctccccgccgccgccggccgagctgcggcgcgcgctcttcgacgacgtgggcgcgtggctcgccgccgccggcgacggcgaggtggaccccgtctggcgctcggcgctgctgatcgagggcgagcctcccgcgccggcgaccgtgtgacgacgacgacgtggacggaggtgggccccacctggcatacactgagtagcagcgtgatggtgacgtggcgtctgggcgccgccacgtggggactcgagtgctgacgattacgatggaggatatctacaaagcgaacgtcactctggtctctcttgacagagttacttccccttaaaaaaaagagtaaaatacatgatgggtcattaaacttgtttaagtgtgtcatataggtcactctacttttaaaatacatatttgggtcactaatatgaggtaagtgagtcacttacccatctaactatccacgcgagcatactttgtacacatggcatgccatgtaggattgaaaaaattacatttggata

SEQ ID NO: 67310 - DNA, 5512 bp, Oryza sativa
aagaaccaatttttattttgttttgctcaagccaagatcagatcagagatcatcagactgatcagtgctatacttagtgcacacaccaacactgcaacaaccaaatctgttctttgtacaaaaaaaaatacaaataaataatgtttttttaaaaaaaattgcagtagccattagccattagcagcttgactagtggtcatttggatccagatctcctaaacttttcctgtataaacaaatcatggggtctccccctctacaatcccaaggctttgcttagttagcagcagcagacgccaccgccgccacatcaccaacacatccaccgcattgccaccctcgcctcgccgtcgccgtccacctcgccgtggcgcgcgccgccaatgccgccgccgccgcccgtcgcagcagcagcagcagcagcgaggcacgcgcttctgctcgcgtccgtcgccgtcgccgtcgcgctgctgctggtgtcgccgtgccacggcgtgagcgagcaggggcaggcgctgctccgatggaaggcgtcgctgcggccgtcgggcggcgcgctggactcgtggcgggcgtcggacgcgacgccgtgccggtggctcggcgtgtcgtgcgacgcgcgcacgggcgacgtcgtgggggtcaccgtcacgtcggtcgacctgcagggcccgctcccggcggcgagcctgctgccgctggcgagatcgctgaggacgctggtgctctcgggcaccaacctcaccggcgagatcccaccggagctcggcgaatacggcgagctcgccacgcttgacgtcagcaagaaccagctcaccggcgcgatcccgcccgagctctgccggctgtccaagctcgagtcgctgtccctcaactccaactcgctccgcggcgccatccccgacgacatcggcaacctcaccgcgctcgcctacctgacgctctacgacaacgagctgagcggcgcgatcccggcgagcatcggcaacctgaagcggctgcaggtgctccgcgccggcgggaaccaggggctgaagggcccgctcccgccggagatcggcggctgcgccaacctcaccatgctcggcctcgccagaccggcatgtccggcagcttgccggacacgatcgggcagctcagccgcatccagaccatcgccatctacaccaccctcctctcaggccgcatcccggcctccatcggcaactgcaccgagctcaccagcctctacctctaccagaactccctctccggccccatcccgccgcagctcggccgcctcgccaagctccagacgctgctcctatggcagaaccagctcgtcggcgccatcccaccggagctcggccggtgcaggcagctcaccctcatcgacctctcgctcaactccctcaccggcagcatcccggccaccctcggcgacctccccaatctccagcagctccagctcagcacgaaccagctcaccggcgccatcccgccggagctctccaactgcacgtcgctcaccgacgtcgaggtcgacaacaaccagctcaccggcgcgatcgccgtcgacttcccgcggctgcgcaacctcaccttgttctacgcgtggaggaatcgtctcaccggcggcgttccggcgagcctcgccgagtgcccgagcctccaggccgtcgacctctcgtacaacaacctcaccggcgtgatcccgaagcagctgttcgccctgcagaacttgacgaagctgctgctgatcagcaacgagctgtccgggcccatcccgccggagatcggcggctgcggcaacctctaccgtctccggctcagcgtcaaccgcctctccggcacgatcccggcggagatcggcggcctgaagagcctcaacttcctcgacatcagcgacaaccacctcgtcggcgccgtgccatcggcgatctccgggtgcagcagcctcgagttccttgacctccactccaatgctctctccggctcgctgccggagacgctgccgcgtagcctccagctcatcgacgtctccgacaaccagctcgccggcgcgttgagctccagcatcgggttgatgccggagttgacgaagctttacttggggaagaaccggctcgccggcgggataccgccggagatcggttcttgccagaagctccagttgcttgacctcggcgacaatgcgttctccggcgtcatcccgccggagatcgggacgctcccgtcgttggagatttcgcttaacctcagctgcaaccggctctccggcgagataccgtcgcagttcgccggacttgaaaagctcggcagcctcgacctgtcgcacaacgagctctctggtggcctcgactcgctggcggcgctgcagaatctcgtcacgctgaacatctcctacaatgccttctccggcgagctcccggacaccccgttcttccagaggcttcccctcagcgacctcgccggcaaccgccacctcatcgtcggggacggctccgacgagtcctcccggcgcggggccatctcgtcgctgaaggtggccatgtccatcctcgccgcggtcagcgcggcgctcctggtcgccgccacgtacctgctcgcccgcatgcgccgtggcggcggcgccggtggcggcggcagggtcgtccacggcgagggcgcgtgggaggtgacgctgtaccagaagctcgacatctccatggacgacgtgctgcgcgggctgacgtcggcgaacgtgatcgggaccgggagctccggtgtggtgtacaaggtggacacccccaacggctacaccttcgccgtcaagaagatgtggtcgacggacgagacgaccaccgccgcgttccggagcgagatcgccgcgctgggctccatccgccaccgcaacatcgtgcgcctcctcggctgggcggcgaacggcggcgccaggctgctgttctacggctacctccccaacggcaacctgagcggcctcctccacggcggcggcgccgccgccggcaagggcggcgcgcccgcctccgactccgagtggggcgcgcgctacgacgtcgcgctcggcgtcgcccacgccgtggcgtacctccaccacgactgcgtcccggccatcctccacggcgacatcaaggccatgaacgtgctcctcggcgccgcctacgagccgtacctcgccgacttcggcctcgcccgcgtcctctccaagctcgactccgccatgccggcgccgccgcgcatcgccggatcgtacggctacatggcaccaggtggggtccaaatcacaccaaaaattctcgttacatttcccgcgctttttcacaaatccatcattatttcgatgtattttgctgaattttttgtctgaatttctttttctttttttcagagtacgcgtcgatgcagcggatcacggagaagagcgacgtgtacagcttcggcgtggtgatgctggagatgctgacggggcggcacccgctggaccccacgctgccaggcggggcccacctggtgcagtgggtgcgggaccacctgcaggcgaagcgcgacgcggcggagctcctcgacgcgcggctcaggggcgccgccggcgccggcgccggcgccgacgccgacgtgcacgagatgcggcaggcgatgtccgtggccgcgctctgcgtggcgcgccgcgccgacgaccgccccgccatgaaggacgtcgtcgcgctgctcaaggagatccggcgccccgcgccgtccgccgccggcgacgacgccaagccaccgcagcccacgcagccgccgtcattgcccaccaccgtcaccgcgacgccggcatcgccggtgtcgagctgctccttcgccgccgtcaccgactactccgtctgaaatttttgaaaagcttagtaaaaactagcgagcagtaattagttaattaccctcccataatctgttgattagccaagaaatcatcagcagcagcaactctgtacttaggtgtaatttttccccactgtacattaatccaagaaatgccattagcagcagtaaaataactctgggcattctgattgctgaagattacatctcgaatttgtggatgaggcggcgtcgttgtcggatcacgaacagaaaaaaaatgaacaaacaaagcgatcgatgatctgtatacccaatcagttgatggtttgtgatgatgcagattgatgggggctgagccaggtgacatgctcctgatcatgcgtgtgtctcattgtgtgcgtctcgttctcggagacaggtcacacgtccatctcacgccgacgaggtgaggtgatcattgattggatcttttgttgtccaaccgagttgccattctgcatgctctactattgaagctaaactcttttttcgcaagcgcgcaaaaagtttgcacgtcaatatattagaataaaacatagttttatgggcaaaattcagatttcacaagttcagtttacacgcaaaataaaattttaaaagaaggcattgcagtatatgaaatagtgtcatggtaattcgatcgaaagaaaatacatagtagggaatgtgatgagcaattgagcataactaactacaactagttaggtttacttccatttgttacatattgaaaaggatatgagggttcagctgagtgctaaagcactttttttgaaagactttgctggacagaagcaaatgctggtcgttaagcagatttatttttcagataatgtgttaagcagacttgacgaacaaattgcattgtgcaagataaataaatcctaaataacaaatttcggtcagcacagcagtctttaaaattctaggaaaacatggcagtatatgcagcaaaagatcgtgaaagcaaactggagtagctccaaaccaagaatacgtaggcccaccagttgtggcccacgtacgtggcaatcccttcaggcccacctattatgggcctcgccgcaaatccccgtccagcccataaataatgggcctcatgtttagccccgatttccgatatggcccaacttgtgccggcccagtgatggtgccgtgagcctcctgccaagtggaccccatgcggcagaggctcgccctgaatttatcacgttttgatcattttagaaaattttattacctaaaaaagtttattcagaatacgatcttttcgagacgctagtgtcatgcctggttttgctggcgaaaattttgagttcgattgtaacatcgcatatacaaacacatatttaaaatattaaacgtagtataaaaataaaataaattacatatttcgtcagaaaagtgcaagacaaatttattaagcctaattaatctatcattagcaaatgtttactatatcaccacattgataaataatggcacaattaggcataaaaattcatcttgtaattttctgtcgaactgtgtagttggtttttttccacatttaatatttcatacatatgtccaacattcgatgtgaaaggtgaaaaatttttattttagaaactaaaccgggtctcattggcgccgtgatctaatataatgg

SEQ ID NO: 67311 - DNA, 5260 bp, Oryza sativa
  unsure (1)..(5260): unsure at all n locations
taaatccgcactactggatagtacaaaaaatgcaaaatgataaacagcggaaggcacccccacctttggtgagggagacgtcggaggcagccaccaccagattgtactcgccatcccgatccagcacgccgctcgccactgcaaaagagaaggaaaaacaaaaacaccacccgtcaagcacggatctccccacattgtcggcgaagagagagaggggggggaggcattcgtccgttcgtaccggtggagtccgggagggtggagacggagacgggggagccgccgtagaggacgaggggcgcgagcaccgacgagaggaggagcagcagcaccacgcccctgcagcgccggccccgcgccaccgccaccatgggctccccaattcccgccgcctccctgcacttcggagagcacgcgcgcctcgccgccgccgccgccgccgcgccgagcgatgcgggaggaggaggagatggcggtcgcgttttgcggtgggcgcaggcgcagcgaaagccgaggcggccgcttattttttgggaggaggcgagatgtgttgtgtgtgtgtgggttttgggcgtcggcacgcgcggcgcgggggggcccggatgcgaaatctcggggcgcgcgtggcgtgggtgacggcgtgagcgtgagcgtgagcgaccgacccatatgcgtgtgtacgactttaaatttgcttgctccaccctggattcccatgatatcgtggagtagaagtaaaaatatttttctccatccaatttgggcagatagtgtgtgagctggagtagtagatctatttgctgtccctaagctgataactgtcccaaattgctttaaaattggtgcaggtctctatatttaaggctgtgttctttgattagggttccaacccctctccctcatgtttcgcgtgcacgcttttcaaattgttaaacggtgtattttttgcaaaaaagcttcaatacaaaagttgtttaaaaaatcttattgatctatttttttaaagaaaatagctaatacttaattaatcacggactaatagaccatctcgttttccgtgcacaagacatgggttcccaactcatagaaaagaacacactctaagagcacccgcaatggtaaagtaaggtgctatctataaaacatgtacatctcagcaatagactcgattaatagtaaaccaccttaatagtatgtctacattggtatctataattctctcatgcattgcctcgtttttctctatagactatctctaagttagtagatagctttgctctctctcttcatttaataccttccaagtaggaaaatatgctgacatggatctcttgtagagagcctatagataaccattgtgggtgccctaagcactgaatgcagtgtgaattattagcgtatgactagttaactattagcttaaaataactaaaaaataaattaatatgatttttaatgtaaattcttactatatgaaaatataaaacaaaacattatagtttagtagttcaggaagcacacgtgtgaaaaacgagagtataagttgagaactttctcatcaaacatgcccttgatctttttatctctcctatttttttttgtcccgtctcacaccattgtgataccgctccaccgtcttcctcatcatcatcgtcgccgtcctccaacaccatcaccgttaccaatattatcatctccaacctccttcccttgtctcacccctccctcccccacctcgatccatcatcgtcgctctccacctcttaatcacatggcctttgttttccaccgctgatctcacccattatcggtcttccaccaccgccgtcatttgtctaaagccttccttctatgtacattgtagtttggttatcactagtgccaaggctcgccaaggaagctcccatcgccggttagtccgccatatcctccatgtattctttgtttggacctctcccgattaaagtgtgtgtttgtgtttaagggtccgtgatccatttcccaaaaaaacaggatagctatttagtacataataattaattaggtataactaaaacgatttaaaaaatggataaacatgattttctaaagtaactatcatatattattttatagagacacacagtgtttaaccgtttggaaagcccgtgcgtgaaaacactagactataagataggaacgggtattctgaacgcagcctaataaaactaacactaggagcttttctaaagcattgataggcgcctacaaatcgggcgtccgattttttttttttttgctacaagtggatcgaacatgtttcactaaatagatcgaaaatatttcagtcttttaaaaagctgaaacacaaccaaatcacctcatgaaatattttgctacaatgtatgaaacaacggttccaaaaaaaaccgagcgttgtttcaccctatataaaaataatattttagcaaatagcgaaagaatgtttcaattcactggaacatttgatccatacacagtgaaacattatgagtacactaggtgaaacatttttggcggaacaaaaaaatgaaacggatttcttaatagagggtttctataatatatgggtgatttgttgcaaacgaatatttcaattcactgcaacatttcatccatacatagtaaaacatcatgcgtacactagctgaaacatgttggtgtaacaaaaaatgaaacggattttcttaatatggcgtttccataatatgtgagtgatttgttgcaacggcgtgtgtggtggagacacgtggcgggggtggtgcggcgtggggacggcacgtgggcggcgggcgcgcgcagcgcccgatttttctagcgcgcgtcgggcacccaatccctggcgtttttcttgatttccatgatcaggggtggatctatacagtagtatgagcggtgtcaagcgacaccgacgactttgggcaaaacctatagcgaaactgcttatccacatattataacactatggtctaagcataattaacatactatgacaccgatagacacgttatgataccaactaatcgattttttagatctgatgatgaataccgaaaatgctcacactcggacgaccgcgcgggatggagaaaaatcggacgctgttgttgacgaaaaaatcgaacacaccggcctgggagatctgcttagctccagtgtaggtccaaatcttggtgaggtgcaggcgtgccagtcagtttgatcctgcaactgacaagatatgcaaatagtagatcaaaacagccgatcggctaacaagccaatggagtggttccagccgatagccgataatagccgatgccgataccagccgatagcgatagggtttaagcaatcggctatatatccaatgtagataatgatataaaggcgatcggctgatgatgatagaatatagcaataatataatccagtataaaccaatcagctagcaatgatatgataaataagcatcgatccgaagtttaaagcacacatcggctggaggtccgatgtcatgaaatccacaaaattagattaaacagtgaaacctttgttgtcatcggctaaatccaacttatatgtatatgcaatcctcatgagccgatgcaacgtccagataacttaccggctgaaaccccgatgaaacccttattggcaatcaataagcaggctagagattatggttctaagcacgacttagtagatcaaacttaactgatgtagcactaagtatgaaaagaaacataatatctagacaatcaagccgatgactgatttttaggatggtagatgcctatgctaatctaatctagcaaggcgatttagccgataccggcagaaaccctaaagcgagagacagccgatagagctaaattgatatgctaagactggattatcagagacatatgataaataggtaggcaaatatatcatccaaaccagagcaatccaagaggtcgaatgtactgatgcaaccttgaacgacgccgatgtagacgatacaattgcctaggccgacggaacattggacttatcccttcgccggagatcgaagacgatgcagccccgcgtcgggtgccaagttccgccggaatgtaaaaaataaaagtagaagtaaaaagggtggcgatgcgctgaattgtattgttgatcgatagattgatagattacaatgaccccgggtgtacatatttatacccatagagagatactagtcctcgtcggacaagaaagaaactaaaaaggaaaagataaagtccttatcggacactaaacacactttcctaaagataaaaggaaactaacaaattatgcctaattaatagataactgtcatgttgcatccttcttgaactcgaactcttctagataagcttcctttgattgatccgactccactaagaacacgacatcgtggcgacttagactcccatcggctgattctagaactttgaagccgatactgactctaaaccgatggtaactttgggcttaccaaatttcactgttaacagctgtctgccactgcagatnnaaataatcttttcttttcttatttcttcaaaagattttttatcgtaaactatttatctaatctacgatctgattgcacccctaaattcgttacaattaaatctttacaacaagaccacacattattatatttcgacaaaaaatattttaatttttttattgattttttttaatgttgcatgtggtctcttttgatgtttcaaccaatagttttacaatgtttcagctagtgtacttatgatgtttcactgtgtacggatcaaatgttgcagtggaacgcgccgttgcaataaatcacacacatattttggaaaccctctgttaagggaatttggtttattttttgttccacaaaaaatgtttcacctagtgcactcacaatgttccactacgtatagatctaatattgcagtgaactgaaatatttcattgcaacaaaaaacccacatattttggaaacctcctattaagaaaattcgtttcattttttgtttcacaaaaaaatgttccacctagtatacttataatgtttcactatgtatagatccaatgttgcagtgaactgaaacattcttccactatttattgaaacattgtttttatataaggtgaaacaacaccagatttaaacgagtgaaacattttcgatctacttagtgaaacaattccgatatacctggtaaaacatcgtgcaatatttaaaaataattcaataataagctaattt

SEQ ID NO: 67312 - DNA, 514 bp, Oryza sativa
accacagcagggtttttatttttaaataatgacctcagcagggtttttttttttgttgtttaagtaaaaaccgctcctctcagatttacaaaaaaccaacaaaagggacaaagcttgacaactttcgatcaaaaccgtatagaaaccaactaatataataccgatcggcttccacaaacagagaatcaccagtttcacgaaaaccgttgaatcctggacctcagtccgtttcttagtccactccctcttcgtctcattactaggctgatccaacagggtcggtgctgtggccgctaccccgatttggcgcagctaccgtcgcccgtcatgggtaagcgtcgtcgaatcgcgcctccgtccactagctccccctatctgcctctagccctctaccaagaaacaccatcgttgtaaccttcgccaagccaccgtgtgtgcgggtcatggggtgggttgggagggaaagatggagagagagaggaagaagtacatagattgacatgtggaacccact

SEQ ID NO: 67313 - DNA, 50860 bp, Oryza sativa
tgttatcaccttaagatgttgcagtcttgtagtcaaacataaaaaagtatccacgtattgttgtgtaagaggtaattatcatatcaaaagtaaaatcacttcatacctggtagcgccgagcccgacattatgggggaagattgtagccttgtagacgttattgtgcccatgcacggcatcaataccgtagatcatcggaatacctagtcgggtcgaaagggcacccttttgcatttcattcaccattgaagcccaagcctgagctgatgcctgaggagcaggcacactgcctccaccactcagtacactacctgcatcacagcacaccaatgtcaaaacacaaaacatatagtatccagcatttcatcgttcacattacttgagcatgagtagtaaaccatgacacacctatgaagtacttggcaatctgctccgccgtggcattctccctctcgatttgggtcatctggccaatcttctcagcgagagtcatccggccgagcagatccttgacacgaacagagacgggctgcttcggatccttatacttgacatactgagcgctccccaacgtagcaaaacataacatgaggagaataacactgaacttgtgcaaactccccatcttggctcagtgtgagtgtctatctccaaccagagctgccaatatatagacctgtgagagaagcatatctatgagtgtaagcttttcaggctagtatgagggtaactacataggagcatagtagtgcacgtctcttgcttgaacaacaacatcttcaaacattagaatagtcaagactcaagagtctcttaggttgcaatcaaaacagaaacaagggaacagcatactcaaaacatggtcggtttttcaaacttgtttatccaatcgcatcaagttgctgaaaaccaacatgacttacaggggaaacaatcatgtacctaacctgattaattgaatcagccagccagcacataacaagagtttgaataagagcagataacgcagcatgcataaaacaaacgacaaaatcatgcacacacatacatacagcacagcaagactgcacatgtgtttacctgatatactcaacaatctccactaaaaagggataagcaaagcttaatccaaatgcacacgaatgcagaaacagtgatgtctcttcctgcaaaagatgagagttttttttttctgcaagctagcagcagcagcactgcagagaggttctttccctctcctctgccttgcttacgcttgctgcctgagaaaggtgaccatgtcctgaaagcaaagcaaaagacctattctctcttatagactaatgagagcactagtaggctaagcggctaacgaagctacgaactttgatctcccccgcgatacccgcgccgacatgaggatcgcattgcaacgaaaaaagaaagcgaaagaaatcagcaactttgattagtgccccagtggtcagtggacctgacgctaagccccggccactatcaacgcctagctaataccagcagtattctactagtacaaaccaaatcaatatcgaacagggaagccaaagccagccaagccaatcaagaacggcgacctccacatcgcccgcaagagggatgatatgcatccatccatccaatctggtgcaatgtcgctgtggataagatcagccaagagactaatctttgattattgctgttgaaattctcttctcacacgccggccacaaaactccacaaactgcttctacaggccgcgtgagagctgcagtcactgcacgctccacgcggccgcttgtgtgaggtcgctcgcggctcgaccgcgagagattcgttcccccattttatttttgcatcgtctcatcaccggcgagctgtgccgcggcggcgagtctttttgtcaagctcctccgggtgaaagggacatgagagctataaacgaatcgtttgtctaatcatgcgacggcggcttcgacacgggagggagcttgtgtgcactctgctttgccgggtcagaggctgcagattgagacagcttaacctcctccatataggagattagctcaattaaattaggagaaaattttggactcgcacgagcaggctcactaacacaggtcactaaccacctctagtaatacaaaatacagtatagtgcaagcatctccacattatgtatatcacatatataatatattctttttaatattagagcctgaaataattttgctccgttgtctgaaaaaagaaacagcacaagcatcttaacccataaaaaaaaaatcttctcttctttttctctctatctcaaagagagccaaggcagattagtgagtgagtccaaccagaattgcttaattagtgtgtcacaaatggggagggaaaagaaaatcatgcgaggttggcgtgcgggcaatcgatcgaaccagcggagcaacgagccaaaagaggaggaggtggtggtgagctggtggtcactctccactactccacaaacgcccaagccccatgtatttgttatgtattgtggcgtatctatccatctagcaagctagcttgctagcgatcgccatggatgggaactaatcaccaatccaccgtcgtcgtcggccactataccagtacgacgacgcgattgggcgatggctagagcgcacgaggcgctcgccaccacgcggagacaacgcgagggtagctcgcagatcaccgtcttctcaggcgagattttttttttgtttttttttggacgcgatagattcgcggtggcgtggcgcgcgtgttccggcgcaccgccgacacagaagttgccggagaggaagaggtcaaggagacacggtggaggcgagggggcgggtaccttgtgctcaccggaataccggccggagatccggcgatggcgacgtgcggcggcggcggacggggttggcgcggcggggcaggggaggcagacgacaataacgcgaggctttattgacaaccaactgcttgctctcagatttttttttcacttgcaactttttttcctgcgctttttctctctctctctctctctctttttatctccgagaatctacgcgacggcgacggtaattttgaccgtgcggatgtcgggccatgccacggtgtcaaaaaggccaactctcactgtccagtggggcccacatgcagctgtttcggttcctgcccacatgtcagttgcattcgtcatcgtctttttgtttaattttttttagttcctagtggacgtgggatctctgctcgggagttgtgacaggcaacctttttgttgctttccccggcataagtctcgccagtggactatactgtatttttaaccgtattcaactatttatcctctaactaaagaacagtgtttgtaccctgatcaagtggcaggtccgtgtaacgcgacactgtttacgcttttaattaatggtttgcacctaacgtagagacgttgggggcagtacactccgtagaagtagaaaaaagttcaatttgagccgtttcctttcaaatcaaatgtcccattttttgaacttatccaggaccgaccgttccaacggaaaaaaaaatggaaagaagacagacaaggtagtagatcaatgaggtgttactccaaggttttaatgtcgtcattaacttcggcgtcaacacacgttcgttgctacttctggcatcgcttgcctttttcgactgctctagtactagaaagaattcatgtgctggggtgttattacagctgctttgatccagtattcattctatcaagaaaagtactcacttatacgaatgaatatggataagtaaggatgtaatatctagataagcaccagcctatattcattcttaaaaagttgatttttattttaggatgaataaagctttcatagccaaatgatgatgcaagggaaaagaaatcaaaatcttgcagccttctcttagaaaaacgaaaacagatggaaagttcaaagtgagacagtagacagagcgatgcatgcatgtgatgttctctcatcttttccccacaaggggagtgatcttaggtttgttcaggaaagcttaaaattctgtgagagatagttgattagtagacagtttttgataaactggagaagccgagttttacagcttcttacctatagtttatttgttgaattctacaactacaacttctcataattcgaatgaaaagttaaattgctgaggaagcttctgaatccaaaagaagctacaggtgtcagaaacttctctatgtatgacttttattcttctgcttcttctatatcatccatggagtcatggaccatcatcacctttccttatccttccagccaggcatgctaagaaaaaggacttctctactattcgcatctcccctattaaatcccaatcacacaaatgcaaatacagaaatcgtcaaagcatcgtgcagtttcttttcactcttattttagtgtgcctgcagatcagatacagccggcgacgcatgggagtagatagtgttccttccaagaaaaaaaatcaatttataaaaataaatttgtacatatgtttgatcagattcaaaattagttttgtggatagtagatacactctccgtttaaaaataaatttaattatatatataaatatgacctcagtctatatttatattcatatataagttacttttatatataaatatgatcttagtctatatttatattcatatataaaagtaaatttattttgaaatggagactatagatatactctctccatttagaaaaataaagcaaacttctaactataactataaatctagatactccgtgttccggtttgtaagagcaagtttaatagtatagcccactattatcttcaattcatctatagtcaatctaacagccaattcatataatagttgcttactatactattaatatatggtcccacatgtcatacgcacattgcgtcttggagtccgtgctgcagctggctacagatatgtagcccgctactcttctctctcattgtttatctcattaaaatatgattgtagctggctaatagcctgctattgtacctgctctaatgagaaagaataatactacctccatcccaaaataagtgcagccgtggatatccgtgctcaacgtttaaacgtccatcttatttaaaaattttgtaaaaaaataaaaatatttagtcacacataaattattattcatgttttattatctaatagcaataaaaatattaataaaaaaaataaataaaataaacagtcaaacattgaacgtaaatagtacaaaactgtaattattttggaacggagggggttggcgccacacaggcacagcacgtatacgctgtcccggcactgctctgctcgtccgtccgcgccctttgtcgtcaggctcgttctcgtggctgcgtcgttgacaaaatttccttcagatcgcgtcagggtttgggctaccactaattgaaagatccagatcgcgtcttagattaacaaatgttccacggatcacgggatcgatccaagcagagtaggagtaagttaaaccagagagcagagtaaattaaaccagagtggctcagctcgtcagagaataatggcaggacaacgaggcgtctactacatgctcgtcagagaagttaggataaagcatgatgggatcacgcgttgttcacgctcatgcagcaacagtagtagtactacgatccaaccaaccagacgctgtctaaaaagaaatctgtcacacacgataggaatatcagcgaggacgtggatcagtacatactccctccgtagcgggacatttaacgtactcctacttgaaattttcaagatatagcaactaataatttgtcattcgctgcctatgacatactccctctgtcccagaatatatgaagttttagggttgaacacggttattaagaaagtaggtagaagtgagtgatggagggttgtaattggatgaatagtggaggtaggtggaaaaaataaatggtggagggttgtgattggttgggaagagaatgttggtggagaaattgttactcccttcgtttcagtttataagattttttagcattgtccacattcatattaatgttaatgaatttaaacactatatatatctagattcattaacatctatatgaatgtgggcaatgctagaaaatcttataatctaaaacagaggaagtatattttaagacaaatcctgagggcttaatattattatattttgggatggagaaactatgtattaagtgttaaattctctagaacaactcgtaagggtgacaaatagtagttaattattttcatagtagcgcattactccaccattagcatttactagagtgtcacattactgtcagtacatttggtaggtgaattaagcggagtactaaagtgtaacagctgcacatgcagtgaaggcccccggacagctatggcaggtgaggaaaatgcagggcgccacggaacagcgcacagcaaaggttgggcagttttaatggccaacctttcctcgcacttcgctgtagcagcactagtactcctacgtactagacccgttatcgctggcccattggtgagttgctaaatcacaagagagccttttcctcctttttttttttcagttggaaagatctgcaaaaaacaggaggctcacagcgaatccaaatccaattccacgatcacaattcacaacgtctccgttgcggctgcggctgctgctgctgtcgtggattaatgcccgtcattagggcggggacatgcagtgcctttgcgtgtcggtgccattagagcaggtttacgaagggtttaagctaaccgaacagcgtgggttctaccaattgtttccacgaattagtgccgtgttactactaaccatccttgtgcttaaactgcatctatgctgcagcaatataaagggagacaatgcacgcacgacgctgcattatgggttaggactcaagtcggcagcagcagcagcactggtgcactatactagtagtgcaggattgttaattagctacatggaattgactcgggtagatcggccgaccaatcaccggatccgtgaaagccgcgcattaagctttgtcacgcactggagtgaccattgcagccttcccatgcatctgaatgctgcctgaaactactacggtcactgatgactgaaagattgcagtctgtcttcactgtgtgctgctgctatacgtaggagtagagtacacctttccactttccagcatgaatgggcatattggcatcgtcgatttgtgccgccacagctggggggtgtgggccactgggccggggcgatggtagccgccgcggaatgggatggtgaggatgagaaggttccaggttgcaaaggccctaaactttagcgtgcacgcgttggtccatctccggctggtgccacacatgtaaaggggacgggccaaccagacgcgtcgcagccgagggcaccagcacacgcccgcgtgccgccgaaatcacacgtaataatgcggcgacgtgacaccaaaaacggcctgggtcgtgcgccattgttgcgcgtgggcgtgcgtgctgccgctcacggcgagtccgtgaatcgttttttcacgtgaaacgagcgaattcaagaagggctcgttcttttcacaggattttcaaaacgtaggaatactacagaaatatatgtgcaaacctatagattaaaaaacacatgaattttttctatgttgttgagcaagccaaccaaaaaaatacaaatattaggttggagtgaattattttttcctatgcttttcctttaaaaatggaggaatggaaaactttcctatagttttcctatggtacattcctatgaaacgaatggtagtttaaaacccattcctatttctatgctttttctttacaattcctttaaaatgaataagcccgaagttgttgtccctgaaatagctgaagccttggcgattagacgtgcgctgatcctggcacggggaggagggataccagcaggttatcatggcctcggactgcctctcattcatccaacgcttccagtctccaacgagatcgttctgctgctggttgcgtggtgagcgacatcaagaaagtcaagagttcattccttgcatgttccttcatacatgtgaaccgtttatccaatgtaggacacacactttggctcgtcgttctgagcacttactatgtactttttatcatatgtttgaccgttcgtcttattcaaaaaatttaaataattattaattcttttcctatcatttgattcattggtaaatacatttttatgtgggcatataattttacatatctcacacaagtttttaataagacgaacggttaaatatgtgctaaaaagttaacggtgtcaaacatttcgaaacggagggagtaatatctttcgctctgtgaccccggagtatatccgggagatgctctgtcattatgcaacttaatgaatagagtgtcgccattctctctctctctctaaaaaaaacgaaggccagcgagtgagcgagttcgggaggaccatctggggaatggaggagaagagacggtgatggccgtcccaaagcaggttcttcctgcacgaaaggccacgtcgttttgcttattaggggaataagccaaacaacaaatttataaaccaaaaaaataatttataaatatattttttatatacgtgttcttagtgatataaaagcaaatgctgaaaaacaaacttcaatgaaaaaaaacctcaaaatcaactctagatttaaagttaaaaatttaaattttggttgataagatgaggcggaatactactactacacggcaaaaaactaagaagtagacgaagcaagccttcgcgtcgccctctccccgggtgacacgggtggtgactaggccgtcgttgcccgcctctccctccctccgcttcgctctcaccacgcaggggcaaggggggcgctgctcggcatttgggacggcgcccagattgttataaaaccagccccgaaattgacatcggtagctaaacgcggaagaaaacgctataggagatctaaaacgatgacggcaccaagacacgatatttggtaacagagttcagccgtagcctacatcttcggggcactgattacgggcactcctccccgatccagcatatacaacgtattagagttacaacgactcacggctggtcgacgccggcagccgctccctctcgctatgctaagtcgctatgcggttacaacagacatgcccctatttatgagagatcctaggatagagtccgactcatactctagtcctaatacctattacaactccaagtcttaaactgtaaccgactatgtacacatattcgacacaaactctaacacagatccgtgtcatttggccggatctggtgggggagatgacggcggcggggttgtgtggaggggcggtggcgtttggtgggggtggcggcggcgcgtggaggtgatggcagcggtgaagtgactgccagatccgatcctggatctgggatctggcggggaagtggcaagggactacttctcgcgacggtcggcggcgcctggtgcggcggcgggcgaggtccgaccccgcgacggccggacgatgacaggcagcggacggcgccgttacggatggacacaccaatcttaaccgttgctgatggctcctcaccttaacttgaatgagctagtcgataaagttactactactcgtatactctctccctttgttccccatgttataagtcattttgagtatattctgagtttttttttcaaattaactaagtttgtaaaaactgtagcgacaattttaacaccaaaacaaatatattccgtggtaatttaaaattatagatgttgctatttctttctataaatttgatcaaataaaaaatgatttaagacaaaccaaaaacatgtagtactaaaacggaggggggaagaagagaaaaggactaggaaagacaagagtcactgcgaaggtgcaacatacaatgcatcgactcaagcaaataggaggaaaagggaaaataaaagccatatatcacatttgctatatccttttatacgaattgggaggttactattaactttttatatctttggtttgctgtaattattttgctttatgagcataggaattatcatgctgatcagagcaccttgcacaaaagattgatcgagctatgccgtaactcaatattatatcaccacttccaatgttttcatttcgtaaaaaagtgtgaaagtagctactatatgagaaaataaaactttataacaatgtgctattatatcgagctagctagtttaatcccatacaaagcaataatcggaggccaccaaaacgtaactgttgtatcgcatatttgtacaatttattaataatttataaagatttgaggattttcgaaccagactatactattggaggggcgcagtgataataaaacatagtagtacatctaatactctcatagtgtataagctacaacttcaattttagggctggacagaaacatatattatacataaagaaagaaagaattgagtagcaaggtgcgtaccggccggtcttggcatataataataaaaagtaaatcagcgataattggcggtgaatcgtcgacgaaaccaaggagctcgcgccggacgaaattcagcacacggcggtgggcgaacgccacgctgtcgtgtagaggcggcgggccgtaaatatttatgccgtgaccggatccacatagccaccatgttgatctcattaccagccggtaacggatcctttctgttttttttaactaagtcatcgggaggagagttttctcaactaaatatattacgtcaaatgatattacacaggatatgctatctgtaacggatcctatctttaattagtaatcgaatggaatacttgcccaacatgtaagttataagatattttaataagatgtataataattatgcatcgtcggacgctgatgtcttcgatgcactcagactctacgttctttttttctcactagctcgtgaaggctctaaagagtccaatttagaataaatctagtaagaaaaaaagctccctccgttcttttttctttagaataaatctattttgtttcttatctcttgctcccgattgtatcagaacatcccttaaccttaaaaccggatataacgtctcctcaaactttaaaaccgatgtaaaccgagtttaaaacgctctgcagacctcaatcttccatctattatatcatctatctattatcttattaaagtaataaaaaagaaagcctccacgttttctctcacggcctagaaattttcatattaatcagagaaaaagaaaagtagagtccatataggaatacaatttaaaaatagctgaaatttggaatttaaaataagaaatattgaaagaggagactagagtccatacaagtatacaatttagaattaactgaaattcggaattaaaaaaataggaaaactataagtagaagttagagtccatataaaaatgtaatttagaaataactaaaattcaaaatgaaaaaaaaacaagattgggagaaaagtttagagtccatatataaatatgatttataaataactaaaagtagagtccatatagaaatacaatttaaaaacagctaaattcagaattaaaaataaggaatattgaaagaggagactagagtccactcaagtatacaatttagaattaattaaaattcggaattaaaaaataggaaaactaaaagtagaagttagagtccatatagaaatataatttagaaataactaaaattgaaaatgaaaaaaaaccaagattgggagagaagtctagagtccatatataaatacaatttatcaataactaaaattcggaatttaaaataagaaatattagaaaaaaaagtctagagtccatatagtaatacaatttataaataacttaaattcgaaattaaaaaaaaacaaaatattgaaaaatgaattcagagtccatatagaaatacaattagaaataacagattgggaattagaaaagtagaaatattgggaaaaaaagtctacggtccagacaggaatttagaactagctgaatgtcgaatctaaaaaaaagaaaactaaaagtagagtttagactccatatagaagttgaatttataattacaaaaattaaaaattgaaaaaataagaaagatttgggagaagagtctagcgtccatatagtggagccatcgtttcgcttattcgcggaataagcgaaacgacacatttacaaatgaaaagtaatttgtgaataaaacttttatatacctgttcttagcgatctaaaagtaaaggctgaaaataaacttcaatgaaaaaaacctcaaaataggttaaaattcaaattttggctaataagcataagcgaaaagatgagaccctagaaatacaatttataaataactgaaattcgaaattaacaaataaggaatattgggaaaaaagagtccatataggaatacaatttataaattactgaaattaaaaaaaaagaaatattggaaaaaatgtctacagtcaatataggaatacaatttaccaataattgaaattcaaaatttttttaaaaaaaatattgaaagaagagtttagagtccatatataaatactatttataaataactaaaattcaaagctaagaaaaatgaatattggaagagtagtctagaatccatataggaatagaacttatgaataaaggaaattcgaaatttagaaaataaggaatattgaaatatgagtcttgagtccatatacaaatacaatttataaataattatcacgtatatacaatacattaaaaatatcacacgtttgttagttcaaccaagaatttaaaattatgttaccattttaatatattttaataataaaatgtgaaaatatttaagctattatatgagaaaaaatataaagatgctagccgcgcaatctgcgcgggccaccatgctagttattattattaagacagctttgaaaggagtcaccacgttcgctgtgggagctagaaattcccacgttaatcggagaaaaagaaaataagagtctaactagagatacaatttaaaaataactaaaattcggaattaaaaataagcactattgaaagaagagtccatataagaacccaatacgagattaattaatatttgaaataaaaaaataaaataaaatctgaaattagcaaaaaggaaaaaaagaaaataagagttcgagtataaatacaatttattttgctagtttttgattggcccacttggcacctcattctttaaagaaaaatcataaatttatactagagaaaaaacacctaacaatcatatgtgaggaaaaatctagagaaaaatatcacatatagattctagaggcttccaaaactatcttccctttccagccacatgaacttctactcctttgctttctataaatataccacgcctacacgacactactcctataactctaaaatatatagaaacccaaaattattaagcaaaaaataaatctataacaacaaatttacattcatttcccttctttaaatatcctacgcctactcgatactactcatataactatagaatatatagtaaacccaaaattattaagcaaaaatttggaataaatcttgagaaaaaaaagcttactccgttcttttttttagaataaatctattttgtttcttatgtaagctcctggttgtatcacaacatcccttaaccttaaccttagaaccgatataagtctcctcaatatttaaaaccgatgtaaaccgagtttaaaaagctctgcagacctcaatcttctatctattatatcagctttgaaaggaggtaccacgttcactgtaggagctagaaattaccacattaattggagaaaaataaaatgagagtccaactagagatacaatttaaaaataactgaaattcgaaattaaaaataagcaatattgaaagaagagtccctataagaacccaatacgagattaactaataatcaaaataaaaaataaaataaaatccaaaattagaaaataaaataaaataaaaattcgagtataaatacaatttagaaaaagtagtactgctcatgtgccacgctactttactaaccgtgaatttttctcaacttttattttttcactggatgaccatcgaaacttctagttaaccacgaccctcttttgtctgaaaaaacagaagaaacatattagtatcaagatctatccaataaaggtccacgcaaaaaaataaaaggaaagaatgatatgccaagtgggggttgtcgcaaatgcttgactctcactgcctgagcacctttatagccgtcgccggcgtcgctactcacaggaggactagtgggaccgctgccagcgcctcctcccgccggaccgccgtctccgctgcccgtgcctcctcccgcaatcagcagccaccgccaccgctcacatgaggacaagtgggaccgccggaccgctgcccgtgcctcctctgctgccgatgtaaccagcgtatcctccaaaattcatccagggtaagggtcggcgacaacgaaagtcttgtcggtggtgtcgttgacgtgttctccaaaattcatccagcgggtcagaatatctcataagtgagtgatttttgcaaggtgtggatgacggggtgggggttagcgacgacggaagtcttgtcggtggtgtcgttgacgtgttttccgaaattcatccagtgggtcagaatgtctcataagtaagtggtttttccaattacatctttgccctttacattgcgtatctttttcttttagagcttggttagtttttgaaatgatatgtcaaacaatagacaaaatccaagaaaatattagatactaactgattgaaacatagaattgaaacaacgtttgcatccagcgggccctttacattgtgtatcttttgctttaagagctcgattagtttttcaaatgatctgtcaaaaaatatacaaaatccaagaaaatattagatgaactgattgaaacatagaacaaaaatggaattgaaacagtgtttgcatccagcgggtcataatgtctcatgtgttagtgatttttccaatcatatcttcgtcttttatattgcgtatctttttttttaagagctcggttagttttttaaatgatttgtcaaacaactgacaaaatccaaaaaaatattagatgaaacatgattggaattgaaacatattttgtagcaagcacacaaacacgacgcacaccaactaaatcggaacagcgtctgcaacggttgcaacaagcacacaaacactacccgcacacgcacaccaactaaatccaactagagtgaaaagcgtttgcaacaagcacacgaacacgatgcacaccaactaaatcggaacagcgtctgcaatggttgcaacaagcacacaaacacttcccgcacacgcaagggagatggattctaatagctcgattgaacatccatccgtttattgcatgtcaagtagatggttacgaaaaattttcaaaaaaattgacaagatagattaatatgtaatatatcactccacaaacaaacaagttcaaattcaacttctacaagttgtaacaaaaataacaaatttaattgtaaaaatacatatagtaatttgagttttgtttgttatttttgttacaagttgtagaagttgaattttaacttccatgtttgtggttgtaatatatctatcttagttcatattttttcaatttttttataactatttagatgacatgcaataaatgggtggacgtccactcgagcaagagaagcgatgagcagcagaacgttgaggagaaacacacgcacacatcatcatgagactacgatgagcagcacaaacacacgcaccgacgcacgtatgaacgcaaacaacgcacgcacgaacgcacacaacgcgcgaacacaagcacgctacgataagttgagaagaaacacacgcacgctacgataaggagaaacacacgcacacatcatcatgagactacgatgagcaacacaaacacacgcaccgacgcacgtatgaacgcaaacaacgcacgcacgaacgcacacaacacgcgcgaacgcaagcaagaagaagatgaacacaacgcagatgaatgaacacaatgcagatgaacaacacaacgcacaaaaagaacacaacacatataaacgcacactagcagatgagtaagggaagcgagaagcagagcgagcgcacacgacttaccctctcgattttgcgagaacattctccacaaccgacgccgtggcccgtgccgacacgaccactgtggcccgcgccgccgccattggaggagagggaaggaaagggagggggggtttatagttggaggaggaaatatttaagatgcgtagcgaataatgtagaaaaaaaatggtacgagaatcactcaccaataaaatcctactaatatttatttttaaaataccataccctcacactcattttacttttaaccgaacaatataatagtccatcagatgcaatgtttaacccctaactccggctctggctacacattgagataaaatgttttgacctctaactttggctatggcttggcttggtggttagtccgaacccaaatgggaacagcgggttgtaatgcttgtcgccgaaattcatcggcagctggtccaccgatttgaaccaagtacgtggcagcttgccggtgaagccgtgatccccgaacagcacgtcggcgacgccgtggccctccgtgccggggagccaggcggcgacgaacgcgtccatggcgccgatgtacggctccaccacgagcggacgcccggagacgagcaccaccacgcacttgacgagcccgcacacgtccttgatcaccttcggccccggcgacgggatggtcaggttcaggttgtccccctccgtctccgcgtacgggtccttccccaccaccaccaccgcgtagtcgtactccttggcgctctcggcgatcgagctcttgtccgggtgctccgtgtagtcgatcaccgtgctctcgtccaccgccgccttgatcgcctccaggatcgtcgtccctgcatcacgattcacattagtggcaaacgcgacggcgagtgtcgatcgagatcggaatcgtgcttgatttaccggcggtgacgttgttgccgccctggccttgccaggacacggtccagccgccgcactggaagccgaggttgtgggcgtggctgccggcgacgaggatcttgtcggccttcttggacagcggcagcacgggcttctccccgtgcttgccgttcttgagcaggacgagcgacctgcgcacggcctcgcgcgcgatctgccggtgctccttgtcgccgagctcgccggcgaggcgcgggtccgggagcgggttctcgaagaggcccatggcgaacttgacgcggaggatgcggctcacggcgtcgttgatcctgtccagcttgatcgacccgttcgacacctgcgtcgtcaggtcggcgacgaactccgggtagtcgtacgggatcatcaccatgtcaatgcccgcgtggatcgtctcctggatcgagtggtagtagtgcttgtgcggcggcgtcgtgatcctgtccaccgcttgccagtccgtgatcacaaatccctgcacattttttaaaagttcagttgaattttgaggagaatttgagaggttttagcattggttaccctgaatttcaacttgttcttgaggatgtcggtgatgaggaagcggttctcatgcatcttgacgccgttccagctggagtaggagatcatgacggaggcgacgcccttgatgacggcgtcgtcgtagggcggcatgtggatgcgcatcaggtcgtggaagctgagcaccgtgttgttctcgttgatgccgtcccgcgtcccgccgtcgccgacgaagtgcttggcgcagccggccacgttcatcccccccgccacgaacggcgtccccttggggtacctcgccggcgcgtcgccctgcagcccgggcaccattgccgacgtcatcagctgcaccagcttcgtgtcctcgctgtagctctcgtagcaccgtccccatctcgggtcgcggcaaacctgcacacacacatgcgatcgatcggtcgaacaccttgaacattacgtaaattttcactggcaacgatgtgttcgtccggtttgggcggcttacggcgacgcatggggcgaaggtgtaggggatgccggtggcgcgggcctcgtgggcggtggactggccgatccgcttgacgagcttggggtcgcgggtggcgccgaggccgacgttgtgggggaagatggtggcgttgtggacgttgttgtggccgtgcacggcgtcgatgccgtagatgatcgggatgccgaggcgcgtcttgagcgccgccttctgcatcttggccaccatctgctgccactccttcgccgtcgccttctccgacggcacgctcccgccgccgctcagcacgctcccttgcaaacacaaaacaaaacacaatgtcagtgtacaacgatcgaacgcgcgcgacgtcggcggcggccggcggcgagaggggcttaccgacgaagtacttctcgataacggcggaggtcgcgttggcgcgctcgatctgcgacatctggccgatcttctccgcgagcgtcatccggctgaggaggtcgtcgacgcgctcgccgatcggcttctttgggtccttgtacttcacgtactcctcccccgccgtcgccgccgccaccgccgacaggagaacggcggcgacgaggagacacaccggcgccgccggcgaacgccacatcgtcgtcggtgcagcacgcattgccaagaaacgcaacgtacgtgttgataagcaaggagggaggtgatgctaattactttttcaccgtgagttcgaagtaaatttatagcgcattgcaggggcggataaatctcgcattccttggggttaggctgttattacggttgcatctacggtttgttagggtggttagatcgatcttatctctgttcgatcgtcgttggcgtaagagggagataaattaaacccgcacgcccgcggtgattttttctgtttttgagtttgaccgtggacgtcaggaacgcgatcgaacggctggtgattgttcggtgggtgaatgaacggctgttgattgagaaatcagggcgacgtgtaatgtgatccactgaactgcttgccatcctaagaaagaaccggatcggaacgcattaactctttgtaatgttacttcatatgtttatcattattacatctctcaaaaatcaccctttttcttttctctaatactataccggaacgctttatctataatgatgtgtttgaataatggattaggagagctgggattgagaaatagaaatgagtggaggaatatgatgaaatgagtgagtagaataaatggctagcttattcgttttagaggatttgtaaagggaaattacaggaatattcaatcctttggaatgagcactatactatcattcgttttaaaggaatgcatgaaaggaaaaattcctatccctccacttttagggggaaaacaaaggaaaaaaataatccactctaacccaatgtttttaatccttttggactgtttgcaacccaaccatataaaaatttcctatgttttctaatccataggtttgcacatgcattcctatattacacgttttctgtattcctacggtttgaaaatcctacaaaccgaataagcccaagattgaaacttaccttttgaggggttgaaaatcatatcccaaacccattatccaaatatggcctaagtgtttttttaactctttgaaatgttatcccaaaaaacttttaaatgatgttatactggctgtttatcattatatctcaaaactcatatcatttttcttttcaaatgtacgcagcatgtaagcgcgcacgctaaaaatgcacgcatgcacctgcttttatcccatctaaaaaagacgtgatactttcgttaattcctaagaggaaggatttaaaggagactgaggaaaaataattttacaccataaatatgggggaaataattccacaacagcccttcaaatcctccttatttctcttgcgggtgggattaatcgaacaagttttagtatgttaccaatccactattagagatttttttaaacgtatgtagttgataaaacatataattgcatatatatatatatatatatatatatatatatatatatatatatatatagtatgattgtttgggtagaccgctggaaaaacataaaattttaagaagagaaagaccaaggaaacttttcattaggtttaatccatgttaaatttgctctaacctgtatggattaagatattccaagaaaaaaaatttctcttttggaacaaatgatattttgaggaattttgaaggattgtgatcatagggattgagccaccaaaaatcctttgaaactccttttgggttatctcatttcattgtaatttcgaggatttttaacatgaagtctaatctcatggagatcacacttgtgtgttagctctctccaaattcctttgatatttccctttgaagcaaccagacaacatgttctcgaggattcattggaccatgacattccaatcgctcgtttttcatattttcgtgttctagaattctgcgatccaaagagcctttataggattcaataatgtcaaatcctttgttccaaacggcatttaggagaaaaaaaactatagcattgaaatcctagtaaatattcatatgattttccatcaaatcaaaggaggccatatgggtcaaatctacggaactttatgaaaatttccaggttcattcttatgaaactcatgttgtaaacctattgtgtagtacagtagtatgtgccaaatctgtggagttttatgaaaaaaaaatgggctcctctggaacacaaaaaatttataaaatggtcatagaatttaggatgtattcctatttcaaactaaaatattttgaaggcatgtattcctagctttagaaatccatatatacggattattcatattgttcttatttagaaaaataatatatataataatattttaaaccaatgctatgcaacttgcaaattctagattagcatgatataagatgtggagttatgccaaattctacataaatccttcaaattctttcattccaaagaggcttagcacgttgttttcctacatattataaattattgtgggcacgctttccaagctccgtaactttttggaaagaaaattctattcataagttgcgtaggatatttgtttatacccttaaatattgtcataaaataaataatatatccaccatttatccattcagcccgtttaattacttgagcagtcgaaaactttctccagctaatcggagcactaactaatcaatctccagcaattaatcttgcacaagtccaagcaaagctagtacaaaattaaagaacatgttaagcgtgcttatcttagttcataggagtaattaggagtactgcactcccacacgatgatccatgtttacttgcgcgcattataattcattggcagttagcaaatagggaattctacgtaactgtagaattaaatttgaaaatatacctttttttcactattttatgtttatatacatgcatgaaaaatattttcacaaatataccttctccgcatattaggaatgcgggactgagacggtgccgctctgtgccgctcttccattctacgggaccggcggtccctcgctagagggcggtcccgcatcacggcgctgcgtgaccggcacggtccagcgtgaccggctcggtcccgcgcatcagtgccgcgcaaccgccctgcctccgcgcatcggcgccgcgcaaccgccctcgacacgctagacagtgcagctaggttgtgtcttgattaattctagacataattgagaccaaaattaacaatatgactaaccagctagcttgtactttctcttagaggaattaggttggaaatgatcgatggatggagctgaggagatcaggatggaataattagtaagctaagctagtgcctggagtatgtattgtggggtttgactggatcaactgcgtgtgtgcgtgcttgacaggtgatgcttgcatggagcgcatgcacgggacggttcgggaagcacggtcccgcgccatggcgccgcgcgaccggctcggtcctgcgcatcagagccccgcatgcgcccgccctccaccacactgccgctctcctgtgttgcgggagcgagcggtgccgcacagccatcctgcgtgaccgtcggtcccgcggaatggaagcgcggcaccgttttggtgccgcgtccagtcgtgcggagagatatatttgtgcaaatattttctatgcagatatataaacgcaaaatattgaaaaaatatatgttttcaaatttaattcccgtaactgtatgcccttactatagcatttcccttagcaaatactccctccgttttaggttatagcacgttttgactttagacaaaattaaactactttaaatttaactaagtttaatatattatctaaacatgaccaaagtcaaaacaccttatatccatatcatctcgtcggctttggacgccacgggattggccgtcatggggaagccgccgtggttgctgccgccgccgtgcacggagtactgctcgtacgtctcgccgtcgccccacaccgcgtacgcgtcctcgccgtgtatggcgtcgccgccgccggcgagctgcggcacggccaccctgacggccaggcacacggcgctcgtcacggcgacgttgagcgccaccacgaacgcgatcccggccagctgcacgccgacctgccggagccccgagccggcgcggccgtccctgacagcgtacgcgaggccgacgtagcgcgggtcgtcgccgaagaagagcctggcgaagcgcggctcggcgaggagcaggagccccgtcaggacgccgctgaggctgccggcgacgccgtgggtgtggagcacggcgagcgtgtcgtcgacgcgcgccaggaggcggctccgcttgtgcagcaccttcatggtgaaccacggccggagagccgcccatcaccatcgcccggcaccagcctggccgccggggtgacgcagacgaggccggtgatcatgccctgcacggcgctgatgacggagaggcggccgaagacgaagctgtcgaggaggagccacaccaggaggctcgtcgccgtgcagaggtgcgtgttcacgacggtgaccgacgcgtcgacgttggcggcgtacggcgcgccgccgttgaaccccgtccaccccatccacagcagcagccccgctccggcgagcgtgagcagaacgttgttcggcgggaacgcctccctgtccttctccgtcctcggaccgacctgtccatgatgcatggctccatcaccatcacactcaagccaagcatggcggcgatcgaacagttagtcgtggtacgcgccggcgaagccccggcgagagaggaagcccgcctggtcgaggccggagaggtcagggcggccgacgaacgggtgcgagctcgtcgccgaacgacatgcggaaggcccaggcgcaccagcagacgatcgagcaccgcggcgaaggcgtacgaggctgtttggtttgttcacaaagtttgccaaaggttgccacctctcatgttagacaagtttaaccaaattagtctattgtttggttcatagccacacttgtggcaagattccttcttatctattaggtctcacatgtcatcaactcaataaagtgtggtacaatccaattttgctagctaaggtgtggctcatttttttaagccacaacttaagacaagtgtggcacaaaaatatggtgaatggtggcaaacttagtatagcatctaaacagcctagagcgccatgaacgccgagttgacggcccacttcttcaccgcgccgcagtcgccgtacaggatcaccagcctcggcacgctctgcagccccaccagcgtcgccgccgctagcggccacgcgttgtcccccttctccacccactccggcgccgcctccgccgccattcgcggccacgaccgaggtgaggcgagggaaatggatttggaaatggcgcgaagtagaggcggagagcgagttatatatatatatatatatatatatatatatatatatatatatatatatatatatatatatatatatatatatagagagagagagagagagagagagagagagagagagagagagagaaggtctgaggtgggggaatcccggaagccgggcagattcctgagaggctgagaatagatgctttggaccacctccagtccagattctgttctacggattgcgaaattgcggcaggatatacgcatatgcgtcatgtttgatttctgaatcgaagtaaatttacataatttttgcaggatttagttcagttcctaaaagaatcatatgaatttcctcctttcttttctttttgcattgatagatcggatgcccaaataagtcaaagaaaaaactaaaatttaatttttcaaacttaatattgagattaattttaagatattacaatgtagttcctttttcagcattgattttgtaagtgacaagaacacgtaaaaaaattccctaataagacgggaataggagcatacgatgggactttcaaacaggcaaagtggcaaacggctcatttttcaagtcccagtgcaagatttaagtaagcaacatttagatgcgtgccaaatgtagtcataaatatttaagggcccctgaaatgaaaaaacataggatttttgataggaatgtaagttaggaatgtaagtgtaaaacagaggaattaccgtttgattggaaattggaccgtaggattttgataggaatgtaagtgtaaaacagaggattgcaaaacacaggaaaaacaaaggaatgaccgtttgattggaccgcagacaaaacacaggaattagaggagagataaagactcaaaggaaagtttctacctcatgttagaattcctccaaaatttgcatggcattaggcattccataggaattttataggattccataaaattcattcctttaatttaaagggctatatagaaaaaattcctatagaaataaaatcctctaaaattcctatgaatttcctttaaatcaaggggcgcctaagtatccactacagaagtaaccagtcgctgttgtgagtaaagaattcaagcaatgccaacacataccaacgaacaacactcactaccaatggatgagcattccaattaccgacagttaaattgctaagaacaaacatggcacaagcatagacattcaataaccaataatccataccgagtcaacaacatatggcccagaatatcactatcacctataatcaatttaacatcgacactacaaagaaaagaatggcgactctaaagttccaaaaacatgagatcctctatgtaccaaatctgacatggctcactggaaaaacctccccgaagaaaaaatgggaacagtgaaatacacagttacaagccacactgtcgatacactctgagtgaaggtgattgcacgatgctttatgatcgacttttctcccaggaagaagagcttccaaaaccaggaccacagcagctcaagcaacaacagcaggaccctgttgcagcataatggagaaataatggaattttaagtatgagaactcagaagcaaagtacacacacataacattgtagcccagcaagctacataaatagcccttccaatttgaattactatttcctctggtgagaaaaggctatgcatatcaattggcttggagcgaactttgcaagaagctattttgttcctggtgggattatgtgcctttgttctgccttcagcgatgctacttaggtttggccaaaaagttaacaaaatcatcacctagcagcacactatatgtcaacagtaagttcttagttaagattccatgctaacagtcaacctgttccagcattacccacccttgtttgcccctatttattcttctttgttctctccttctctgggttgagatattataacagatgattcttctattaagatcgtgaacttgtgatacatatcaagtctgagtaaaatatatccaggaaaatatgatgttaagttaatcgttcaggataatataataacacagcccctaacagaaagaaatggtgtcatgtgagagtttattaatgtgattgtgtagatgcaaagagatcctttgcacacactgaagcagcacggtaacagtcaaacctaaattatcaggcatgcctgatgcctataaatgacaatgcaaccgaaggtctgtttcatggtaatttattaattttgactaaatgaaagaggaaaatggaactgtagctcgagagttgctaaaagtatttatcagctgtagcctacatagagagtcttgattcatttactcagtagcaaccgatagttaagtttattattgacttactttcgctgttagattggacacagctatttggaacttctctcttgttcttgagccagcaacatgaccagccttagcaaccttgctgaaggcaccatttagccagcttgttccagcagacacatacctacaagtaggggaagatggaaaaaaatcagtaaagtgtttggagattcatgtatataaaagatcttatatattcctcctaaaagaatttaggcattataaaggtaatagatttcatcaaaattaaaagctactcaaccattacaaaaaaaaaatgttcattggttattggtacaacgtcaaacaaatttgttggctgaacataagcaaaagcatggataagaagagacctgttggttttcacagcagagccagtgtcatttagcttgcgctctgcagccagcaaagcagccattgttttgtcagaaacatgtagcctttggtctacagatttcactttctcatttacaactgttatcccgctgtttatcttctctgaaattccaacacgcttatcaaaggaattgatcttggccgatgcatttgccctcaattgatgtttctcatcgaatgctttagctttgttcacagcatcttgtcgcattgctgaaccccttgcaatcacagttgtcatgacatcatgagccttgctgacataaacacggccagtagtggggctggcattggcctatgtggtacaatgagatacttttgatcagcaccgatcataatacactaaataaatgtataagaaaataagcgtaggttcccaattgtcatgccaggggaagatgtcacacatgctgttgcacttgattgattcatccctaccacccacctactacaagttatgggatgctcctttcgttaaactttatcagtgcgcacttcccctggttcatgggaacttcatagtatgctacaggtctataccggggaaaataaaatagagtacactggaaatgaaggacacctcggtaggttggtccaaatctgcattaggagccgtacttgtcacctcaccgaccacctcactgaccacaagttgctgcatgattttcaaaacagatgtctctatgaaaaagacgaatcaaaggatttagtactgacatttgggtaacataaattagttggatggtgcacctggtcagtaacagggatgtagatgtagtcttcagcaggggttatgttgacaacccgatccacaattgttgctccctgaaaaagggaacttagaagataataagccataatccatactgaaaggggaagcttatcaaacatctatttcttttcagtgctgcaagacctaggtagcgtaatgagatttaaactgaatataccctaattagaagattcactggattgttatctgtgcactgtgtttcattatgacaatctcagttgaaattgatgcacatttatcagatttgcacacatgctgcacataaagaaatataactgggagcagatttcttaaatggcaaaacagaataacaaagtcaaatgatcacagtagtaacaccatataatatgctgctcacttccatgccaatcaaagcaggcattaatataaatctattttgtttttgtttattatagtccatggtcaatggcttctaagattttaccgacaacggaagaaagcaccgcctttcaatcatttgcttgccagtgcatgaaaccataaagcacacggttatgtgtaatcataggaagaatataaagcattcaagattcaatgtttttttgcatcaaaaatgccttcgattcacataatgatcctcacttacttttaggtcatccatctaatatgaaagagctccacaaggaacacaactgaatatttagtacataaacatttatgtgctctctaatatgtacatgcatgccaacaagttctataggaagtgtgacatattataataacgacaaaataccgtttatataatacatattttcctttttatcgctacacgctacaatattgatagcaaccgacacaaaatttggcttcttcagcgcctaaacaagccataataggcttgtagctacacataccaactacactattcacaatggcagtatgctaaaatactaaatcattcattaggcacaccaattgtgtaaccaccacaaccaatagcgaaaagtcccatccacaaacatagccaatcaatgcacagagccataccgacagcagcagcgcgatctctagggccttgggatccttgaacgtgacgtaggccgtcctccccgtcgccaccccatcgctgcaagcccaaaatcacaatgcggatttcagagaacacgaaaaagaaatataccacttctgattgctaaagcaatgcagaggcgcaaccattagcaatccgaacaaagaaatcgaagggcaaagcggcgcctcaccatctgatgtcgacgtgctcgatttcgccggagaaggagaagaactcccgcacctcccgctcccctgccagatctgagatgttccgcacccgcaccgtcctcaccgccctcctctcgccctgcaagcagcgaaccccctcacacgatcactcctcttcctaccgccgccgccgccgccgcggcgcaagaaaagaaaaaaccaagaaccgctcacctccatggttgctgatggcgcgacaccgaccgcgaagagcagacgagccaagaatcccggcgcgagcagcagaagcagggtgggggggaaggcttggtgagtggctgcgctggcgatccgggtagggtttggtgctcgagaggcgatccgcgttggctggttgggttggttggttggctggccgccgcggctgcgaaaaacttttctacgttttctttttctttctcgagctgttcgcttcgctgatcgccgagaaagttatttacgcgacacgaaccaaactccacctcggaggccgtaatacccgttctgcccacggccatatcacccacatggatggtacgaggggtaaaatagtattttcgcagggtcggggtgttacttgtgagacatgctggctgctgagtttgcttcgcggcggcgccatctctcctgacctgtaaacaagaccagtcttgcttactagtataattaaattaattaatattttttcgggtgattactgtattaagtgacctaataatgacacggcagcggctgggcccacactccagtcaccgtcagtgtggggtagtgagtggtataaaaccggtgtttaattttggcgcggggccgtggggttaatctaatctgatgggcgaggtgggccccccagggcgatgtgatatggtctcgtgcaaatggaacggtcgttggttgggcccacggccagctcggtcgggggtcaagtggcacatccgtcgccgtctgcttcccaccacggaatgatgacaagagctctgtattctttgcatgtgagagcaagtttaatagtttagccaactattaactccaattcatctatagccaatttaatagctcattcatacaatagttatatactacatttttaatatctggttccacctattatacatacactgcgtcttgaagtccatgctacagctggctacaaatctgtagcccgctgcccttctctctcctcatttatctgcttaaaatatatttgcagttagcttatagcatgctattgtacctgctctgacgtgagccatcttgccatctctctcgctggcgagcaggccctactaaaattcatattttctccgtctcagccagcatactgcgacatgtttccttcgctctaaaataaattaacctttaatatcctatatgagtttggttttctagacagggagtatgataatatttaatcatcttagaacagtaaatctaaacctaacctattaagttgtagtattttaagacgaagttttctccttgaatttctttgaaaaaaatatattcctcctcgaattatggtttgtggatattcttcagtcttcacaggaaaacgcgtggctaattacgtgttgaaagataattcatgaaattttatcccgaaaacgggtgctctccatttgcttatagatccttgtcaactaaaaataagtaaggtcgtgttctgcctattcctgtgtaaaacggcgaattcattcttgtgaaatttctttgaacgtctgatgaaattgtttattacgataagtgtgtcattatgtcactcgtataagtagtttatcacgatgaagtggaaattgaaaaacaagaagcaacgagtttagcatagtgcaataaatgccatggttagtaccatctcactatagacacaggatccgtattgtaagcactttactgcaacgcttcaatacgagccatatggcagcatactgccgggatatttattccattatgcagcatacgggtttagtaattgattgtactgtagaaattaatgttgttactacaacataggatcctacctatatgatgtttttttttcctatctacaagtttgttttttttcctatctacaggtttggttcttagtgtctgtttaattcgtgaaaagaaaatttttgggtgtcacatcggacgtttgatcggatgtcggaagaggttttcggacacgaatgaaaaaattagtttcatacctcgcctggaaaccgcgagacgaatcttttgaggttaattaatctgtcattagcacatgctggttactgtagcacttatagctaatcatggattaattaggcttaaaaaattcgtctcgcaatttcttccttaactgtgtattattttttaatttatctatatttaatacttcatgcatttatctaaagattcgatgtgatgtttttggaaaaagtttttgggaattaaacagggtcttatgccggagggagctacagttagacccagtttaaaacgtagggaaaagaaaaagacctagcactacatttaacatggacatatacttctatagttttagtttttggagtatctaaagttagacctgatttaaacgtagaaatttcacatgaatattccaatgctcacagaaaagaattataaacttatcaaggaaaggagcaataatataatccctatattccgttttgtggtgtaagtcatttttggtttgttataattcaaactttggaaaaataaaacaacattcctaacgcaatacaaatatcttatagcaggatttaatataattaatttagtgttatagatattgttacatttttcttataaaaacaccaagtttaacttataataaatccaaaacttattaccactccattagtggagcgatcagtactatacttgggtatcagcccatcaagcacctcaggtccagtctcacagtaagccgagccttggagaaccgaaggcaacggcccaacaagtctgccacgtggcccacgacggaagaagcccacgtcgaacaaaaccatttcagcccaaatctgaccggaagcagaggagcgcccaccgccgccgccgccgccgcctcctcgcctctccccctctcccgacgccggcgtccactctccctcccctcccctccccacctcctaacacatgcccgcgccgcagcagcagcagcagtggtagagcccagcctgcctaccctaccaaccgacgggcagtagcatgcgcggcggcttgcgccgcgggctgggcatcctcctcctcccgctctccagctcgcccagccgggcgccgcggccgccggtcccgctcgctgctctgctcgtctaccaccgccgcctcgatgtcttcgcccgccggtccttctgcagctccggcgggggctacgccgtggagcagttctccgacgacgagtacgaccacgagtacgaggatcaccgggtaccacctccgcgcaggcgccgagctagctttttcttccctttttgttcttctccagtttcgccatgctgagctatcgagtggtgaactggtgacccgcagccgtcgtcgtcggtggcgaacatcgacgagtggaggtggaagctgagcatgctgcagcgcaacgcggaggagcaggagatcatctccagagaccggagggatcgccgggactacgaccagatcgccaacctcgccaagaggatgggcctctacaggtcttccaccgtaattttgctatctccggttcataattcccaaatgtagatgtcgaaacattgaaatttgtggtttggtgttttctctgtggaacggcagtgagatgtatgggaaggtcattgttgcgagcaaggtcccgctgccgaattacaggccggacctggacgacaagcggccacaaagagaggtgagcccatgcattccactggcaagatcaaacatctttcccttatgcaaattgacggtgtttaaatactgcgaatgcctttgttatgcatggaaatacgcaggtggtgattccattaagcttacagaggagggttgaaggacttgtgcaggagcaccttgatcgtgcactcttgccggataaatgtggaactggaaatggttctgagatggctgagaaagctgagaatgtgaacctggatgagcagcaggattcccttctcgatcgatcggtcatggagaagatccttcagaggaagagcatacggatgcgcaattttcagagaagttggcaggtatgtcactcttgatatgactacgtaactttgaattcaatctggatacaggtttggattatttgaaaatgtttagatggtttatagatctgtacctcaacaatgggtacagaatttagggagctctctatctggataatttacaaatgcctggatacacatagattagagattccttctacagcatttagtgtaaaatttgccttatatctcatttcaacaattccattgtggttgatcatccatctatctgtaacaataggaatcacctgaaggagttaagatgctagaattccggaaatcacttcctgcatacaaggaaaaggaaaggcttctagcagccattgcacgcaatcaggtatatatactgtataattcacaacatatgtttatgagccatagaatctgtgtatactgcatacatgtttggcaattcatttgtctctttcaatttttctgaacattcttatgcaattctaggttatagtgatatctggagagacagggtgtggcaaaacaacccagttgcctcaatttgtattagagtcagagatagaatctggccgtggggccttttgtaatataatctgcacacaacctcggagaatttctgcaatggcagttgcagagagagtatccactgagagaggagagaatcttggtgaatcggtaagataaagctttcttttttcgtctcatatggtaccatgtcccatctctaatatgattaaggacaaaatgtctttactagattcttctattgtatttttttgtatacaatgctagtttttttaataggttggctacaaagttcgattggagggaatcaaaggaaaagacacacatttgcttttctgcacaagtggtatattactacgacgattgctcagtgacagaaacctgaatggagtaactcatgtatttgttgatgaaatacatgaaagaggcatgaatgaaggttggaagattgcattgtttcctttgaatttgctgagatcgtctttattaaactcctgataaagttgcattactttgttggtttctcagatttcttattgattgtcctaaaagacctattatcacgacgccgtgatttgaggttgatcttgatgagtgctactctaaatgcggaactgttctcaagttattttggaggagcaccaactatccatattcctgtgagttaatatcttctcatataaaaaaatatattacatctgacatctgtcttattcttctcatgaatgctgcttctatcagggattcacatatccagtgagggcacattttctggaagatatattagagaggactggctataagttgacctcaagcaatcaacttgacgattatggacaagataaagtctggaaaactcagaggcaactattacctagaaaaaggaaaaatcaaatcacaacgcttgttgaggtacattttcaatatatatatatatatatatatatatatatagagcgcgcactttcccaacattcttctgatattattattgtactatacaggatgcccttaaaacttctagctttgagacctatggatcgaggacacgcgattctctgtcaaattggaatcctgattgcatagggtttaaccttatagaagctgttctttgccacatatgtcgtaaagagcggtctggtgcagttctagttttcatgaccggatgggatgatatcagttgcttgaaggatcaactaaaggcacaccctttgttgggcgaccctaacagagttttactgcttgcatgccatggttccatggctacagctgaacaggtagttgcttctgatttgcccctatcttattgagattgcttgtgtgatacgagttaaaccactggattggagatatgagtattacataaacatattttatatataatgtatgcatctggactgttagtctattgatacttatttctgttagcatcttttgtgcatcgtataattcatgctattgacatctatgaatgtattatgatattcgcagaggttaatctttgagaagccacctcctaatgttcggaagatagtgcttgccactaacatggcagaagcaagtattacaataaatgatattgtttttgtcgtggattgtggaaaggcaaaggaaacgacatacgatgcactaaataacactccctgcttgcttccctcatggatttcaaaggcttctgctcgtcaggtaaaatgcccaactttgattttttttttgcttctcgtctttcagcagcagcagcataaaatggcatgtgcctgtacctactttcattattatttgttttcttgaactctctcgattttaaccttctgtatggtctagggggtaaatgagccaaaaaatagtttagggggttaggtgatccattgaactagttcgggggagtagaatggacttttttcaatgtaatataattgaacgtttgtcctgtttgagtctatagtattatattagtacttttgactcttactttgcagcttagcagctttttttatcattttctcgtggagggcatgccttagatttgtggttgggaaatacctatatttctgaacaagcacgtccatgtgtctcttttgcttatgagcttggctagtcgacctatcttttattttttctgcttcaataggcagcagaaatgtactcaatattaaaaatcagaaactttgtaacaagtgatcaaacttgaagataactccttaattcagatacactatactattgttttcctctaccatatccttctttgccatatgtctgatagtctccccattatcttcgtgcagaggaggggcagagctggtcgtgtgcaacctggagaatgctatcacctctaccctagatgtgtgtatgatgcatttgcagattaccagcttcctgagctccttagaactccattgaattcactatgtttgcagataaaaagtttgcaagttggcagcattggggagtttctatcagctgccttacagcccccggcaccactagctgtatgtcttattgtcttgggtggctacgggctagcaaaagggttcttgttttcaatcatctccgcttttttttttggctgatcaattgataaatatacaggtccaaaatgcagtggaattcctgaaaatgattggagcattagatgaaaatgagaacctaactgatctaggtacatctatcctacactttggttctttgctaacactgcaaaacatattattactgaaacctatttaatattccctaatccaactttgtaggaagatacctttccatgcttcctgttgatccaaagttggggaagatgcttataatgggtgcagttttccgctgcattgatcctatacttaccgtggttgctggattgagtgcccgggatcctttcctgctgccacaggacaagagagatgtatgccttgattttccactaattactattattaattgggagacactattcttgctttcatagaaaatttataaaaaaagggaagaattgggcctcaggctttgtgtattcattatggcaagaaggatgtgtttgattttttgtcctctatttgttagttggcaggaaccgccaaatcaagattctcagcaaaagattatagtgatcatatggccctagtccgggcttatgaaggatggaaggatgcagagagagaagggtctgcttatgaatactgctggagaaatttcctttctgctcaaacacttcaagccattcactctcttcggaagcaattcagctatatattaaaggatgctggtttggtagactctgatgcaaatacaaataatagtttgagccataatcaatcattggtccgtggtatcatatgttctggacttttcccaggcataacatcagttgtggtaaagatctgtcagactactttgtaaagttccattctatttgaaaacacaaaacttgtcagttaatttttgagctttcctttcagcatagagaaaactctatgtcgttcaagaccatggatgatggccaagttcttctttatgctgtaagttcatactggaacgtcttgaagttttcatgtgcaacaccctgcttactagcttatcacttgacctttcatgggagatagcccatctagggtgccatgtatagtgccttacatttcacagataccaaaattgtgctgatttatttgcattttacgctattccagaattcagtgaatgctaagtaccagaccatcccttatccatggctggtctttggtgagaaggtgaaggtaaatgctgtcttcatccgtgactcaaccggagtatcagattccatcctgatcttatttggtggtgctgttacaaaaggaagcatggtatataaatattaaatcttgttcaagtgctttatgacatttttgcatttctattttccctacctatataccttctaacctgtccatcataggctgggcacctgaagatgctcgatggttacatcgatttgtttatggatcctagcctgtgtgaatgctacttgcaacttaaagaagagcttgataaacttgtacagaagaaggtaagccatgcaatattctattgatttcgttccactagatatttctgttgccgagtcagcgtttaataagtatttgacaggcattgccaatgctgttatgacttatgaggcatgtataactaacattgcatatgctgctatagtgcgccaaatgttatttctcttaaatctgtccaccttctgtggaagctaggaacaaaggagaaaattcacatgcaatggacagagagacaaccttttgttgtttattgccagtcacttgaaatgatatttgatattgaaacatggcctgtggtacatcatcggttagggcaaaaaagattgaaactaactgtgcagtgtttttttttcttgatttcagtcaaattcttccgcatctattatatatcagtcatgtgtaataactctacgatgttttcaatctgaactccagcttgaagaccccagcttcgacatccacaaggaaggaaagtacatcttatatgccgcacaagagctcgctgcaggcgacctatgcgaaggaaggtttgtgtttggccgcgagacgagcagagcaaggctcagcagcagcgacgacaccaaaggcaacattatcaaggacggaatgaaccccaagagcctgctccagaccctgctgatgagggccggccacacccctcccaagtacaagacaaagcacctcaagaccaacgagttcagggccatagtggagttcaaagggatgcagtttgccgggaaacccaagaggaacaagcagctcgccgagagggacaccaccattgaagcgctgggatggctgacacagacctcagggacaaagcttcaggatgatggcgatgattcccctcttgacctgacggataacatgctgaagttgctcagtagaccgaggcggcggtccagaaacaattccaggaaatgattttcctgtcaaggacatctagtacttaggttcataagaagcccatgatagttttgttatggtgccatttttttgttggcctattggttggatgcattcgagcttggtttcaccggattcatcgccccttttggaattttgctccgtgtcgagcgtttagatgctcaaattagtgtgaccattattggttgcatcccttgaacatggttatgtaatttgttagtttgtacagcttattatgtatacaacggcatgatgtatgatcgagaagtgaggaaaaatggaaggtactggattttgcctgtactaattccgcattcactggcaatgtcgtgcatccgtaatccgttcgtgtcaaaactgaagcggctgccgccggcgaccacttaggtttgtttgaattgtaatcaaattttatcctatcaatattttgcaagtgttaaaaccttggcaaattttgatactttctagattgatagcgtagaatgtgtattatcatagacataaattggtaacaaaacaaacattcaaactctactattgaaacttaaaaaaaactaggactcactccgtttcacaatgtaagtcattctagcatttttcatatttatattgatgttaatgaatctagacatatatatatatatatatatatatatatagaaaatactaaaatgacttaaattctgaaacggagaaagtaggacaaaaattggttttcgagggaagaacaaaagttggtttcaatccaacccgtctccgcttgatcaggtgcgtcacccgtggcgccagcgtcaaggctgtggaccacaaaatgaaagagaaacccaaaccataattgccccttcaccacttgattaatttatcctctcctcgcgtcgctgtcgcgtctcccagttgttgggggagtgatagtctgaggagaagaatatcatgacacaactagccaaccaaccaaccaaccatccttttgcttttgcatctcacacttgtgtatacaaatgaaggaagacgaattacattccatctcctccccttccatttcataatccacccccaaaatagcaaacaaaaaaatatcttatcaataattaaatccctttttttatctgatccaaaacttttttttaaattctagaagctactagaaaaagtcatggggcgagagctgactgtgccgtgggctccaggccaatccaggcccaggaggcccagcaatttcttcccctctctctccttcaaagcaggagaaaagaagaaaaattgattgctctctcgttccgttccggaggagagagagagagagagagagaggagagcggcggcgatggcgtcgtcgtcgtcgtcggcgtcgagcaggttctcgccggcgctgcaggcgtcggatctcaacgacttcatcgccccctcgcaggactgcatcatctccctcaacaagggcccctccgcccgccgccttccggtgagactcctaccccgcgctcgctgattccctttctgccctaggctggggctggattggagctatgcccggcggcgctgctccggtgttggttggcttgccggtcgcgtggttggtcgctggccgtggaaccgtgcgtcgtaccaaaaaaagtgtgtgtagttttgtgtagccatatgggtgatgcgtggtaatcttagcagcgtactagttcgtctcaccatgcgatgcgggatgattctgtatcgatattggaagattttcgagtgctgtactgctgatgtctagcctgtaggcatcgattgatagagcgtgcagagtagagaggaggaggaaaaggaggcggaattgattttgtccttctgctgttaggttgtttgtgaacgagacgaggggacaaaatggtcttggctaaagacgagccaccattatcgaacactctgaattcttcggagttcgggggtgggatttatggtatcagatgctttttttgctgcatactgtctttcctgctgttcgttttagtcgagagaaatcaaattaaagcctgcagtgagtgaacaacctctccagaggtgttgaagaaaactttttgattagtaatagagaaacatatgaaaccaaaacagaagtccagtatcaggtgttggttgcaaacatgaaagcaacgttcaatcatatatgatttctaactggcacctagttccctaattgtttgttgaatggcagaataaactcaataccagactttgcacctttggtatttacatctctgcacacatttgtacaagtagcttcaaaattagtataactggatgattcgcttcccatccgcataccattcctcatatcttggcacttctgttaacagatcaaacaaaaggaaattgcagtgagcacaaatcctccagaggaagcagtcaagatttcactgaaggactgtttggcttgcaggttttctttactaccttgcactgttcattcaatcagcagcttgtccaaatccaaataatgctgactgtttcattttaatcccatagtggttgcataacatcagcagaaacagttatgcttgagaagcaaagcttgggtgacttcattactcgcatcaactctgacaaagctgtcatagtatcggtctctccacagtcaagagcatcgctagctgcattctttggtctttctcaatcacaggtgattaaatatttttttcagttatctgcttccctgtcaaatctgtccttataaaatgttttgtccgaaatgctagtttatttgaacataaccacgactagagatgcataaaggagtgcatttttatcatgaacgtggtaacaaaagcaggagcttaatacctttatgctcaggttttcagaaaactcactgcgctgttcaagtcgatgggcgtaaaggcagtttacgacacaagttccagtcgagatctgtccctaattgaagcatgcagtgaatttgttactcgttatcatcaaaaccagttatctagtggcaaagaagctggaaaaaatcttcccatgctttcatctgcatgcccaggtaaaattgtttgcagggtactatgtaatttaggtatcatgaattctgtacttccacataatgcttgtactctggtaaaaaatatttgatgtttagaataagattcactcaaacttttaaaattttgaccatcaataatttctcatcgaatgcttagtttaaaaacaaaacaaatgatatacatagatttacctcgaaaagtactatcataatatcataaacttattagattttataaactaattctaatataaaattgattgttggaattttaagttgggcaggatcttgtcctaaatgtccctttttttttttaccgtagggggtagcttattagttgcatcttattttataaacaagagtaagattagtgcacaaatatattcaaacctcttcaacttgcaggttggatatgctatgcagaaaagactctcggttcatttatcttgccttacatctcagctgtgaagagcccccaacaggccattggtgctgctatcaagcatcatatggttggaaaacttggtctgaagtgagcactttgccatagttgatgtaaaggtgttaccttcatattttatatactatagacccttaaatatttggacttacagttgtacatgaatgaatttgttgtgtaggccacatgatgtttatcatgttactgtgatgccctgttatgataaaaaactagaagctgttagggatgattttgttttctcagtggaagataaagatgttacagaggtagattccgtattaaccactggtgaagtgttagatttgatacaggtaactgatttttttcccatgtcctgtcttttgatatgcatttaaaaaactatgagaagcttataccattttcatgcttgtgcagtccagatctgttgatttcaagaccctagaggagtctcccatggacagattgtgagtccctagtgtgcctttagcccctttgggtgaagtcctaatagaattcaagttggaaagtaaaatcagtcattatctgttcaaccgatatttcagatttacaaattttgcattgaatttaatcactccttcaataaaaagtcaatagaataattcatgttgctttggataacatgctgtggtatatcacagttgttttatctgtcatatctggaaactcacatatacttacgttcattgttgatccagattaaccaatgttgatgatgacggtcaactatatggggtttctggtggctcagggggttatgcagaaacagtctttcgacatgcggcacatgttctcttcgatagaaaaattgaaggatcagttgatttcagaatcttacgaaattcagattttcgtgaggttacactggaggtgaattcatcctgcatcatgttggcctgctttcaattctctcttaagcatgattcaagtggccttagattaattttgtataacgtgtgttgtgttaatgcacaggtggagggcaaacctgttcttaagtttgcactttgttatggattcagaaatctgcagaacattattaggaagattaagatgggaaaatgcgaatatcactttattgaagttatggcatgtccttcaggtactcccatttatgatacagtgtggcttgcccgctttaagtaaatggttctgagccataggatcttgattctatgaccttaattgttcgcttgcaggctgcctgaatgggggaggtcaaataaaacctgccaaaggccagtctgcgaaggatcttatccaactactagaggatgtgtacatccaagatgtaagctagcgaaatctctcgctaaatttcatgctgtttgtttggaacttgcttttctatgctatgttatgttgtctcagcattggttggattcttccatgtcaatgtggagtagacctgaagcttcttacttgatgtatcctagtaaaaaaaaacagagagaataatctgacctcacagttcatttatggtgatccatcatgttgctgttaacatgccaatcaagtataactgtgtggtagtatgcaattcatatttaccgatcatcacatgtgcatatgaaatgctagctgtgatgcttctaggatctaattactactgtgcaaatatgttatgtttgctgtatgccagaatttccactaactgtaaagcttatggccttatgtaccaggtatcggtatccaaccccttcgagaaccctattgcgaaaagattatatgatgaatggcttgggcaacctggttcagaaaacgcaaagaagtatctacacacgaagtatcacccagtggtgaaaagcgtggcatcgcagttgcagaattggtgataacacagtggtggaaagcatttcccagtgtgggcagttgcttgtgccatcttggtgccctgcccacactaagcaaacactgaacacacagaaaagaaatacacgtcatcaaagattttgcatgcgggcaaatgaattttgttagattgtaggttttaccagcttttcttggtaatgtttgtatactacctcctcactgggaaacacagatgagattgtaacatgtaaaaacgaagtgaaccaaatagtagttgatctactcagctgataattccattgcaatttttcaaacagggcctattcgttagcatttatcttatgattccttaatttgttttatgtacaacagtgatctttttctcttcttctatgacgtgcgtgaaacagacgtttgtcttcttcattgaccttgatacagctttgccccgttgacatttgatggtgaagacatcaaagtgaactttgcaaagttgattaaaaattaaggagaagaccaactccgaggtgtgtttggaatccgcaccttcctggcccgtggttttgcatttggaatctctatataactctggagattctttggggaaacaatattttttagatgaagggaaaaacaaaatactccaatttggcagactgacattgcacagaaacaaagagaaggcctgcagctgaccgccgtacgaggctcaaaacagcaaactttatccttatcaagaaggccaaaatcactcaaaaataaacgatacaatttgtgctgcattttcatcagcaaatcagtagtaaattctacagaggttgaggttcagatgcaggctggaacatgtcggggagcgtctcgagcaggtaggtgaacagcccgcccagcaagaagatgaacacgaacgcgagcacgatcttggtgatgtacgctgccatcgtctcctggtcgcgaggattcttcgccgactgcttcgtgtcatctcgtctctgcatggcaaccgaaaattttattcagagaggaaatcgttgctcattttgttcttgatttccgagaagaaaagaggaggaaaaaaattttctgaacttcttgcataccgtgtcggacgccggcgtctggtagtaacccggcgcgtcctgctcggtgatggtctgcagcttccatccgtcgccgtaatcggcgagcggcgcggcggggccgaagctgacgggctcctcgccgtccttcacggcctcgacgtgcagcgccgccggtgcgccgggggcgagcttgcggttcacggcgtgcagcgcgtaccgcgccgtcgtcccgaacgcgaaccgccgcacctcgccggagctcctgcacttcacctccaagaactgcgagcacacacacacaccacccacattgagccaatttccttctcctcgttctcaagattgaggacactctaccgtagaaaaaaagtaagcaggtttaccggcggtggaggagggtcgccggcgccggcgccggaggctgccttctccggctcgtcgggcttccgctccatcgcgccgccgccttccgatttcgcgatggtcgcggcaaggcggaggaggagttgtggccgactgactttggcccgtgcgcgtggagcagcagcgaggaaaaaagcacgaaagaatccgctaccgggttgactttttcctatccgtttctggtccgggccgaatcgctcagagatttcggctcaataccacgcgggatccaccgtgatttcggcccaagattacgcggaatccaccgtgatttcggcccaagatcacgcggaatccaccatttcgcgagcacacgcgatgcgcacgcgcgaggcggagaccaaaccaaacaccaccgtcgcggcgcgtgcgtctcaccagtcgcgcgagcgagccgcgtgacgcggtggtggtgggcaccagcgatgggcaagggcggcggctgcatcccgagcaagaggcaccgcgccgccgcggcggcggcagcgccagcgtcgcactcgcaccagcgcgagaggacctcgatcccggcgccggcggcggcgccgcggccggtgcgcatctacgtcgtgttctactccatgtacgggcacgtccggctcctggcgcggccggtggcgcgcggggtgggctccgtcccgggcgcgcgggcgatcctcttccgcgtcccggagacgctgccccccgccgtgctcgcgcggatggaggccgacgacggcggcggcggcggcgacggcgaggacgtcatccccgtcgtggaccccgacgggctccccgacgccgacgggttcctcttcggcttccctgccaggttcggcgccatgcctgcgcagatgcaggccttcttcgactccaccgtgccgctctgccgccaccagcgcctcgccggcaagccagccggcctcttcgtcagcaccggcacccaggccggcggccaagaaaccaccgcgtaagtatccgccgccgccgccgcgagatcgcatccctctcgcatcagatcatctcactctgctccgtgaatctctctggctgcatgcatggatgaagctggacggcgatcacgcagctggcgcaccacgggatgctgttcgtgccgatcgggtacaccttcggggaggggatgttggagatgggcgagctccgcggcgggtcgccgtacggcgcgggcgtcttctccggcgacggctccaggccgccgtccgagctcgagctggccctcgccgagcaccacggcaagtacatggccacacttgtcaagaaaatggtgcacggtgcctcgtgatccgaatgctctaccaaatatggaatctctcgatcgagaatccttgcaattagactgagatttcaagccgatatcctccagaaattcagtggcattgtgcgaattgtgacctgactatcttgcattgccctgcctgttctagcatgatcagacccaaatgtgatattgggattatggaacagaaaaggatgcagacggtatgcataatctaggtttgtctaaaagaattacagaggtcatcaataaagacatcaataactgagaacgatagtgagaattaggcagaggtgacaatatatcacatactaatgtatagcaactcaaaactatgatctccaactccaagtcaaagaggactaacatttctaaagcagtaatatttccagttttggatgtgataaatgtaaacttgcaactacaccaagaacaaggggaaaaaataactcaggttcatcactctcatttcatcattgtgcactcctaaagagtttttaaaaaatcgcagattctagttgtacaaagaatatgtccaggaaaaaggtcaggggtgtctacatttctgcagccccaacaaatctaacattgcccaaccaaccccatacaacaaatgtctgccctacttttctttccccgaggaactattcctaatatatctaaagaaacactcgtttcccatgaaacatatctaatctgaaaacagtcttacacaatgcagcttgtaaaattaatagcatctcacttagcaggggtagcatttgttttattttgcatagtacttgcttgggggtcttcagttgtcttggatgaagcaccgtcaatggcaatgttccccaagttcacagccattgcatctctctcttcattctcaatcctctgtttctctgaaacaccatcatcggacgaattctgtgtcaggtctgatggccgtttaggctgccggcgaaggggcccgacatcaagccatggatgttgaagcagttgagcggctgaaggacgcttttcaggaacaaaatcaagtattggaacaagaaactctgccatgccatttgcatctatatcactgaattcatatttctcaaccaaaaccttgttgagcggccaaaaccgcaagcgccgaatgtgcctcaaatccccataacgattgaagaactcacgtgaatatcgaccacccaaggcaatctaggaaacaatgtctttgtattttatctataattcagaacaatttacatgaaagcttacgaagatggaaaatttgttacctttcgaggcatcattcctaatagctccatcatcagcgcgaggtgatcctgcttcaagcaagaattgatcagaataaacttccaatggaaagggatggcattctgtactatagggaagacaactagatttcatatctatcattatggttttgctacttgcccatatctatttcacacagcatctccaaacaatggcaggtgtttaagaattataaaaagattactcagagaacttttcaattagtaatattgctaaatgaaaagtttgaataaattcagcagttgatttcccacaaatatgaagtggtcaatcaactaggacaactgaataaaaggtttgagcttataatgcaacttgacaaaaaaaagcaattggcatcatgcattcatgtagtcaatgatatgttccaataccatataccacaaacttgaaatgtatttatcaatcacattcagaattcattcaatcaagataaccatatgacatacctgaaaagaactagcttagaccagtccttaacattacctttcatctgttgccgatcatttttagaagaaaactgtggcttttatcacattggtatgacttagtttcattctctctttttttctctcttatagactacaagttatagcttctgtagaacacgtgatgtagacgagtacgttcacagattttcaaaatgataaaatcacaattataatagtaaagtatgtatgccagagaccatgccaaactgccaataaccgaaacttcgtttatttcttgaacaaagcgagtttctaatgcataggtgcatgttattcatggttaaaaggaaagtgtcagactcgaatagccaagtacactacaaattgaataaacacatggcatagcaaagttttctcctgtcatcttatgtgctacagtacttcttccacgagtaaggaggaagagagggtgcgtcgtgtaattgtgtatggtggtggtggttggtttggtttggaggccttgtcaggtctcataactaagcatgaaaagaaaatatactatgtgttcaaaattattgtgaaacagtaagcaaacatgaacaagaaatgagctgtatcaggccggtaccccacaatgttttatgtatatcaaccttaccattgtccaaacatgatcgccttcaaaacgaaatgttcttatttacaatatttaaaatttgattatcattttttttctggaataattggttagattcctaccgaatcccacaaatctgagtcagaagatgcatcgaaatgctcaagctttattaagaaataatttctccaaaacaatctttgtagctttcattttatttgcttttggttatgagatcatggcacaattagatgttgacaaatatcaaatttcagagtgatgttccttttaagtattgtcacaaaagaaaacctaggtacatgccaaactggagttttgggctgtagccagtagatgtcatttggcttgatcactcaaatttctattgtgatagactcctatttttttaagctaaagtgttgacaggtgatagtttgagttaagttttgtatagatatgaaatgtcttggaaagaaataaatagacatacctcatccctgtcataactgtcaccactgtgcggatcaaatagcacatctcctgtggcaagctcaaagcatatgcatgcaaaggaccacaagtcagcagatgtagaatacttggatcccagtatcacctcagggcatctgtattgccttgtttggatatcacttgtaaactgtttgtatgtccaacatgcatttccgaagtctaccagtttgcacttcaggtcagcctccaatgccatttttttcctggtccctttgctaccccgtctactcccttcaccttcttctttcttgtctccatcctgattcggactaccctcgtttgccgtactcaaatttcccctatcatctgacccatccgtctccccagatgcaacagtcccacttccttctgaagttgcagcggctgcacgcttggctttcctccgaatcttcttcttttggttcctggtgagaccaccattcactgatggtgcatgtgcctttggaggaggatcatcagttcttgcagaaggtgccaccagcggcacacctgatttccgggggtccttcgagggatcaatagtggattcaagcaatatattctcaggcttaaggtcagtgtgaatgattgaaagtgtgcggtggagatagtcaaggccaatgagcacatgtcggcatatctccttaaccatgggaagtggaattccatggtaatccgtgtactttatcagggtcagcaaattatcaccaagaaactcaaacaccatgcacacatggttcccattaggccccgagtgcttgaagtggtcaagaagcttaacgacgcaccgagagtcatcaggatcaccatcggcaatctgcttcaagatcttgatctcatccatggccgcctctgtgtagtgctgtgcactcttctgcaccttcagcgccacatatctctgcatatatataaccaacaaattcagaaacacaaagggtatataagaacagatacatttcgtgtatgatgatggtgggattaacgaataaaacagtactcattaacaacgaaattagccattatgataccaccaaagcaataaaacgaacaggttgcgggtacaaacgaaaccgcccgcaatacaccagatgattaaaacgcatccaggtcgagatttcccacaaatcatcacgaatctaggaagggaa

SEQ ID NO: 67314 - DNA, 505 bp, Oryza sativa
accaccaccaccaccaccaccaccaagaaccggtcgccccggtgcgccattaccccccaaaacgatcaagaaaccacaaaaaaaaccagaccaaaaaagaagaacaaatctcccccctaatctacacctcacgacatgagagagagcttgcttgctagtgagaagattactttgagctggagttgcttaagccgcaccccagctcgcatatggagctagacgaggagatggatcgatcgatcgatcgagcgagcggaggcgttgctgctgctactgtcgccgctgctacacactcgctcactctccggtagtagtggtattaatgtgtttttggctaaaaccccggttgattagggttaaaacctcggtcgatttggtcttatctgcgcgtctcgggggttggaggaggagtatatttaatggagcctatgaacttatgatatgagaggtcgtctcaagctaggtcggggggctattgctaatttgctactgctgctgatgggat

SEQ ID NO: 67315 - DNA, 547 bp, Oryza sativa
tcccccaaaaacatcacatcaaatcttggacatatacatgaagcattatatatagattaaaaaaactaattgcacagttagggggggaaatcgcgagacccatcttatgagcctaattagtccataattagccataagtgctacagtaacccacatatgctaatgacagattaattgcttaaaagattcgtctcacggtttccaggcgagttatgaaattagctttttcattcgtgtccggaaaccccttccgacatccggtcaaacatccgatgtgacacccaaaaaatttcttttcgcgaactttaacaaggaaataacaaacaatcgatgacgttggatgacgctgttagggttgtctattggatcacctaggtttagatctagtcaggtagaacactttggatggatgaacaacaatagatgaattaacaaagagggagtgagagggtttagggatgtgatcggtcgatgttgaggaggaggaagtgcggccggccatcgtcgttgtcgtcgcaggcttgacgtggacggcggtgacggtgaa

SEQ ID NO: 67316 - DNA, 2584 bp, Oryza sativa
gtccatgcacatttcagctcgatctacacaaaagttcaaattgaaccaacaaaagtaaaaaactaaaaaagataccgaagcaaaatttcagtaacaacagattattttttttagggtttgttggaaccatgccaccctaattttacaaaatttgagatatgtcacccgtatctcagtgacatgtaggacccacatgagtcaatgacatgtcggtcagggtggcatatcacaaatttgaaatttgtgtggtatggttcaaattttcccttttttttagagtaaaatgcatggagggtcattaaacttgtttaagtgtgtcatataggtcactctacttttaaaatgcacatttgggtcactaatgtgagataagtgagtcacttacccatctaactattcacgcgagcatactttgtacacatggcatgccatgtaggattgaaaaaattgcatttgaaaatatgcaggaaaccccctatgcattgtgattaaatcgtctcgtatcaattccctaaataaattgactagtaaacagatcctgaaatcagtgcatgacacgttcgtaggaggctgccaatattcttattcccgctgaatgcatatgtgatatcaattttttaatggatgtgttagaccattggaaattaacagatactagaccattgtatggcataagaattcaccaatttgttggcatgcatgttttgccatagtggcttctacttttacttttaatttcagagacactacaggctttcataaatcaacatttcttaatgatgttccacatctcaaaatcacatagaaaacgatcttacattaactgataacatccatgagcagtcaacactaagttccactaaccaaaagccataaatttcaaaaggggaataaatccaattgttgaattgtgcaccttttattttgcattttgcaacattgaaaaaacaagatagaaagcacccatataacttctatttttttttcttctggctaggtggtctagatgatctggccgttgttgatcttgtgttgcttctcttcatccttgctctgcccacgtgtgtacatgttgtcgctcttggctgtggtagtgtatttctattagcttcaatgaagactgaatccggtaaagggcctagctggttaatggaggattgagttgatgttgcctaacaagcaaattagtatgaaacatgagtaggtagcagatagtgacagtgaaaaatgttaaaccatgcatgcaactaacctgttctaataaagtagtcaacactgaagtgctatgttggccctcttgtactaattcttctggaacaattggaaacgtttgacataaaagattaagaaatgcttgccgaaggtgacagtacataaaggatatagttaactatacctcattcatgtaaacatctttgtcatcttgcattacttgtacactcctcttcctttttggtctcatctttttagttgtaccaagtaattcacaattattcctattgtgtccagccccatcacaataactacaatgaataaccacgccatgcttggacaattttgtaccaccctccaattcaatggattgcttcctcctagttttctttggtctccctactttcttttcatatttaggaggttggacatttacaccattcattttttcccatttagattgatcccttgaaggcactatgttatatttgtatgcagcacgaaatgactctaatgagtagcatggagataccatgtcctcagttgtatcctttcattcctaaagcatgatatggcatgactacatggtattcctgtgagttgccagcgtctgcaatcacaacacttcacattgatataactatgaactggtgatctctgtcggtgacttggaaaatacccttcccagcaggcagtgtgtagcatgtattggctaactcggcagtcttctctagtttctgttttatctttgggcatatatttccactccatttctcctcaacctccttttgcttcatgtacactctagtcatgatttaggtctttattttctcaatcatgctcaatattggcagttcccttgcatgaagaatgtacctacagattgaaagaggaaatgttaatactattgataatgctaattggaaagcacacatgtacaattaggaaaaatatatctcacttattgaaaacttcacaactattattcaacaatatatcacacttcggaaaatcactaaagaatgctctacaccacgtatttggtgggattttgaaacaacccacagtttagttaaatcataaatctgtagttatgcacataattatagttttaaaaggaaccaagcagtgcacatgtaggcactcaacttagtttcccatgcattaaatcagaatcccatatatattggttagcaaccccaaagcatttcaatacatgtctagaagtacattcgattaaataattaaaaatgtagatggtctgaatacataagcatataagaggttcatactagctacaaattagctgtcacacccataaactgcaactttcatctgctaactcagagaggtatcaatgccatcaaggata

SEQ ID NO: 67317 - DNA, 701 bp, Oryza sativa
ttttccccatattaccccacccacattccctagtaaattaaacttaaaccaatctatcaccagtgtgtagttttccctagcaccttagttcagtttttaataggaaagaaggaggagcagcagcagcagataaaatggaggagtaaggaataggagcacttacctaggggatggttgcacggtgatgtcgagctctatggggcactggtcagggcatctgggcttagagctccatgcgtgactccattctagccatgggagtccacttctttgagctgtgggttggagagctcaaggaggaggattaggagggcaggtcttgttggtagcctgggcattgaggttgccgagagcaacatggtggcagcagcaacagtactagagtggggatttgagggagaagatagccactgctagcagcaaatggaggaaggaagaaggggattagctagctgatgcttttacctgtacaagtcataagaggggagagaaggggagaggtctgtacagatgagaacagaggagaaaaggaaaggtggactaattgctagatgcacattagtaggctacacagaacaccaacttgagcatagggacccaataatctgcagtccaagtatactttagataaattatctagcacatcgcaattggagtttcggtataataaaaaggttacaaatttgtaagcacatttgtaa

SEQ ID NO: 67318 - DNA, 1582 bp, Oryza sativa
tcatcttctcttccattgttttaccttttatcttttccaatgcagtataaatgaagggcatcaaagtggtttgagttgttttcttaattattgtgcagaagtctaaaaccatttatgcagcacagatagctattaactgtgtaatataatatctaacatcatggctattcgtattgcaataataatgaacggtaataaggatgaacacaaaatcaagtgactgcaacaaaagcaacagaggaaaaaaactgagagaggtaatacttgatcatatgcaaatcatcctcttttcctttgaatccagcatgaggaaaattgaagataattcgatcaaaccgtctcagcttcaggttggtgtgatccttcatcctttttgcatcgatgccatgcaaaacagtggcccccatccttttcagctccattatatttgattctgctttgctgtatttgcccctcaggtcctctgttcacaagtaatgcacaaatattagcatattgcagagaaaatggataaacacagctaacaattatctataatctatcaattgcccttctttctctaatttagaaggagttccactatcaacacaatgtaattaacttgattcgttagaagagtttctattgagtctctgcacctatccttttcctttggattctaattcaagaaccgcttgttttcttaaaacacggatttggctcaggattgccccttttaatccagggtttctctgaatttggaagttactacttaccaacagtattataggtttgaggttgtaagatatacaggggaagttcgatgcatgtggaggtctcaagtaagaattagaaatgaaacaaataggaaacatggagactattgagagttaaaaaaaaatctatagaaaccgacaaacagccatcgttacatggagacatggagttaaatcagggtaactttgtgagttagttttttattgttgtgtgttaaagctctaactgtgaattctgtcctttctcttctaaggaaatccttttcagatcctaaattctttactggctgtactgactcttgagtcaaccatatcataacaaatttgctaaatattgtaagaacatattgccacgttgagcttcaaaaagcaaactataagaaagcaaagaggcgaggccatgccaaactgatgatcatcaaaccatctcgcccaaaatcattgtcaaaagacaacactgggtacccaacctagtctaggccaattgaactgtactaccaacaaggtccataaataggttgagcttagcaaattagcaaatttacattgttcaggccgacaggtcctatcaatgcaaaatgcagaaaaaaatgctaaaggtggcagtaatgcttactcagcatgcatgttccttccatgacatactacatgttagtagtgagaaacaatatgccacaaatagtctctccgtatcaaaataaatccttcacaggatttagctatagcattcccaatcccagcattcatgtattggaacaattatttattttcaatatatgcaggagaatagtgttccataaagagatcacatataaatcattaacgat

SEQ ID NO: 67319 - DNA, 1802 bp, Oryza sativa
cactcaaaatgaacccttttttttaatataacaccttgatcttaacagggtaaaatgcaccagatctatttaccaaattatcctagaatctacaaaaattggcacatggattcatgcatgcacccccattgtttgttccatttatggattcccatatccaaggcgagaagaaccctaccaaaatgctaattgcgcccataaaatctgcaccattattgacgagaagcagagaggaagaacagagagggtcgaaccaatgtgtccagcgaggtggcgacgaggttgtcgccggagccgaacgcggtggcgagcgccagcgagaaggagaagtccccgtccccgacggtgagtatgctctggagggaggagtagtgcttcagccacttcaccccctcgtcgtcctcctcccgctccgccgcggcgatcgcgttaaccccctccgccacggccgccgcctcgtcggccaccggaatcgcttgaagcgcctcgcccttgacatccgcagccgcggccaccgtgttcccccccgctgctggtgcatgcgccgcctcgttctcgcccgctaccgccgccgccgccaccgtgtccccctccgccgctgcatgcgccgcccccttcgcggcgaccaccatgtccccctccgctgcaggcgcctcccccttcgccgcggccaccgtgtccccctccgctgcaggcgccgccgcattctcgtccaccatcgcggcgaccgtgcccccctccgctgcatgcgccggcacctcctcctccccgcaccaattcgcccccggcgccgccgcattcgcctccctcccgtcgccgtcggccacgatcgcccgcaccaccacctccacctccacctccacctcctccagcggcggcttctcctcaccctctgtcaccaccgccgcagccgccgctggcgagagcagcgcgaccgccgccatgcgcgcgtgcgtgtgacacgatcggcgtagtggagtggagttggagtgggctcgagtacaaacagtttccgcgcgtgaggatgaggaggaggaggaggacgcggcggcggaggcgaaaggatgcttttgacctcccggaggaaaaaactcgcgggattcccgaggaaggggtgggtcccacatgcagtgacacgagggcatgcactagtggtagtatgagcatctacgtttatactgtgcttttattaaaaaaatatattttatttataaattattatttgtttgtaaatatgacgtaatttacagataaatagcaatttataaataaaacttatatttaaaaaaaacacagcacaaacgcaagcgctcacaacatgtgcacacttacaccctatagatgtctcgttgtcgatgagtacgtcgtctatcactgaaagaataattagccgtaaatacgagcacactcataccctgtccttatggccgtcgcctgccactaaaaaaataattagccgtaaatacgagcaccctcacaccctgtctttatgggcatcttgttgttgacgggtacgtcgcctataactgaaagaataattaaccgtaaatgcaagcactcatgatctaggattttaaccgggggtaggctgattccaccacaagaaacctaatcagttgatctacgctcacttcgctccaaatttaaaagcaaaaaagcaaaatcagttgggtggactggattttatatacatgttcttagcgatctatgagcaaagactaaaaaataaacttcgatgaaaaaacctcaaaatcaactctaaatttaaggttaaaaatttaaattttagctgataagtataa

SEQ ID NO: 67320 - DNA, 1055 bp, Oryza sativa
ttttcttcctagcttttcatgctcatcctctcactatcaaccagtatccctcagccttattattcttttctagtaggagtactaatctttggcatgaggtagccgtgcccgtttatagcagtttaccgtggacatgcttcacaagctagtaaaccgtatatttttcaaagaagttttatataaaaatttcttagaatacttctccaaatctatttctattttttttaaaaaaaatatttatccatttatatccctaaataattaccataaaatcagaataatctaccatccatcctccacaatctattgcgaaccgggagctagtagcagagctagaagtcatgagctcatgatgcaacggggcataccctgctgggtgttgagtactccagtacagtattcgccgtgccgtcaaatttgtaggccctatacaaggctctaagcgagacctaaatcaagtaccaaatatagttaaaataatatatatactgcagagtaaatgcgatatattaagaatagtatattttttaactcttgttttgcataatcagaaactgccaagctagaaacggagaatgtttgttgtttttgttggcttgctgcatagtgcattgcttgttttatgccagcaagcaatattttattttatgccagcaagcaatattttatgcgacagcaagaatgtcaagtagtagtagaaaccagtgtttcagtagaaccagccctcagattgggcttacaagtaaagccaagataaccagggttttttcagtcccaaacggcacctgcattacaaaaaggaacttggctgttgtggtcagtcagagttttgagacacaaaacgatcctacctgtacattttcgacatcatccatctaacacagcacctcttgaaatgaaatgccaagttcttctatcctagagaaatgctgatccttttagcacttagcaggtcaaattctcaaaaagatacacaccaagtcaccaaccaactatcattgatcaccaccgtgtagcgtgcaacgtaatcatagtttgcagccacttctccttct

SEQ ID NO: 67321 - DNA, 6427 bp, Oryza sativa
attcctgcagcccttctaggccatgacatacaatttgctgtgtgtttgtgtgcgcgctttcaagcttctactcgtgcttcacatcgtcaagcggtcaagcgaataatgaggtatttgaatcatacacttgagtttgtaatttggtattctacttcatcttctatatgcttaagtggatattcagatgctgattttggaggttgtagaattgataggaaaagtactagtggaacatgtcattttcttggtacatcattgattgcatggtcttctaggaaacaatctagtgttgctcaatcaactgctgaatctgaatatgttgctgctgctagttgttgttcacagattctttggcttttatctactttgaaagattatggtcttacttttgaaaaagtacctctcttttgtgataatactagtgctatcaatattgctaagaatcctgttcaacactcacgcacaaagcacattgatattcgttttcactttttgagggatcatgttgagaaaggagatgttgagttgcagtttttggacaccaagttgcaaattgctgatattttcactaaacctttggattctaatctctttgcttttcttcgtggtgaattgggcataattcatccttttggcatggtttgagggggagtttgcacctcatggttttatcaagcaataatatgacaatgaaaaaaattgagaaaagagagctttgtttatgtatatggtattttcttgtgcatgctagcaatactttgaaggtttatttgtctctagcatagcttgtatgtattctagtcttttcatgagatttagattttgcttttaagggagatgatgcatgacacttaaattctatacttgaattaagaaaatatgcaatgttgatgctagcatatggtttgatttataaatgctctatatatatgctttattgacttgttattcctcaaatacctttaattgctcattgtgaaaaagagaataaaaaatataaaaaaatgaataccgaattcttgaaaatagtcttgacgacaaggacgtattcgatgtgagcaaaataatgggtgccgaatccctggaaacagtcttgacgatagggacgtacccggaataaaagagaaaaatatgagcaaaaaggctcaagataagaaaaagtacaaaaaattctcttggttattttgtgctaaaggttatttgagaaagagtgataaatgcaataggtctatgtgtttagtgtttattcttcaacctatgtgcttgttaagatgttgcattataaatcgtatgaaatcatgaattttgattcttgattcaagcttcattgtaaaatctttggttcatggttatactttaatgcatgcttgttttgttatagatgggtttattttctttttattgcaacgcatgacttgatatgctatatgtatgctcagctcttgaacattaatgaacataattcctatgcttgatgaaatcattgtcaaaagggggagaagtaatgtgaaaatttttggatttttggagaagcaaggtgaatttttgaagagttgttgaaaagagcatgttgttggttcaattgggaatttctttcttttaaaaagggggagaagttttcttttggattttgaccacgatgtgtacatttgttttcttttggatttttgagcatgatgtgtacatttgtacgaagtgtgctttttaccaccaaataccaaaagatttttatggatttgccaatgtgtccatcaaggggagattgtaaaatcaaaggtgtttttgattattattctgtgatgaacgattgggcattggagattattggttttgttatttgaaatttattcacgaagtggttttggagatgattggatttcacaggtgaatttacaggatactgctgtgattttatgtggacatgttataccgggctctggtagccggtcagaccggcgtgtaatgcgcggtcagaccggcgcagcccacggtctgaccggccgacactgtgtcaatttcggtttcgggttgtttatttggatatccgagtttattccatgattatgacttctagatggatactatacatatgtaataatattgtttgctgctaatgagtcaagttggagatagcttggtctcggaatatggtttctttgtttgttccatgtgtaggtgactcgatgtctcgggagagtatttgcggtgatggaccgggagtcggcttggggataagacgacgtccgtggtggtcagagatcatgcggaatacttaggctagagttgatgcacgtggtaaatggagattccatatggcatacgatggaggaattgtgtgcgtatgggatgcggagtcgaatttggaaggagtccaaatttggtacgtttgattatctaaagtttctttcttgtactagtgggcttcctaaggtgtttaggactcctagtatgagtttagttcgtggctttaggctgcctacctcatgtataaatagagggggagcgtgaggcttcccggtatcgctatagagagcaattgagttgagttttgagttagggtttcgagtttagttgaaatttttgtaaggagtgctgttggtgcactttgtaaacacagagagaagaaataaagtcgtcatccactttaagagttctttgatttgtgtttcaccaggtttcggcggtctaaccggcggcgcaccggcggtcagaccggcggcatcgcggcggtcagaccggtgggcacacggcggtcagaccggcggctacaggagttggcaacaggcgttttcggcggttcgactgatcgatctacatcggtcagaccgacgttcatcaggtggtcagaccggcacaactactacggtcagactgcgatccatcgatttcgagggtaacttttatttccgctaaaagtttttggtttttgggtataccaaccattcaccccccctctgattggcttagttcttgtgattcgatcctaaaagtggtaaggccctttacgatcctacaattggtatcagagccaggctaggttaacatctctggcccgatggacacgtgtgaaggcctgatggacagtgggtgcctgcggggcccgtatacctgatggaccgtgggtcggtgggggcccggatcatattaatggtcgctgttcaagttttctcttatcattataaagaaactcgatcctgatcaaatccatggaaagcatggatgtagatatttaataccaaatgatccatctaattttgggcctatctgggcgttgtattcgaccattaatattttcattgatattgcatctctcttaagacatcaatcagtgagagaataactaagtgcttattattgttcagacaaatccttgttattgaatctatgcatatcgttatctattaaactactaaatgatcttccctgttgtgatttccaaacctgtgtgcagtctactggtttcgatcattatttgccgtgattattctatttctctcttgggacgttggtttaaattaaggaactcaaccctgagccgttccgtggaaaagtttgcatatgcaaggtattaaattactaagtgatctttctaattttgaatcaatgtgcaacctactgttttcgattattacttgtcaatgatattgattttattcacaaacctgcctttgttttctatcattatttgtcattcagtcattgacattcagtttttattttaagacgtcaatgagagaggaacttaatcctgatctatcccatgagtagtttaggtgattgggactcaaaacattatgggagggtccacacccacatgcctagcctatttgaacgcaggacaacttttagatctacacgacacagaaagtcttgacatacagaggctcttctctagctttgatgtcttacactagaaatggttccatgccaactgcaattagcaaccactgtacatacttcttctgattgaaggaatgccataaactccatggagatcattggcatcaagtgctgtggtgttgtcctgactcccttgataagcctcgcaaaacagcatgctgcctatttcttcaaagcccagaagttcgtgcgtgctctcaaaactgccaccgagcgtttaagggagagggttagcgatgttgagaccaaggtggagggtgctgcacgaaaaggtatgcagccaaggcatgaagttgaacgatggctgaagcgtgctgagcatgtatgtgtggagactgagacaatccaagcaaagtatgataagaggaccaagtgcatggggagtctgtccccttgtatctgtgtaaactacatgatagccaagagtgcagcagcaaattgtcaggctgtagagaagatatacagtgagggcatatttgaagaatatggtgtcatggtgccacaggcctgcactgaagtgcccataactgacataagcctaactggtacagatcggtatcgcaacctcgctgtcaagttcatcaaggatgaggctgtaagcaaggttgggttgtggggccctggaggtgtgggaaagacacatctgctctatcagatcaataacttgtttcacaaaaaccctgcttttgatgttgttattcgagttactgcttccaaaggttgctctgttgcaaaggtatgttgtgctccctttaacgagggagtgatcaaagtttgtatttaactaattagatgaaactaatcgttgtcccttgatgtacatgtttctgtatcttgctaaagtatatttgttgcaaagatgaatgcatccagcttgcccaaaagacaaaaattacaaaccatctagggtaagcggcctaatgagcaattcacagagactaaaagctccagctaaaattatagtttgttttataggagctacgatttctaggatactatattgactgtcatcaggtactactatcatgtaatatactccctccggatggaaatatttgttgtttcggaccagcgaaatgacttacacataacatattttggctgtcggaaacagcatataaaactgatcggagggagtaataactagcgttacataagggttcctggcagccaactaacattttgatatttcaaaaaactgcatatacttctaattttaaatactttacaacattatttagttaagctctctgccagtttgctccaaatgacaaaagtacttttttacttgttgcccttgaaggttcaagactcaattgttggggaacagatgctgcagaagaagaatgacacagaatctcaggcagttatcatatatgaatttctcaaaagtaaaaattttcttatattattggatgatttgtgggaacatgttgatcttgataaggttgggattccaaacaaagttagctcaattggcaattacaaacaaaaattgttgctaacaacacgctctgaaagtgtttgtggccaaatgggtgtcaagaatgggcaaaggattaaagtagattgcctggatgaaacagatgcatggcatcttttcaaggaaaatgttggtactgaaattattaaaaatcacccccttgtacttccactggcaaaagaggttgcaaatgaacttgccggactgccgttagctcttattgtagttggcagggccatgtctaccaagaggcatccacgagaatggcagaattgcatcgactttcttcagcaatcacggcttaatgagattgaagggccagtttgcaacgaagaaagtgtgtttgctcgactgaaactcagttatgaatatctaagtgatactaatctgaaagattgtttcacatcatgcgccttatggcctgatgattatctgttagatagaaacaaactatctgagtactggatgggactgggtctagtagaggaggaggatattcaaagatgttacaaggcaggatatgcacgaattcgtgagttggtagacaagtgccttctggaggaaactgatgatgacagactagttaaaatgcatgatgtgatacgtgacatggcactatggattgtaagcaacgaaggaagggacaagaataagtgggttgtacaaacagtatctcactggcatgctgcagaacaaatattatcagtggggactgaaatagcagagctgcctgctatttctggggagcagaccaagcttaccgtgctgatacttcaggataatcatttaagtcaaagttcagtaactggcttgtgttcttttatctcccttcaataccttgatctttcacggaactggctcaaaacatttcctactgaagtttgcaaccttatgaacttgtactatctgaatttatcggataacaaaatcaagtacttacctgaagagctcggatccctttttaagctggagtacttgcttcttaggtcaaatcctatcagagaaatgcctgaaactattctttcaaagctctccagactgcag

SEQ ID NO: 67322 - DNA, 7059 bp, Oryza sativa
agaaattctttttaaacccggttagggttaagaaccgggactaaagattatagcactgcatatgattttcgcttacatatgtgtttataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatacaatagtcaattataattagcatatgaatgctagtaaattaaatgttaaaaactctaattaacgtacatatgaaattgccacctgtgtgatttaaaacttttaaaaattgtaagtatcacatataactagcatatacatgatttgaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtaaggagctaccaatgaagagtgttgcagaacagtgaaatgggctttacggaataaattgttgtctaccgtcataattgctttccttccgagagttccctttccccgtagtctcccttcatggcgtgattccggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgtgtcattatattgaaaaatgaaggtggaaatatcaactcaaaactgacgagacattgcaccacttcattctgaagggcatctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccagggccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcctcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgttaagtaataaactaattttaatgtgttttacttcttttaattttcattttagtttgttttctattatttaagattaactttcactagagttttccttctcaactattttataaaaccttatttagcaaatgaactaaatttctatatattctttcttccccacacacattttctctctcatcaacttacaactacattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtattaccaaccgggactaaagttaacatctttagtcccggttggtgttatcaaccgggactaaagataccgggagggcctgacagaccctgacagcattcgaaccgggactaaagatcatctttagtcccggttggtaacacaacccgggactaaagatcaaatatgcccgttacccttttgaaccgggactaaagaacatctttagccccggtttttattgcatccgggactactgtggaaatcggccgaccgacgaaagatggtttctccaccagtgtcatgcttaaagaacatttgatgatgaatcgagtcacaataaaataaatgttaattgtataaattttttgaataagacgaatggtcaaacgttggataaaaagtcaaccgcgtcatacattaaaatatggaggtagtagcatgtacattacataggtgaactgatgagccataaatattaatttcagcaattccagacaattgcaaaaataaaagccaattctaggcaacttcacaaataaaaacatatagcttggttacttacatctaatcctatatatgcaggtggaaaaataaagtgagcacaaaccttagcatattccatgtgtgattttgtaataaatgcttgcatgaaactataccaactctatggaatgaatccaggaagcaaaaagtgcagagaagcgtagttggaagttcatgaaacatttttgtctgatatatatatggaggcaattgcaggttgttggttaaaaagaaaaagaaatcgaataacacaccaaagaaatcttgcaaagttattttacgttagtatagtgaattatttggattgatcagagatggtaaagaaagaagcacttggggacttggagagatatatatgtatagagagactgggaaaagaggctagatatattgccgcgctgttcttaaatcacatggcagctcggtaggtgaggctctattcggtgccaagggtggatttagagtgtaacaagtgagggccttggcccccacttaaatttgcagtgagtggggacaaatatcccttgacactttttacttccttaattagtctacctgagcggtagatccttggcccctactcatgctactttctgactccgcccctgttcggtgcctgcttgcatggatcgaccttgtcagatgtagatggagacagtggtcgcatcgttcactacctgtgattatggatgagatgatcttcacaaaatatgggaaaattcctaatggagtattgacgaagatcgatgccgctcacctgcaagcgaggcaaataatttctgccgccggtgccttttgtgctcgttggaacggacgcaaatggacgctacggcctaggagaaaggtgagagtagaaattacggagtacgtcgataggtgatggctgggcttctattctatatatgagagctgcactgttcttgggcttgatctgtcagtgttcagaacttcagatagcttagaaaaccagatcgctgttggatggaggtgtcaattaatcgaattttgtttgatgacgcggcttcacctggaactgtgcacaaggtatgcacgtcgccgtcctcgtacgttgccccctccggtggataagaaacaacagcaaaccgcagacacagtacacggatatagcgtgaaaggcaccgaagaaagaagaaggctgcaaagatcagtacagaacccactacgatacccataatgcaaacgaacacaatccatgcaggccgctgaagaagtccgaatggtaaaagcgactcatatcctgcaacaatgatttttaaagtatatattaaattttattttgcacaactgttgagcagaaacgaagtagaactgatgataataataaatgagtaaattttgaaataataataaattagtgaattttagaaaactcatatattttgcggccagtgtaacacgtaaccacagctccttacttattttatcacataactgctgtttttttcttctggtcgaacagggcatggcggcggttcatcggcgccggtggcggagcaggccatggaatggagagagaggccagttccggcagcacagtggcgtgcggcgactccggtagtaatcttgcgtggcggcgggctcgggcaagggatgcgcgaggcagcgctgccaaaccagggatgcggcggcggtggggggggggggggggggg

SEQ ID NO: 67323 - DNA, 65991 bp, Oryza sativa
gtcgccacgccgtcgccacgccgccgctgtctccacggcgccaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaacgttaacgtgaaatgcaatatatatatatatatatatgtatatatatatatatgtatatatatatatatatgtatatatatatatatgtatatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagccctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaagtggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaagtttgtgtagggttctaatgtacgacatttacacttagcatacatgacttagattgttaaaacataaatgtgtcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgacaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggattagggatacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgttcgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatctatatacatatgcattaatttgcataacatatatatgtgtataaatacatatatattatgcatgtatatacatataatataatataatatatatatatatatacatatatatatatatgtatgcatatatatgtattgaaacatatatatgcatggtttatatatatatatatatataaactatatatatatataaaccatgcagcaacagggccatgcaaaaaaaaaaatggtcagctcgatctttagtcccggattggtactcccggtttggaaaccgggactaaaggggggttacgaaccgggactacaaagggtttctccaccagtgtgatataaatactttcatatttgcacgaaaattttaaataaaacgaatggtcaaacgttggtcgaaaagtcaacggcgtcatacattaaaatacggagggagtattttgcaatactttggtcttggtcttttgaactggtgtatgctatccggctaatctcatagactgtttatatacttagatggaaccgtaagtctcatggcgttactaaatattgttactgttgttttttattgttaaattgacgtccaaagattcaatgatcggacgttttaatatactgaacaatgattgcaaaaatatattcatttgttgactatttcttatgccttaaccattatcaaatataagatatgatctctaacgtactatatatatgcgcaagtatgttttgtggttctaaaatgacaaaatgacctgctatgcaacgcgcggggcaatgaactagttttacagaagttcatccccagagaggatcccagttctagaagggtttacatgagtcacaaaatgggtgcaattgttctctgaaaagaaagctaaaagaggcaattatgttcaaattaaatttagggaatgagtggtatgacaaaatccgtttataaatcctgtttctcaactatactacattaatcagcaccaagaatggaggatagtgggttttagagttaagaaggaatctaaattaaagtgaccagagagatttagttgagtcgacagataagctgaggaatgtcttattaatagatgaaccagatcagctaatttgtccacattagaagaaggggcttataaaacaaacactataaatgtacaaatcgctaaagtttcgatgggtgagagacgggcgtgatggaggtctagaagagtaaaattcctccaaaaataaacactttatatacatggctgggagagagaggctggccaagtgatgttcagctagtaaaaagaaaatgaaaaagaattttgtaaaatgtgttaggaaaaagagtctactaatcatgttctcctcaaatgtcccattgctacatttgtgtggtgtatcatcagagatgctttagaactatcatgtttatctgaacgttttgaatattttaaatttcatttgcaatagtttttttttttttttgggggggggggggggcttgtgtttgttggggttctgtggttgacaagaaataattgggtctttgaaaatgtcttgattaaatctccaatgtaggtggtctactagtagtatctttttgttttagatctcgtgtgctacccttgtaaacctaagtttagaagacttaaagcaaagggattttgctttcaagcatccctgaaatagcttatggtcttctttcattccttcagtagcccttttctcttttttagcctttgtaataactttaacttttatttgtcctctattttactcgttgtaatataaacggcagttctcctgccgtctaccagttaaaaaaaaaggaaagttgaaagatacatatccaacataattaattctaggaaattgttttgatttttctcaatctgacatttattatttccagtgtatgcatatctagaacaataaattgccacctacctttatagatgtataaactcttactgagagaacaacctctgcccatctatataaagccgtgttcattgtaggaaataaaagcacacaaaaaccttttatctagaaaaaaaatttccgcaacttatttgagtagttcttatcttactcatagaggagtgagaaattctagttgtagaatgagtcaagtaatgcgtgttttactactactgtgtcttctgatcatttgttcggagcaagcaagtttgatatcatcatgggaatatgatcaagatcctagggagttacacatggggaatcgtttatcctctgcaagcagctcgctactcaaaaaggatttagtgaagcctcccggtcaagaaacatcctatgtgagttaaaactactccgcgtagaattttcattggggcattagatatcttcatattttgttgcaatccttgattttctccttgattgcccccaaagatctaaaaattgctaatggactagtttttccttccttcttcagttaagtgttttgacccctctagaataatatcgcttaattttgtccctacttccttgctcgtggaattcccatactcctttcatgttctcacatgcccattccgtgaccgttgcggagtggaaagatcaatgagtaggacatcaacatggctgcggtaggactaacccatactttggatatggaaagaaaatatagtatatagaaaaaggggcaatttcgtttctacccctactttgatgtctaatattgattttacccctattttttattgttttcgtttttacccttacttttttgaactgaatgcttgttttgcctctactttggatggtgaagttaacggtgttaagtaattgataaaatgacgtttataccctctcatgtatgttcattaattgtgtttttgtccccattttatacatgtagctttggaactttatttttgggagtatatttaaaattagatgacgcacattgactaatataacaatttggacaaattctgaatttgatggaattttgataaaatttcagcattttgatagaacttaaacaaaattttgacaacattttgtaaaatgtaattatctgttcctttagatattagtcaatgtgcttcatgtaattttaaatatactcacaaaaataaagttctaaagctacatgcataaaatggggacaaaaacacaattaatgagcatatatgagagggtataaatgtcattttgtcaattacttaataccgttaacttcaccatccaaagtaggggcaaaacaagcgttcagtttaaaaaagtgagggtaaaaacgaaaaccctaaaaagtaggggtaaaatcaatattagacatcagagtaggggcagaaacgaaattgtcccatagaaaaaagggtggaggggcaaaagggtaattacagagagataaaggaatagaatgaatgaaaagggtgaaaacagcaaaatattgttttccaaagagggtagaacctagtaatgatctgataatgcgaggaaatcttaatattacaaaaactatgttaatattttataaagatagttacatacttcaaatgaaatttataagatttgtttctttacttgttagacataattgttttttgggaaattagacatgatttttaatggtatcagccttaattgctgcaactgcaaatccctaatacatatttacctcaatgagatgttgggtatatgattttggtcaatcccctatcaatatcttctatggatagatatttgtatatatacatttttttgcaaaaaaaaaggctgtttgcaatgatcttataaaaacatggtagtataattttgtagagtcaaatattttattacatttcttactgtagatcttaaagcatatttacttggcatctgtcgcaatgcgttggcacatttcccagaaagatataaattgtctcagattgttatttatgtgtgagtttttccacagcaagctcaatgttattcgaacacatcaccctcagatgagcttcttggtgccatggcaacatttgatgtatatgggttcccaaatttgaacaaggaccaagtaagctcagcagatttagcggtactaaatgagcaacgccatgatcttactgacggaaatgctttatttgccggatggatggtatgttagttttctcaacattttcacaagtataacatatttataagtataaataccatttatgtgattgttttatttcatatgtaggtcaacccggtcatctcttcatggtgacagcaaaacacatttttatacagcgtggacggtatgtagtttgttgcctcttcgtattatttaattaccgcatgcttatactatcgtgtataacttaggatcttttgtttatttttttacatatataggttgataatggtgtctcgacaggatgctataatctggaccgtgatggttttgtacctgtaaacaattcccctataactcctggagatattttagagccaactaatggcactctgagtatcacaatcaagatatttaaggtttgtagttgaatgtattgatgcttttttgtcttaatctttttttgaaacatcataaatctaaaagcgaattagtggatactgaattgggtgtcaaattaataaggtgtatgaaatgtaaatacatggtttagtgacactaggttttcattttgttcacagtgtttattagtttacattttttttatatcaactgacatcattggtggatatttcaattaactttatttgcttttattgacatgcagaaaaaagatgatggtgactggtggttgtactttggacatgataataacaatcttagccctgtaggattttggttgagcagtgttttaaccaatttggctgaccatgcaaacgtcatagcatggggtggctacacctacacacaatctactactccctccttccctaaatgtttgacaccgttgacttttttaaacatgttcgaccattcgttttattcaaaaacttttatgaaatattgttgacagaaaacacgaggcctgaaagatctgcttaactccagtgcaggtccaaagctcgccttagaatgtatgagcgtgtcagttgatttgatcctataatcaacaagaaatagaagcaaagaaaccgcggttaaatctataaatgatagtcgatcggctagaggccgatgacatatcatttatctttgagccgatgtcatatatgtatcgatcggcagtcatgaataaataagaaggaactaaatctactcgatcggctatagatattaacaatatatactccttatatcgatatatacttaaatcaagtgattgggatagatcaaaatatatattaataatgggactatatatgttcatagcatagccgatcatatagatctagcatgtatcggctaatacttcgataccactctatactaagatgttaaagcaggtagaatatattaaacaaaggcctaatatacttaaatgcaataagatcttaaaataaagggtagatttaacatgtcaataaagtatatagggtaaatatagttaaatcagataagatcggctgaaactctgatgctaccctaatcggcaaccagaaggcaggctagagattgattttctaagcacgacttaatagatcaaactcaactgatacaacattaagtatgaaaagaacaacaatatctagacaatcaagctgctggaagcttcatagagtggtagatatcttatataatctaaatcaacatcgaaatctaacctaattggctgccctctaccgacagatgttagccgattgtagattagatagcggcattgccggagattatgtaagatatatgatagctcgacgaattacataaacgagatcagagtatcataaagatggaagcactaatcccgagaacacaagttgtcataacaagttttacctcttgttgaagatcgaaaccgatgcagctcaacccgaaagtaagaactcgtcgaaataaaactaaagcaaaaagggtggcgatgcgccgaaattgtattgaacgtgtgtgttcaaagttacatagggctcgggtctatttatacccgagaattacaagatatgtccataacggacacgactaatatctctaacaaactctaagataccataagtctttatggcagacttttgcccaagcgtatctctaaagaaattacataaaacatcctaattaatagataaaattgccttcttaggactctatccatgtgcggcaatcaccttgaggtgcctcaactcaacccgatatcatacatcaagtcgcattgccggaatcggctgcatcggcttacctagtccgactcagacccagccgatcctaatcgtagccgatatggactccagccgattcctgctctgtttccgaacccgatctccgcctccgacttcgtttcgatctaatcttctttctcgatgctgatattaccaaatttggttgttaacacatgccccccaagtccggaatatttggtaatgtttcggatttgctgtaaatcgaccccgagcaagtttcgcactttgccgttttccgaccgttactgccgtgctttaaatactaaccgtcaccctcgagaaatctcacaccgtgacttccgttttcaccgctcaagcgaaactttgttctctctctctccgacgattcctccgatgcaaaagcgactcccaggcgacttcatcttcggcgagatttccgcccgcagcgatgtcatcctccaccaacctatctgatgtgccatcagccgagtacgctgaggtaagtcctcgtcggctagatcccctttcttagcagcagatcgattttctcttatcttatatcgctctctttttctcggttgtttcggatttgcagcatctctccaacctagttgcgattccaagcctatcacacgaaaaccactattttcttggcccaatcggcaatctcgaccccactgatttcatcatcggtgaaaccaaccaaatcccctttagactagccaaccctaacctgggtcactggaagaataccttcaagtcttggccatctctcgaaaaacctactcctgataagagctggaccacctggtaccaacgcgtattggctagtaagaaagttcactgggatgagattggaatcggccaagcgcttgctctcaccatagccaattctgctaaggatgagcctctgatggctgccgccacctacttctggtccaacaccatcaatgctttcttattcaaccaagggccgatgactccaactttaatcgacatcaccatgattactggatttgatgtaacttcatcggctaaccctatgagtatgaacaccaagaaccaatttgacttcaagaccaaaagcataggtggctggtctggctatgtggcggcatatatgggccaagggtctgttactcctcgagagcatgtagctttcttgctcatgtggctggaaaagttcctcttctgtggatctagttgtggccatacaaccaactggcaatttgtagtcgaagcctgttggcagatggcatgaggcccttcgactaaatctgccgaaacccgtggcgaaggctatggagcaagaacggcatgaggcgaagagtcgtacgagtgccctgccaggccagaggcgtctcaggcgaagggtgtaaggcgaagactatctcaggcgaagggtgcaaggcgagggccgaggaagcctttccggcctatcaagcctaagggctacagggccggcgatcgccagacggcccatcaggggcccatgagcccctataacattatgtacccctgtaaatgtccctttcgtaaaggtaatcatgtaaattcccctgtacaacctaaaccctagtagtaagaacctgtaatggggctataaatagtcccctagggccatgtaatgagggggatcccaaaaaaagaaattcaaaattcaatacacttcgtttccttccaaccactgttgagttaccacgtccttcgacgtatgcagttgtcatttcgacaacagctggcgccgaccgtggggacctccgagcgaaaccactgagagcgaatgccaccgaagagggtcgtgaaggagaaggttgccaggtggaaggaaagcgacgccggactagacatggccgccgaggaaggagcagagccttcggcgcccactgccgaagatggaggaggacaagcgacatcacaactgccttcggcccctgcaacctccgtgcaagtgccgaacgcggccgacgtggcgaaggcggctgcggcggcaagggcactccagaccagggcggagatcctttcaacaatccaactggtggtgccccaagccgctccatcgcagccggcagcggccccaaccgcgcctgccgttgtgcaggcccaagtcagccctgaccccgaagcacaagccgaagccgacatggaaaccatgcggcagaacatgacacggctccaagacatgcttcgccaaatgcaagaacaacaacaagcatacgaggtggcaaggcggaccaaggccacgtcggctccaatccttcagtattcggcaggttatgtcccatctcaagtccatccgcatgtgacgacccagcccattccgccacaagccgcacaggcgccggtgtactttgccgggcagcaatcggccgcagcagtgcattcagcccctcacgtgcaactggaagctcaaccagtcgctgcccaagcacaccatcaaccacctggccaagcgccacaaacagtggcggaaggggcttcggctctgcaggcgcaactccaagctttccttcagcaactcaaccaacctcactgcatttcaagtacaaccccatcggcccacccggaggggaatacaagtcaaggtgtgcctaattggttgccaccgattcagccgggcctaggagtttttgtaacgccccgattttcgttcgggaataaaaatcaattaataatacatcttctagaaattaaataaaagttaaatcaatttaatcaagtgaaattatagaggaaattaaaatttcctttaaaaatcattggccgggaatattttgtaatattcttggtgccctaatgtactctccggaattttccgtgaattttcggagctcgagaaatagttttaaagtcacaaagatcatttaaccaattaaaataaaaagaaaacaaataaaatcctccctcctctctttgggcccctttcggcccaattccccccccttctctccctctcgggctggccttctcccacggcccgctcggctctctctctccctcaagtctgctttacctccctcgcccgttttccccactctctctccccgacaggtgggacccgaggccccacctgtcagctcctcctcctacctctggctggccggctgcaaccgccagggccgcccgagccaccccacgacgccgccgtttccgacctcctccaccccgcgcgcgagcccgccggtcgtgggaccccgtcgccccacgtcctccacccttttccccactctccccacgaaaatcgccgccggttaacctctccaccacccccaagatgccccgcctatctcgtcggccggttgccacctctctcgagcacgatcccatcgctccaagcccataaaaagcatccccggcctcccctttccatttcccccaattttcccgagcttctcgcgccctgtactgctctcccctcgctgctcccatcgccgccgctcaccggcgactctccatccgctcgccaccgctgctacagccgtcgccgtactgttccgccgccacctgcggcttcgccgtgccttgccgcacctcggccccgctccgttttccccattccatcgttggaaccccctccccaccgcgctccctctctccaccactcaacgacgagctccagccgccgctcctcgccgctgcagccaccaccgcgccgtgccgccgccaccgccggcatcgccccgtcgagctccaccctggtccctactccattttcccatttcgcctccggaacgccgccgccacacgcaccacctctctccctcaccatggccacctccagccgcgtcgcaacgccgcttcggtcctcgccgacccgcgtcgtcgccttcctcggctccgcagggacggggagatcctcggccactggccctcttcgccggaaatccacccgagctccacctccctcgtcgccggtgagctcctcctcgtattgtcgtggtcggcagtcgtttccatttacctcgcaccagttctcacctccataggaggctttgagccgtgaccgtgccccagccgcgcgccccgtggccgtccgatcggcttgggccaatccgggccgtcggttcccgtggaccggcggtggaccgcctcggtggtcccggtccacggtggaccggtgcccttgtgccactgaccggtggggcccgcttgccggcgccacccctcccctttgatgacgtcagcaaccctcttttcctttggaaaaataaataataattgcgtcataattcgttaataattctagaaattcatttaaatggctcaaaacttctaaaattcatatctaattcattcgaactccgaattgagccgttcaacttgcaaaattcatctaaaattgagatctacatgtttgtttagtttttatgtactgtttctttggtttttattagagtttttcctcgttttgcgtgccagcgtgtagaatccgtcgtttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgttctttgtcaaccttgggtaataaatcgcctagcttgtgttactttgatgacctagctagaactatatgcttaaccatgcttcattaccactagctcagttgatggggtaattacagttttagaccttttagtatcagtatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgactcaatacactgtagttcaggtgggttggttgggcctgttcaacgtggtgtagcgttgatcagtggagattcaatattactttaattactcaacagttttactgttttgctcaataaaatgttttacaactgcctttatgcaaatagccacaaacccctgcttgtatccccttgcacgtctgcatcgttggtgtggcttgctgagtacggtggttgtactcagtcttgctattattcccccttttcagaagtgtagtgcttctgagctgaagacgaagttagaagaccaaggctcagaccccagttgagttttgcctgtggaatggagctgaagccccgctaggatcgcctttttccgctgctgctgcttttgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacagttttgccatggaatcaaggactgcagttcgacttcgtcaacatgctcaggcaccaaccgttcggcagcaagctccaactccaggcttcggaacaaaccaagcaccaatccaagctgccacgacgtggtcgcagccaatttttgacccatccatggcgactcagcaagtacctccaattggagccagacagtcgaatgccatggcgcaacctcacgcacaagctgcgattttgcccttcgccacaccgtacccgcagcaaagtgcagtaaacagggcgggaggcgaaaaggggctaccgctgagtgggggaatcaggactcgtccaatcccaccgcagttcaagttcccacccgtcccgcgctattcaggcgaaactgacccgaaggagtttctctctatctacgagtcagcgatcgaagcggctcatggtgacgaaaataccaaagcgaaggtaatacatctcgctctagacggcatcgcccgtttttggtatttcaatttaccagccaatagcatttactcatgggagcaattgcgcgatgtttttgtccttaactttcgaggcacctatgaggagccgaagacgcagcaacacctcctcggcattcgccaaaggccgggggagtcgataagggagtacatgcgttgcttctcgcaagcccggtgccaagttcaagacataaccgaggcatcggttataaacgccgcttcggccggtctgctcgagggcgaactcacaagaaaaatcgccaacaaggagccacagacgctcgagcacctacttcgcatcattgacgggttcgcaaggggcgaggaggattccaagcgacgacaagctatacaagctgagtacgacaaagcctccgtcgccaccgctcaagctcaagcacaagttcaagttgccgaaccacctcccctctctgttcgccagtctcagtcggcgatccaaggacagccgccaaggcaaggccaggcccccataacttggagaaagttcagaacagaccgtgcgggcaaagctgtgatggcggtcgaagaagtgcaagccctccgcaaggagttcgatgcccagcaagcgagcaaccatcagcagccagcccacaagaaggtccgaaaagacctctgctgcgcctttcacggacgctcttcgcacaccacggagcaatgccgaaaaattaggcaacatggcaacgtgcaagacccaaggccgcagcagggaacaactgtcgaagcatcctgcgaagcaattcaggagcaaacacccccagccgaacaacgccaagatgtacagcgaagggtaatccaagtgattacaagggctgatccgccaagccagttgtccaaacggcagaagaagatgcagatccgtatggtccacagcatcactttggcgggtgaaggggcgccgcagtatcggaaccagctaatttcttttgggccggaagacgcagaaggagttatgttcccgcatcaagatcccctggtaatctcagctgagatagctggtttcgaagtccgatgaatcctggtcgacggagggagttcaaccgatgttatcttcgccgaagcatatgccaagatggggttgcctacccaagcccttaccccagcaccagcatcactccgtggtttcggcggagaagcagttcaagttctcggccaagcacttttgctgatagcctttggctcgggagagaacagacgcgaagagcaaatactgttcgacgtcgtcgacatcccgtacaactacaacgccatcttcggccgtgcaaccctgaacaagttcgaagccatttcccaccacaattatctcaagctcaagatgcccggcccgacaggggtgatagtagtcaaggggcttcagcctttggccgcttcaaaaggcgatctagccatgatcaacagagcagtgcacagtgttgagaccagaccgtatgaacggccgaagcacacgccaaagcccacccctcacggcaagataacaaaagtgcaaatttgtcacgccctgaagttcccctcccttgctctaaattcataaaataaatcgtccgaagaaattgtttaatttaacctagagatgaatccctaattaataaatgcaaataataatcggaatcgacatgtggaatttttcttggattctacatgtcaaaatatgctaacaggatttttagtggaattttcagagccttggaaataattttaatcaattaaaataagcaaagtgcaatattaaatccctggaaaaatcctttttcctttttatcttttcttttccctccttttttctttttcttgggcccggcccatttcctcccgcgccggcccgctcctccctcccactcccgaagtccacccggcctccctctccctctcgggcgctgacaggtggggcccacctgtcagccctttccctaacctccggccgcccacgcccgcgccaaccgccgtcgaaaccaccgcccacgccgccggtttccccgtttcccgcgcccactccgcccgtaccgcacgcccacgtcgccgcccaccttccccgcacctcccgccagctcgcgcgcccgcaaacggcgggggatttgaaatttcccccactctctctttcctcctccaccccctccactactccggcgaaattgcgccgttcccggccacgactcgccgccccccctcctatttaagcacgcccgcaccttcccctctctttttcctttctcggccgagccctcccgagctctccatcgctcccgcgcctctcatcccgccatccgccgctcgccgccaagctccggccgcactccgccaccgctagagccgtcgccgcaccgcgccgtcgacgccgccgggttcacaagcttgtgcgccaccccgtccgccgtttccccggtcaatcccgccgccggagcttgcttctcctcgcgcgccggtgagtacccccatggccgccgccttcgaccggcgaatccgctcgctgttaaccacccctctccctctaatccctcccatcttgttccctaggaggtctcggagctcgtccgcctatcatcgccgttccccggtcgctcgccgtcgccgttcgccgtcgtcttcccccccccccacgccggccaactcgcggtgaggcgcccctccccctcttttccccttcctctccctcctagcgccgtgccgggccgagccgccgcttcggctgtgtgccgccgcctgtgcgccgccgtcatccgccgccgcttcccgcgcctccggttgccgtcgccggcgaccgtgcgcgcgcgccgccgccctcgccataaccggccggccggcttgaagccgagctgagccaggccgccttcctcctttccccgtgagccgcgcccctcccgccttgtgccactgccagtggggcccacgtgccggcgcccctccctctctctcttgagccgctgactcatggggcccgcatgccggcgccgccccaccccttgctgacgtcagccctggggcaatattgcgcaataaattgattaaggcttttctttaatagtaaaaatacagagaatcttctaaaaatcataactaattcatccgagctccgattaagtccattcaagtctcagtaaattcataaaaatgtatagaatccattaaaaatggttttgtttcctgtttcagtagtcttatagcatgtcttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcattgttttacaatatcatgtgggatgggtcctattactcagctatatgttgtttcccttacgccattgataacttgggtattaaaatgactagatgttggtttaggagatgcttagccatgcttagttcaactagtgcacaaaaggggatcacattaaagcatagactttgattattggcaatagttttggattagtgccaccgcaatggtgttggttaattaaaatacacttcatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcatgatggagttgggtcggccggggtgtccggttgatcggcttccggattcaccgcggcacgaaaggggggctgcccgttgcctgctggggacgggggcgaaccctaaggtgtggtgcgatcggttagagagggttatgcgaagggtcctgtcacggcctctttctggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagtttagcttaatgaactggtgtagttcaggtggttggttgggcctgttgcaacgtggcgtagcgttggacagtgactggttaatattgcttaattactacaactgttttactgttttcaactactagttttaaatgcctgctttatgcaaatgaaccccgtagcctcctttggttatatcctgcatcatacctcctctaccggtatgacttgctgagtacagtgggtagtactcagtcttgctcttttcccccacaccagagttgaagttcttctcatttggagaggtcttgaagaggttggtttcgtcgctgccgtcaagggttgcctgtggaatggaatcgcccgctgcaggagtcaaggcttcaggcttagctcgctttaccttttccgctgcatttgtaatcttttatatttttgtaagacgtggatctgtatgtcaacaattgtcgtttgtgtaccctggctggtcctggacaggggtttaatacacattcagcttagaaattctggttcgtgaatttctaggcgtgacaaaattgatgacgccgaccccacaaagcccgtatcactggggggcgacataggcgaagaagaagttgagagtatactagaggtgcttaaaaagaacatcgatatcttcgcctggagccctgacgaggtggggggtgtcccggcggatctcatcatgcatcacctagcagtcaagccggacattaagccaagaaaacaaaagttgcgcaagatgtctgccgatcgccaagaagcggcgaaagccgaagtacaaaaattgctcagggcaggggttatccaagagattgaccatccggattggttggcgaatccagtgctggtgcggaagtcaaacggcaaatggcgcatgtgtgtcgatttcacagacctgaacaaagcatgtccaaaagacgacttccccttgccacgaatcgaccagctcatggattcaacagctggatgcgagctcatgagtttcctagatgcatattccggttaccaccagatccacatgaacccgctcgacatccccaaaacatccttcatcactctattcggcacattttgtcacctcagaatgcctttcggcttaaggaacgcaggagcaactttcgccaggttggtgtacaaggtccttggcaagcagttggggcagaatgtggaagcttacgtcgacgacatcgtcgtaaaaagctgcaaggctttcgaccatgcgatcgacctgcaggagacattcaacagcttgcgcatagcaggcataaggctgaatccggagaagtgctttttcggtgtccgcgcgggcaagttgttgggtttccttgtttccgaaagaggcatcgaggagaatctcaagaaaatcgatgccatccagcaaatgaagcctccgtcaagcgtacatgaagtacgaaagcttgcaggccaaattgcggcactcagtcgattcctctcaaaggcagccaaaagaggtttgcccttcttcaagaccttccggggcgtaggaaagtttaattggacaccagagtgccaagcagcattcgacgagctaaagcaatacttgcaaagcccgccagctctgataagcccaccccccaggaagcgaactgctattatacttcgccggtggcttcgcgcaagcttaagcactacttccaggcccacaaagtcatagtgccatcacagtaccccttgggcgaaatactccgaggcaaggaagttactggccggctcagcaagtgggcggcagagctatccccgttcgacttacattttgttgcatgctctggtatcaagtctcaagtgctagccgacttcgtagctgaatggacaccggtacttgcccccgaccccgagcccgccgaacaattctgggtgatgtgctctgacggctcgtggtcgcacaagggagtaggcattgcggcagtcctattttcgccgaatggtgtgccgattcggtacgcagcaagactgcagttcgacacaaccaacaatgcagcagaatacgaagccgttctcctgggcctaagaaaggcgaaagcactaggagtccggcgcctgctaattcgaattaactccaagttggtagcaggccatgttgacaaatccttcgaggcaaaagaagagggaatgaagaggtatctggaggctgttcggtccatggaaaaatgcttcaccggcataacggtcgaacacttgcctagaggccaaaacgaggaagcagacaccttggcgaaatccactgtttgtggtggcccacattcgcctagcatctttttcgaagtcctacatgctccaagtgtgcccatggacagctcggaagtcatggcaatcgaccaggagaaattgggcgaagacacatatgactggcgaaccccatttgtgaaacaccttgaaactggctggcttccggtagacgaagcaggagcgaagcgtttgcaactcagagccacgaagtataagatggtctcgggtcaactttaccgctccggggtacttcaacccttacttcgttgcatctcttttgccgaaggcaaagaaatggcaaaggagatacaccaggggctatgtggcgcgcaccaggctgcaagaaaagtggcctccaaagtatttagacaaggagtctattggcccactgtgttgaaagtctgtgttgagtaaatcaagaagtgcgaaagttgccagcgccatggccgaagccaagccacgccccagtatgatctgcagcccattgcgccaatatggcccttcgccagatggggactggacatcatcgggccgttcccggtggcacgaaacgggtataaattcgcaattgtagctgtggaatatttctctcgatggatcgaagccgaaccccttggggcaatcacttcggcagcagtacagaagtttgtatggaaaaacatcgtttgccgtttcggagtgccaaaagagttcattagtgacaacggcaagcagtttgactctgataagttcagagaaatgttcaaagggcttaacctggaaatcaggttcgtgtcggtcgcccacccgcagtcaaatggggcggccgaacgtacaaatggcaagatcctagaagcactaaagaaaggcaaatggccagaagaattgctatcggttctctgggcccttcggacgacccccacaagaccaaccaagtttagcccgtttatgcttctttatggcgatgaggcaatgaccccagcagagctaggggctaactcaccaagggtgatgttctctgggggcgaagaggggcgcgaagtatcgctcgaactcttggaaggggtaagagtcgaagcgctcgagcacatgcacaagtacgccacaagcacttcggcaacttacaacaaaaaagttcgacccacagagctgatgcctggtcatcttgtcttaaggaagaaggcgaatccagtagctgttggcaagcttgaatcaaagtgggaaggaccgtacctcatcaaacacaagtccaggacgggatcttttcgcctagcgacactagaaggtgaggagttcgaccattcctggaacgccgcctctttcaagcgcttctatgcctagaatgggtggcacccaaatcgctagcttgtaaaaatgtacatacagtcatgtaagcccttcggcaccatgtaagcccttcggcactatgtaagccttttggcaaagaaaaaaaaaggggaaaaagagaaaaaagaaaaaaaaactagatgtagggctattatccaccatggaggcccgaaccagtataaaatctctatgtcctccgccttcttttcatttttcgtgtgattgataatttgtggaaaaaccccaaggcaaacgcctgatcagcgaaaaaggccagggggagaaacgaatcggtcgaagcatcgctcgccgaacgttgaaaccgcaacagcttgtctcggaaaataactagccaaacgacgttacgattcgatcaacataaaagcaaaagtgtctctttcgacacagaatgctacaggtcgaaaacgaacgacgaaaagctaaaaagtcagtacacctattttgctaatatgcgcaaaggggccggcatgttccgacctaacaaaaagcacaaaatgtgacgatgcgaaaaatagcgaaaaggaaataaagcacgtttctttattaacttcgaaaaaaataattgaagaatagaaggttcacaacacgatacaactcactttacaagtaaattacatcttcgcccctgtaatcattatccctccctaaggaatggtcagacgaactaggttcgtcatcactactaatatcatacacaaccttaagaggagtagggggcgaaacacagaccaaactgttgcgacgctgaaagatcatttcctgacgtttcgtcttctgatgatttcgccaaaagcgagccatatcctccaaacgtcttgaatgaacaaggtcgtaatcttctaagattcgcccggggtgcgcccgcagccagtcggcaaccttgaaaaccttatagctatgaccgtttatctccatttcgcgataaacaggacgaaatggacatcgcaccttcggcaggtccttcaatgccacaaatttctcgttttgacttcgccagctcccggaaggggaccgaatgcacaacttccggtgaacgccctgatagacagcgcagagaaagcaaaacacagcttacatagtaagaataggcggaaggagggggaggtatggcataatgcgagatgagcgaaataataatatgccaaagacctcgaccatcaaaaagcaattaagattgtgtcatatattccaaatgtacaaaaaggcgttttttaaggttcggcggcagcctgccgaacgtacatcattcgcctctccaggcaaatgcaaaagtgggaggaaaactacaaaaatctaaggaaagggcggagggcctcacacctctgggtgatcctgggcatcgcctccaacctcttcgcctgcggcaccctctccttcgccccgatctgccgcctccgccttcgccagttgctccagaaggcgcgctttggcagcggaccggccatcattctgccagaactgttttcgccacgcgcgaagagcgggcgaaatgttctgcgcactaatctcctagtcccccttcgcataggtagggaattcggcaacgtgctcgcagccaaactattgcaaaaggtctaaggtaaaggccgccgatacgcgcgcacagcaattgccgtacgcggtggcacagtccgaaaccgatccgccagcttgctgggtccactcggagaagtcaaaggctgaggcatcctcggcaaggaccccccgcaccttcgcgcccatgtcggtaagggcgaggcggagcgtttggcaagccgttctcgcggattcggtggtcttcgccatctcccgcaaaaaccgctgcgactcctccgcggcgcccgcttcgaccctgctagccttctggcgaagagcctccatcttcggctcagtaaggttgtagtaatcgatgagcaccgccgaatgggccttctccttctccagttcggccttgaggcgatcaacctcggcccaggcatctttccccttgtccagttcggactgaaggcgtttgacttcagttttcggctccttgagggtgtgggccagggactccacctccaagttcttgcggcttatttcatcatccttggcccgaagacggctcttaaaaccgtcaaaacgggcccgcacggttcgctccgtcgagcagtgagtcgcaagaatctagatgaaagataggagcgggcgaaaagaataaaaggttaattgccaaacgtaaaaaaaaagagggaagaggaaaacaaagaaggaaaaaaaggcatacccgaaccgccaaacttttaatggtggaacacccctcgtcgaactcgttaagttcggtgaacaggctcggggtgccggcgggcaagacaagattgcttactccctccacaaagggaataaggtccgcctgggtcacgaagtcaccagggacgaagtggggcgccgcaagggaatactccgaggcagatgcttcggcggccacacacttccccttcgccttgaccagcggtgaaatagctggctcgcgcacagggctcccgaaaactctcgccgcagccgacacgatccgttcggcggaggcggaagccccggcggcggcgctaccgcctgccctagcaacgccgagcggagcaaggtgagcagttgaaaggtccaaactgcggccagcaggtgaagtcggagtctcgtcagaagattcatcgtcgctaaaaacgcgagcgatgtcgacgagtcccttcttttttgagatcttcttgaccagacctccttttgccgccttgcccgacgagaacgcaactagggccttcgccccttccaaatcctttcgttgaaggggggagctgttcgactccaccctggtctcgttgtgacctggacttggggtaggagtgtagccgggggtgtcgacgcggtcttcgatcgcttcgttcgcggccttatcagccacagcttccacctcctcttcttcctctccttccccctcgccgtcacattcttcggcatcatcctcgtcgtcggcgtcggagtccgacgaagcaggaacccttcgcttcctgggggcaagcttcacttgtccacgcatccgctttcgcgaaggccctgcatcgtcgtcagctttttggggattcgccggggaggcagttcgccgttgtaaacccggttcgtccgcccagccgcttgtcgtgttagcagctggctatactcgacgaccgaaacatcgccgatcatcctgcgggcttcggcttcagcctggtcgagggttgacattgcaaaagtaaagggtgtagctgcgttaaaggtcagacaaggcaaaataacaaagcacaggagtgtatagcaaaagaacggccttactgttcgtcccctcaggaagaaccaagttcggcaaaccgttagcctcttcgcattgctcgaccgtgacttgccatgactgggagaggggaaagatgcaaagcatacagaactcctccaccaagtcacggcagctaaggcgggagcaaaccttgcgcagtaggatgaaccgcgcctccatagcgccgtccatggcgatcttgggtttccggttcggtgcaatcgccctatgccggcaccggagggcttttgccgagtcagaaccagctgcgaaggggatggtgtgatagaaccacctcgccatccaatggcggtcccacttcgacatggcagcgttcaccggccagagattggaccgctcggggcgaacgttaaagttcacgctcccgaacactgtcttcttcgttccagccggggtaatcaccgtcttcgagttcaaggtggcgaaaaatatggcgccgaagagctcggcgctgggctcaaacccggaagtccgacacgcccagtcaaagatggagatccgaactagtgccgacgggctcagctgcggaagctccacctggaaaaggcgaaagatctccggcaacaacacgttgcacggaaaccgtagccccgcctcaacaaagacggcgaacaccaccgtccgattgtcgacaggcttcggcaccacggctttccccggggcgaaagcctgcccctcaaccaacgccccagagctaaccaactttgccagttcaacgtcgtccacgagagaaacccccaaaaaggcggtgctgtcatcatcgacccggccgggatccggtccttttgccgaagctgggtttggcttgcgaggggccatggcgaacggcgtgtatgcggtggcgaaggaagagaatgggcgaaacacctgaggggtcaagaaatgttgtggaagagaggaatggaagaagagagcgcaagcggtaaaaatggcaagtgtaccggtgaaaaggaaagaggggtgggaatatatagctcactcgggcgaccgtgcctactcaccagtaataaagcgccacgtgtcgcaagggtaggcgaaacggtaaattcccaccgtctgagcggcacagtaaaaagcccacgatgggaaggcccaatactgttccgttcggcccgggaaaagaaaatatataaccaccaatcgcacgaggcgaagcgcggcaaaataataccagccgcacaagtaacaaacttcattcgcaggaataatgtaggtttcggcaggagcatcagtcgaaagggggcgccgcataccataccacatggtttgcacggtctcggccgaagctccaatctcacccttgcccgtgaggggcttgttggcagatggcatgatgcccttcgactaaatctgccgaaacctgtggcgaaggctatggagcaagaacggcgtgaggcgaagagtcgtacgagtgccctgccaggccagaggcgtctcaggcgaagggtgcaaggcgaagactatttgccgaaggaagacgacttcgccatggcaagttcgcccccgcgagggtcgaggaagcctttccggcccatcaagcctaagggctacagggccggcaatcgccagacggcccatcaggggcccatgagcccctataacattatgtacccctgtaaatgtccctttcgtaagggtaatcatgtaaattcccctgtacaacataaaccctagtagtaagaacctgtaatggggctataaatagtcccctagggccatgtagtgagggggatcccgaaaaaagaaattcaaaattcaatacacttcgtttccttccaacctctgttgagtaaccacgtccttcgacgtatgcagttgtcatttcgacaacaaagccttagaatcaaagaaagaatttcctttgggcaaaatccttctcggctatctgtaccaaatgttgaacaatgcatcggctaaaatagccgtcggctcaatagttggagcaggtggaccatggtggctgctgcaaacttggttaaacctgatagtcatgaaggttgtccatcggccctctgtgacagaagctgaattcccactgccagagctgtcgcgtcccaaaacgactctaaaatacaccctctaaattatgcctagaataattaaaaaccatgtgaaagccttcaacaattaaaatgtgcaaagttaaaagtcaaataaggcttagaggatttttgtaaatttcctaaaaagcctaaaatgtgtaaataaattttagtggaattttcagagcacaaataataattattaagaaatgaacaaagttaaaatgattttataaaaagaaaaaccctaaaagtcccccttccctccaagatcccttgggctggcccggcccatctccctccccctctctctctcctctccccgcggcccactcggcctctcctcgcgcgcgcgccgctgacgggcgggcccgcccgccaccctcgctgacgggtggggcccacccgtcatcccctttctcccgccgctcccgctgcctcctccacgccctagcgccgccgccgccgtgaatcccgccgcctcccgccgtccccgcgtgcaataaagtgggggaaatcactccccgtgatcccctctccctttccccccatttttccctctctctctcgtattcaaacgggcggatttgcccccgcaaatctcgtcggcgccattgatggcggccggacctcctgcgccggtctccttcccctccggccgctctctcccccttccaaccctatttaaaccctccccgcacctcctccgtccgtttccgcctctcgccgcccttcctcctcaccggattcgagctcgcgacgtcgctctctctctctccgccgtcgccgccaagctccggtccgccgccgtcgtcgccccggaccgcctcccaccttggtgccgcctccttcgggttcgctgcatcctcgccgacctcgtccacctctctgtttcgatcgccgaccgccggaacgccgtcgaccccgttgacccgagccgcgccgccgcctccctccgctccggccgcctcctccgtcgccgccgtcgccccggggtgagccgtggaccgtcgcctcctttcccccttccctcccctctctcggccgccgctccgccgcgccggcggtcgccggcggcaaccatcggggcgcgggcgcgctgcctcccgccgaccgcgccggcgtggccgccctcgggcgcgccgagtggctgccgcgtggggcccggccgtcagctgcccgcgccctcgggtgcggctgacgtgtggggcccacggcgccggccggtgtgagcccgggtgcacccggtccaccgtggaccgtgaggctgccgcgtgggccccactcccgtggacccggtccgcgcgcccctccccctcggctgacgcaataaacccttttaaaattaaaatttaaataaagaaattcgtaaatattcatttaaagagcatataaacttcaaatggccataacttggccatttgaactcagaattggaccattcaagtctctaatttttccttaagaagtcaagaacccatttttgtgctttgttcttgctggttatatggagtttattagagtaaaagccttttcttttccattggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgctattgttattatttccttgttcaccctagaataaacaaaaccccaactagtggacactctactcatggtaccactagtatgattttaggcagatgcttcgctggttaattaggcaacattatgtggttttacaactctagactttgggatattcatatcacctggacactacggaatggttggattattgtggaattggattcacacctccccctctattcaaaatcctcaaaatggttttaggctgggctcggggtgcatggttttgatagtagcacatcggccatataaggaccggtcttcgggcctctgttgcaaagcactaccgtacttccacatgtctagtggataaggcttagtttgtggctcagtctggttataaaaaaagtacacggatggagatggacgaagtcgggggtcgatggacatctctaggacaaatgaaggctacacgagctgcggcctggtagtcgagatgtcatggcacagggccggtgtcctgctgctaggggctcagtcctgcctacctgatccgggggttccggccgtaggtggggttgggtcggtactcttgtctatggctaggatgggtcggaaactatgtcacgtcttccgtccgtataccgtggtggtatgtggcacgtggttacacgtgaggaagatgtgtcttgtgggtaaagatgtacacctctgatcagagtataacctattcgaatagccgcaccctcggttatgggcaagccgagcaatgtacccaagttagtgtttttaattcttaaaacctgcttaacaactaaaatgtggaatggttggcctgggttggcttgggacgagctgggacccggggtcgggttgccagttcggtctgaatcatcgtaggccttgggttaaggcaggctcgtgtgggttcacggccttgattaataatattatatagctctagaatcgtgtttacaaaatagctttgagcaactaagtgtcttttaatgctgtttactgcaaactctaaccctttatactataacccccttgtactcccttgcatttattctgcacttgtgggtgtgtcttgttgagtacgatggttgtactcagccttactcaatttttcccaaactcagaagaggagttcctggaagatgaaggctttggtgtctagctcgtgcctgccgtcaagcgcctatggtcgtcgccctagtcttccgctgtttttcgtttgtcttcttgtgtgctgggccttcgccgcccatgtaatagattaattaattacgcttccgcttgttaaactctgaattgtatcaacttttggtgtaccttgcctcctgggacaaggaataatgcacgcacgtaaggaacgcccgttgggttatttccggtcgtgacaatccccctttcatgaacaagaaatcccaaaaactggccagccgatacaccaaaagcacattttgtcgggttcatcttcaggccatattttttggttctcttgaaaaccttcctcaaatcggctatatggtcctctatttctttagacttaacaaccacatcatcgatgtagacttcaaccaaccagccgattaaatcatgatatatgtaattcatggctctttgatatgtagctccagcactcttcaagccgaaagtcatgacaacccattcaaataagccgattgcaccagggcatctaaaagctgtcttatggatatcttcttcagccataaagatttgattatatccagcgtttccatccataaaactcaaaattttgttccctgatgtagcatcaaccagctgatcagctattggcattgggtattcatccttcgttgtagccttattcagatctcggaaatcaatgcacaccctgaccttgccattcttcttaataactggaactatactagaaacccattcagcatatcggcaaggacgaataaaaccagcatcatacaatcgtttaatctcagctttgacaggttcaagcatatcggctttacatctcctcggaggttgctggcgtggtctaacccctagtttgataggtagccgatgttcaacaatcaatcggctgagtccaggcatctcataatactcccaagcgaagcaatctctaaactctcttaacagctctattagcttggttctaaactctggagataagttcttactaataaatgtcggccttggccgatcgtctggacctatgtctatttcttccaaatcatcggccgacatgaaaccttgaccttgcttgtcatcgagatcatctactgtatccttagtgtagacatttgaaccctccacgatgtcctcaaaataatagcttgggttctccatcttcaattggctgtatattagaatcggacactttcagaaaatctccatcccagacttttccagataaacaatcaaggccatccatctcccaaagagctaaatcggcactggcaacattaactgacctgtcagctggcacgatctctatcttgtcgccttgccattgaatcaaacattgatgcatagttgaagggatgcaacaactagcatgaatccaatcccttccaagcaataagctgtaagaacccttcccatcgatgacaaaaaaagtagtaggaatagttttactgccgactgtcagctccacattcagaacacctttggtttccgatggattaccaccaaagtctttgagcaccatatttgtcttgatgagatcctcggcatttctacccaactttctgaacgtagcatagggcatcaaatttaccgcggccccaccatcaaccatcattttagacatcggcttcccattgacatagccgtttatatacaatggtttaagatgccgattctctgtcccctcaggtttctcgaacactgcctgttctggtgacagaaccaacttagctgattcctcttccacctcgtcgacatcggcttgatcgatcccgaattcggctggcagggtaaagaccatgttaaccggtgccatcacaacactcttcccttttgccaacctctttgcctcatcggctgcaacatcatcggctagagtaacctgattcttaacacgccactcctgccttggctttgctttcttcagccgatgattaatttcttgttcaacctcctgaaggcgctccctgtttctcaatctttgaacccttctcttctgattcttcatgaaaataccagaatgacaccattgattcttcctgattacattgtcctcttggccatgatcttgattcactggaccaaatctttgatgaacagaaattcttgtctgccttagccgattactcctattatatgatcggcttgatctctcaatgatatcactgcacccagggcagttttcaatagatggcaacctcatgctctcattccagcagaatctaaagaattcacaatcccaatgagtatcaaaaccatcatcgtattcttcatgatgcttctcctgctgcttgtcatacttcctctgatatttatcgataatcatagccgaattcgcctgaaaacccgttgcacggaccctattggctgtttggccagctgtatgcaccatattaacaggaaaagggttaccatcgaccttcatcggctttttggaatcatcaaacctaatcttgcctccctcaatggccacctgaatttgctgtctaaaaaccttgcaatcgttaatagaatgagacccagaattatgccacttgcaatacctctttttgcctaattcctcagccgatgggattgtatgaccagcaggaagttgaatttgcttctctcggagtagcagatcaaagatcttgtcagctttagtaatatcaaagtcatacttctcctcttttccagaactttttacccattggcatggtatgacctttttactcctcacccattcggctgcagctatttcagaatcatcgtcatcatcatccgacccatacatgtacggacaaacatgattaacattcttagagcttttcctaacttccgcagacctatgctcatgcaaggttactttctgtatcatatgtgacaagctatcaaagtcttcagacgagaacttctccctaatcggagcaatcataccctgaaaggccagatcggctaactgggcatcggttaaactcaagctgaagcatttgttcctcatctccctgaatctctgaatatactagtgcacaggttcatcatgccgctgcttaatcgctgtcaagtcagataatttcatctcatgaaccccactgtagaaataactgtgatattgcttctccaaatcggcccaactattgatcgacccatatggcaaagaagaaaaccaagtaaaagctgatccagacaaagataaccggaataacctaaccttcagagcgtctacagccgatgcttcaccacactgagctaagaatcggccaatgtgctcataagtcgatacaccatcttgtcccaaaaatttagagaagtccggaactttgaaccgattgggaagaggaactctctctcaaaccactcagggtaaggctgccgatacaagctcccagtctcttttggtttaagcccaaactgttccctcattacgtcagcaatcacatcggcccatggtcgttgctgagctgccccttgtgactgttgttgcatgggtccgaactgaccgtattgagatgcaaactgaggttgagccaatccccctgggtgatattgggcttgcggggaaggaggctgatattgataattcaagttacccccttggtaattatgaaggttcggctggatattacgtaccaagtgctcaggaacaacttgaggcattactgtgccatctggctgtacgtggtgaaccaagtgttctgggacaacttgatttaaaaattgttgtacaggctgaccaccaggcgttgcaaacccggccgatgtgcttactgaaccctggtgctggatcggctgaacgatttgctgtcttaatggcgttcgctgaatcggctgcagaggctgttgccttggtggtgtttgcggaactggttgcatgacctgttgctggattggttgtacaacctgctgaattgggggtgtctgctgaatcggctgctactgaatcggttgctgctgtattggatcaacaacaggttgaggtggcagaaacatggcagcaacctgatcttgggttagccgattcgcaacctgcccactatgctatggatgctctctcattaacaaccgagggttcgccggctggcctggcgccatcactgatagagcaggtagggcagttgatgccggcgccgttggctgagttgttggtgcaacggagggaaccggctgaatagatggctgaacatcggtaatcaaataccgataatttgggaagacaccttgcaaataaaccgggcctgcagcctgatgctcagctattgaaccatcggctattgacttcatcatgtttgataaggtattgactaacaccccagactaattgatcaaagcatgatgcaccgcgtaatcaacccgatcttggaagttattgaaaaaatcctgtgccacatcactattctgattaagatttcctccctgcagcccctgagcaccatcaccttgaactccatgcaccccgtcaccttgtactccatggactccttgagaattgtcgccttgatttcctagagagccgtcggtagcacctttgatactcggctgagccgagccgtctggagcttgtttcccatctccatccttagaagaactggtcccaggatcatcagcaaccacttttattttgtacttctgaacaagtgtccccttgcgggtctgcatgaatgagttcaagaactgatcccgtgcttgctgcaacattgcttcaaactctttcttctgttcaggtgtgaatttttctggatcgatcggcacgacgtttccttcattgacatcagtcaatcccaatttcagcatcttttccttaacagagcctgggctagatggtggtggtggttgtttctcggccatgaggaagaattgttagctgactacttaaaggtcccatcgggcgtgccaaaagcgtgttgacagaaaacacgaggcctgggagatctgcttaactccagtgcaggtccaaagctcgccttcgaatgtataagcgtgccagttgatttgatcctgtaatcaacaagaaatagaagcaaagaacccgcggttaaatctataaatgatagtcgatcggctagaggccgatgacatatcatttatctttgagccgatgtcatatatgtatcgatcggcagacatgaataaataagaaggaactaaatctattcgatcggctgtagatattaacaatatatactccttatatcgatatatacttaaatcaagtgattgggatagatcggtcgccatgccgagacagtataaatcacttaaatcgaaatatatattaataatgggactatatatgttcatagcatagccgatcatatagatctaggatgtatcggctaatactccgataccactctatactaagatgttaaagtaggtagaatatatcaaacaaaggcctaatatacttaaatgcaataagatcttaaaataaagggcagatttaacatgtcaataaagtatatagggtaaatatagttaaattagataagatcagctgaaactccgatgctaccctaatcggcaaccagaaggcaggctagagattgattttctaagcacgacttaatatatcaaacttaactgatacggcattaagtatgaaaagaagaacaatatctagacaatcaagctgctggaagttttatagagtggtagatatcttatataatctaaatcaacgttgaaatctaacctaatcggctgctctctaccgacagatgttagccgattgtagattagatagctgcattgccggagattatgtaagatatatgatagctcgacgaattacataaacgagatcagagtatcataaagatggaagcactaatcccgagaacacaagttgtcataacaagttttacctcttgttgaagatcgaaaccgatgcagctcaacccgaaagtaagaactcgtcgaaataaaactaaagcaaaaagggtggtgatgagccgaaattgtattgaacgtgtgtgttcaaagttacatagggctcgggtctatttatacccgagaattacaagatatgtctataacggacacgactaatatctttaacaaactctaagatacaataagtctttacggcagacttttgcccaagcgtatctctaaagaaattatataaaacatcctaattaatagataaaattgccttctcaggactctatccttgtgcagtaatcaccttgaagtgcctcaactcaacccgatatcatacatgaagtcgcattgccggaatcggctgcatcggcttacctagcccgactcagacctagccgatcctaatcgtagccgatctagactccagccgattcctgctctgtttccgaacccgatctccgcctccgacttcgcttcgatctaatcttctttcccgatgccgatattaccaaatttggttgttaacaaatatgtaaaactatatgcatacataaaaatatatttaacaatgaatcaaatgatagaaaaagaattaataattacttaaattttttgaataagacaaacggtcaaatatgtttaaaaaagtcaacggcgtcaaacatttagggatggagggagtattaggaatcctagtcctgcaatgggcaatgggcaatggcctggagaaaattcagcatcattcagagatctcaagtttgttgatgctaatgttcagggctatgatcctgcaccatggcctgtcggcatccattgcttgtcaactaataagaactgctaccaattaagttagtccatatttagatggtgtattccattttggacgtcctggtggttgtacaaggttgtaaaatttttccaagtcttaatggcagaataagttgttctcatggaaatattttgggcttattatttgcatatcccaactgctttagcaagaacagaggaggtcatgttaagcactccctaggcttgtttcattcatgattaaccttaccataacttagtggagaagtattacaatctctgcattaaatgcgtgtcttggagaacaacacgaatattgccccgtgatggggcccgtcaaatcatgccgcctgacacgggggacatccctgtcagcggccgtcaaggggcaaagacttctgggtccatgttcacactgctcgtcgtcgttgcgcttggaggccacaaacgtgaaacagtgaaggacccaccggtcagagaccccccacttgcaccgggaggcggcgatatccgccttaattatattaaggcagacgtgccaccctcgattgtgacgggaggctaaaatctctcatcatgatcgatgggacggggccaggcgcacgccgcctggcacgcgtggtagtgcgcctgacgcctcggtcccatcagtcaatcaaccggtcatgcctgctcaggtcaccataaatgcgggtaggtgggcgctcgaaggcaaccacctaacccgttgcacatggttcccggtggaggggttcgggggagcccgaccccttggtcacacgagagggcggccgccacctagtctcgggcctaacccccctcgtgggtaaggccacgtggtgctgggggcagtctcctctctctagtcttgatacccccggacccgtatcaccgacaccggcatctatattcaatcggatatatgcaccctttttttttagaaattataaacttagcctatcaaataaggaacttagcgctcaaataatccaatctgaaattcactcctatttagatttgaactcaggaccttgagatgctacttaggtcactgcaaccattaggctacatgcccatttacatatgacaatgccaatggcattggtgctatcatgttaaaccacggtgtgccaatgatgttagtaccgtgaaaagggtttattctcggaataaaatttctgggtttatttgtaaaataagttttcaaataggctacagtcacttcgttgaagacaaccgcaatggttacatgtgtaacacgtaattgccaacgattttttttaatattctgggtttgaatagatgatgggagagctttagcaagaacaaagaagggatcatatgttactacattgagcctgaagaaaaatatggtcattttaagtttaagaactccctaggcttgtttggttcatgattattaactttacgtggcatatctcttttctaaacaacaaagtctggctaacaaaatggtaacctaaacataggcaatgttagcatgaaccaagctgtcacagcactcttcgtcatgccagatagaaatggcatacttaattacacacctgcacaattcttttttttaaaaaaagtaaattttgttttggacttctttctaccaaagtttcaccttggacctcctgttgacattttatgttgccgatgaaagcctgcaccttggtgcttgttaacatgtattttgattatttgaactaatacaacaacaataaactcaaaactaatgtatatagaacagaagatgtacacattgaatttttgccacaagttcaaaagaaacttttggaatttaagtttggttatctcacatttttcttttggaatattctcatgattttgcaacaaagtttatgaaaccacatgcatgttccaatatgtttttacatacatgagttttcaagaatgttttcaaatgcacaatttgcataatcaggaaaagtgtgcctaagagaatgtgattaacaacagcttctgagttatgttaccatctgtagaaacagagcatgtcaatagcacccaccaagcgaattctttacaaaaatatatgaacgatattcggatgagtttactaaagccctcgactctgtatactacataatcaagcactaataaaaggaaaatgccgtttgtattcgtacagaccaagcacaccagtaaatcgaaccacatagttttgacgctacggtattcgggcagatacaacacatattggaatagtacagtgaaagcttaaaacatggagaccgaaattcaagatggtaagcgagtcgacattatcaatatattgtgttatggcctatatcaactatcaagccctcgatctttgttccatcgagctttaatttcttccagttcgtcatcctgtcattgaagaaatcatgttatttagtcaatcctatgctttcattccagaacaagtgatttctctatcctgagttaaaaggacgttttagaatcaagtgaacaaatacaattacaatttagaaagcatatttatttacgtttgcaaaatatatatagttcatgtgctcagtggaatttctttagtgtgtcactgatgcataaagaaagaacatgaaatcactttgaaagccattatgaatagaatcgcaactggtatgtcaacgcacctcaaaccgatggtagatccactcagcgtataagccatcaaggaagttctgtggtgcagaattgttgttcatggaaatcactttgaagaaaggctggaaggagtgcttgatattagcattgtcccactgcaagtgctccaacaattcttcctcacaatgaataaccttcatattacatgggacggttgtgaaaggcagtgttgtcagctggggacaacccaagatttgcaagcactccaatgaaggaaagtgaaaggatgagtcgcagatagtagtcaaactctttaaataaattaaagtaaacctttttaggcaaggctgcgaaagagatattctttctttttcatctgtatttggcagattatcattgttagaagtgcttccaattatttgctgtagtttttcgcaattatatactatcaggtcttccagataaggaaaatgttgaacccacgatatgtttgtcaagctaatgcatgatataaggtccaatcgtctcaggttctgaaagagatcctggctttcaactccttcccataatacatctgtgaagtaatggccacatatgtagagcttctcaagattagaacttcgatgtggcctgttgctttcaaatacaatttgttcctcatgtgtgtagatgtataactccaacagattcctctgtatcagatcatttccgaacaaactgtctgaaaatgcaaaccttttccattcgtctagagactttgatttaatgattacacagagggatctgacaggtaagctggttttgcagagcatattcaagtattttatcttgcctacagtaattccaagagctttcaagtctgtcatgcattcaagagcaccaaatggtggttcaaaagaagcaggttgttccaactgcaacgagcaaaaatctgcaacctgcagtctggagagctttgacagaataacttcgggaatctctctgataggatttgacctgagaagcaagtactgcaacttaaaaaggagtccaagctcttgaggcaagtctttgattttattatctgataaattcaggtaatataagttcacaagtttgcacacttcactgggaatggttttgagccagttccttgagaggtctagatattgaagagatataaaaaaacataagctactcactgaacttccatgtaaatcattattctggagtatcagcacagtaagcttggtctggtcctcagaaatggcaggcagttgtgccatttcagtgcccactgataatatccgctccgcattacaccaatgtgatactgtttgtacaacccatttattcttctctcttccttcgtcaccaacaatccaaagtgccatgtcacgtatcacatcgtgcatttttacaagcctgtcatcatcagtttcctccaaaaggcacttgtctaccaactcacgaattcgtgcatatcctgcgttgtaacatctatgaatatcctcctcctctactagacccagtcccatccagtactcagatagtttgtttctatctaacagataatcatcaggccataaggcgcatgatgtgaaacaatctttcaaattagtatcacttagatattcataactgagtttcagtcgagcaaacacactttcttcattgcaaactggcccttcaatctcattaaggcgtgattgctgaagaaagtcgatgcaattctgccattctcttggatgcctcttggtagacatggccctgccaactacaataagagctaacggcagtccagcgagttcatttgcaacatcttttgccagtttaagtacaagggggtgattttcaataatttcagtaccaacattttccttgaaaagatgccatgcatctgtttcatccaggcaatctattttaatcctttgcccattcttgacacccatttggccacaaacactttcagagcgtgttgttagcaacaatttttgtttgtaattgccaattgagataacttcgtttggaatcccaaccttatcaagatcaacatgttcccacaaatcatccaataatataagaaaatttttacttttgagaaattcatatatgataactgcctgagattctgtgtcatccttcttcaccagcatctgttccccaacaattgcgtcttgaaccttcaagtaaaaaagtacttttgtcatttggagcaaattgacagagagcttaattaaataatgttgtaaagtatttaaaattagaagtatatgcagttttttgaaatatcaaaatgttagctggctgccaggagcccttatttaacgctagttattactccctccggtcagttttatatgctgtttccgacagccaaaatatgttatgtgtaagtcatttcgttggtctgaaacaacaaatatttccgtccggagggagtattacatgatagtagtacctgatggcagtcaatatgaagactgttagtatcctagaaatcgttgctcctataaaacaaactataattttagctggagctttgaggctccatgaattgctcattaggtcgcttaccctagatggtttgtaatttttgtcttttgggcaagctggatgcattcatctttgcaacaaatatactttagcaagatacagaaacatgtacatcaagggtcaacagttagcttcatctaattagttaaagacaaactttgatcactccctcgttaaagggagcacaacatacctttgcaacagagcaacctttggaagcagtaactcgaataacaacatcaaaagcagggtttttgtgaaacaagttgttgatctgatggagcagatgtgtctttcccacacctccagggccccataacccaaccttgcttacagcctcatccctgatgaacttgacagcgaggctgcgataccgatctgtaccagttaggcttacgtcagttatgggcacttcagaggaagcctgtggcaccatgacaccatattcttcaaacatgccctcactgtatatcttctctgcagcctgacagtttgctgctgcactcttggctatcatgtagtagtttacacagatacaaggggacaggctccccatgcacttggtcctcttaccatactttgcctggattttttcagtctccacacatacatgctcagcgcgcttcagccatccttcaacttcattcctccgctgcataccttttcgcatagggctgtccaacttggtctcaactagggatgaaaacggtcgggaatggtcggaaacagtacattattttattacttttttcgaaaacgagcgcaaacggtcaggaaatttctatatttatgaattcatctatttagtgtcaacttcaatgctacgctgacagaaattaaaaaaactaaaatttgaaaacggtaacatcggtaaaaatattattattatattagttttgcggaaacggtatcggtacggtcgggaaatttccataccgtttacacccctagtctcaacatcgctgagcctctctcttaaacgctcggtggcagcttcgagagcgcgcacacgcttgcgggctttgaagaagtaggcggcgtactgtttcgagaggcgtatcaaggagatcaggatagcaccagagcacttgatgccgatgatctccatggagtttgtggtattccttcaaccaggagaattttgtctgtgtttattaagagtgcaagaaccaagaagaccaaaaagttgtcctgtgttcaataataaggattgggttcctatctaactgacatcttaagagaaaaattaatgcaatagcgatggcaaatattattacatgaatagaagattcacataggtccaaaattagatggttcattcgatcatttaacacctaacagatgtattctatggaatcaatctgaattgatgagttcctttctggtgttaactaagaagaaaactgaatagttatcaaaagcgataggccgcacatagcttcaaacttttcgacatatgtgaagcctattgttttgttgatagttcatggtattgatgactaattaacgtgctttcagatgttattagtttaacatctgatggatgatgatgcatgcattcagtgcaatttatgcaggaattcctttcttactgactgagtctacaagaaaaaattaatataaatgacaaacgatgattgaactcacacgttggttaattctaaactagacagctaactataatacatctggctgcaggcatcgtatagctggatagcagtgcgtataaattaaatacttaattttagacttgggtgcagtgtgcatactcaatattaccattacaataatccataagaatcagttttttttaaaaaaaagaacatgccaactgaaataaaggataatggaagttgctggttccgtccgtcgtcaattcctgcatgacttaagataaggatagacaacaaatcgagctcatgcttgaaggcctcgttgttttggcttatgcttattcctataagtcaaattttaaattttaaaacttaattttgaattctactctttgtttttttatcgtactttattttacaacatgcttatcagtcgctaagaacattatattaaagatttgtacatggttagtcttttatttggtaataagttattcatataagcacatgaataagtgattatttatccaccgacacatatatacaaattaaattggctcaacccgttgcaacgcacgggcatattttctagtacctaattaaaaataagcaaggtttccctaaaaaaaaatttcgtccgtctttttttatttttcgcccttttttctttttttttctgtccgttttccttttttttttctcagtctgtttcttttccttctttctctccgattctttttctttttttatccgtctgtttttttccttctttccgtccttttcactctttttcttttttcttttttcccagtttttccgtctgtatttttcgcctttttttccatctgcttttttctcttcgccttttttcattttttccctctgctgttttttcttaatttttttctatgcctttttaccgggttttttcatatgtttgttgctgtttttttagttgtattttctcgcacgtggtaagcatttgtttttttatgtgccatattttctacgcccggctgaacactagcgtcgccggtcgatctgccttcccatgcgttccctcttccaatcgattgccaaaaatcaattccccgctactcccttatcattttcctatgattttccttttaacgctgctttaattcactgaatttaatctttatttaaaaatcactgtttttatcccgatgtttgtcgctctgattttaataaaaacggaaagagaagatcgagtgtatcaaaaaccctcgaccaattttgaaagatcgagaaagattcgaccaaatttgatgggaggatcgattttggcatgtacagacacgacattgtctttcggaggttgaagactacagtcggatatgcgagccggacctacacagctccacttgacaaggaaggaacgaaatgagcttttggtctaaaaccaaagagtaaaatatataacgatccaaaaatatttttacccgttgcaacacacgggtattttttctagtaataataataatagtaagaaaacaaaaaagagctctgacgacgtgtacgttttcgtgtgtcgtttaattatttttatgccgagtctgccgatgtttgtcttgataatttgcttatttttttctatgtaagaattatcgatgatttatgggtgaataggtaatctagtctctcaaagttcactaaaggcacaatttaaaccctgagatttaattttatgcacataagtccacataagtcctcttaagtattcattttaacttaaaatcatctttggaccaacttaatatgcctcatggataatcctaatcaacatttgaattaggaaatgtcccttttgctcctaatctgcatagattagaaaattacacaagaaaagaataaataggacagaagaaaagaataaataggattgtgcaggtactttccattatttaatggctacggtatacataaatttttttattgtacttaaattgctatgcattacgtctaagaaaattcgttgtgcgtaattttttttaaaaaaatatcatataattgttggatatatgtccaaattaaagttaggtatacagaagtcccatcttacaatttatttttcttgtatatgtggatgagaggtattagagtcattattaatagagatgcgcatgactttttataaagagagaatctcttatatgccactgaaaatttgtttgatcccttggatgccattgaaaattggcacttcccttatatgacattggttcaaattttcgctccctctcatgccattgccgtccgttgactggtagttgactgttgataggatgtaatcacttgtcatttttttacagaaatgacaaaaataccctttggcccaaacatgagaatatggcccaatcgtccaagtgggccaagcccaacatccctctgatgcaccatgtcagtaagcctgaacatgtattttggtactgtgttagtatgcattttggtactatgtggtcatttaaacagctccctataatatttgttgcatattctgtgctactgtgtatatctccatgctctagcaaacaatctgttggttattttagctatttagccgtgcattacaaacaatgtgcaattacacattatcttaaatgtctgtcagaagcaatctattatattgcttgaatgttttgtcatactgtgaaaaacagagaaatgttgtgctccctagtaaatattgttgaagcttttgttcgagaagcacatggtcaatgtatgtggaaaatacattaatgccataacagattgctttgttctactatgaaaaacagagaaatatgtgcctcaaaattatgtgactgaaaaatattcatatattcaatatatagattaatgctatacattcatatattcatttattccaaatatatgtgatgcctagctaaaaggtagtatataactgatatactaacacctactgcatgcctatcaactcaagaagggcaaatacgtcatttcactctacagttaacagtcaactaccagtcaacggacggcagtggcatgagagggagcgaaaatttgaatcaatggcatataagggaagagccaattttcagtggcatccaagggatcagacaaattttcagtggcatataagggattctctcttttatgaatgggttggaccagatgcattgtttaataattaattaatacatgtgggttggaccacatgcatgcaccgttttatttataaatatatagctctgcaacgcagcacgtatacaggggagagcttttacaagaaggcggaaggccaccacgcggagctctcttgctcttccattgctagttttgcttcatctccctgcctgtaagaggtgcaaggtacatttttatattgtagtgtatactccctccttcctaaaaaggttaattcttaaatttctactccccgatctaccatcagtcaaaaaatacagaagtttaatctctggagtatatatgaccaatatcctaataaaagttttatttaacgtttcattctcaagttatcgtattcggacgttcaattcttaagttcttgcactgtatcccacccacctactaagttgttgtaccgtaggtacaatttactcataaaataattatgaagaggaagagggaaaaaattcatctaaatcaaactaggcttaggctatttccaagactatgaaactagttaaaccaaggattgttttctaatttgtactaccagattttagaaatttcatattttttataaaaaatatgttgtataaattaaagcatataaattgacggtagcgctattctatgctctacaacgcggaatattagttcaagcgccgcataacgccctctcctttcagttttccccttttttactccctcacctttcctccgcatcccaccttttctcagttcatttttttgttttttaccactccaccttccgtgtttcttttttctcttttcatctcatccgtgatttttctgtttttctttccttctctgtagttttttctgttttctgtttttctttccttcttgtaaaaatattaaccagatttttttgtttttctttccttctctgtagttttttctgtttttctttccttctctgtagtttttctgttatcacgtccgtttagtttttctttccaagttttcctttttctagtatctccgcacgtttcaaaagtaacgaatttactcccagcctcccacatctgctcattcaaaagtaacaaatttactcacatgaatgcctccacatcgtatgctgccatacctagatggtcgtaaaagaattattaccagcttacaacgctggtaattcttttaccaatataaatattgtttagattttgtggtccatgagtaaaacaattactatcttcctcttgatatagcccatgatcttgtaaccaccgtgttgtaatatgtttacatgatcttgtagccaccgtgttgtaatatgtttactgatgtgttcaatacacagtataagagtaaaaactgaaatttcatggtctacgagtaaaacaattatcaccttcctctcgatatagccatgatttcatagccaccgtgtagtaatatgtttactgatatgttcaatacacaatataagagtaaaaactgatactaagagtattgttgatctgtatcacaaaatagtcgtatgaatgaaaaaattacaggctcaatcacacacaagcgataaaattacgccaaaaaatgattcagccaaaaaatccatccgatggctttgctggatcttgctatgaggatgaagagcacggtctgtgccttgtgactggtagtggagagggcaaccgggtggcgagcagtagtcgatgatggaatcatggaaggatgcgagcagtagtcgacgatggaatcatggaaggatatagtagtgtggtatagagatgagctcgacgtagctcagtagcagccatccatcatctagcaagcacgaaaaaaaatgcaaaaacattctctttcacgtcaatacgaatgacaagcaaatgaaaaaaagcgaacaacctccatcaccggtggactccaccctatcctctgcggccagccacatggagcacgatgtgcaaatgtaggacctgtgcagcccatcaattgagatcaggtaatactggagattgcacgttaatttgatttgaaaaaaaaattagagcttcatgcgtgaagttgaaggagagtatgcagatgcaaatcagagtgttatttccttacttgtttgttatatcaatatcgccgatgtggagcagccgctggttgctgctattggcccaggtgaacacctccttgctggttaaggtgatgcctagcgtttggcagtgaggtccgaagtagtgccttcgcctcaaccgctgccagccaccgctcgctggccaccaccatcaattgccacggtgtcgtcgtcctcctgcatggtgtgtcgccgatctgtgggctgggctgggatcgattcagatcccaaaaaaaggaaaaaaacatagtggggcgagagtggttggttgggtacgggataaatagaatatataccggaagcagagaagttgttttttatcaaagtaaatcatttactccgataatggtgggagcacgatgcgggacgtggggtgggatcggaagcaggggagttttttttattatcaaagtaaatcgtttactcgaataaaggtgggtggttgaggcgcgcgataggagtaaatcgtttactccgacaacggtagaagtgggatgacgaaacgtggggtggggtgggcctgggctgatgcatgtttggcgctgcgctcctaacagtagttctaataaattgatttcaataaatttaattggtttttatgtaaacttaagcatattttttcatattattttcaatccaccttattttaaataatattttataggatcgtagggatcgtagaatcaggatacaaactaagatttcatatgatcgtgtgtaaatgaatactaagattagaataccataaaaattaggatactaggtaggatcaatatcatttcagcttggtacgattatagtatcgtaaaataatataatacggatcgggatactgacaaccttggttgatagtaacattaggggctagattgatctcatttcatccaactacatctaattaatcccatatatcgctattaaatgccatgactaacctataaagtcacgcaataaaattgtgtactggagggcttaattcagggtggttggagcaagggtgagtgaaggtaggtagtgtgaaaattaaatcagaggtgattagtaagaatacagtactagtatatttcggatacagggcctgtttagttaaaaaaaaacttttccaaaaatatcacatcgaatctttgaacatataacatatatggagcattaaatatagataaaaagaaaaactaattgtacaatttgcatgtaaatcgcaagacgaatcttttgagcctaattaggccattattagccataggtgctacatagtaacccacatgtgctaatgacggattaattaggctcaaaagatttgtctcgcggtttccatgcgagttataaaattagttttttcattcgtgtcaaaaaccccttccgacatctgatcaaacgtccaatgtgacaccaaaaaatttttatttcaccaactaaacaggcccacaatttaaacgctataaaaaccaatattttgatatggagggctacatagataaacgaatagagatgtaactataatagacatgcaatgttgtcatttaattttcaacgaataaacgagtagataccggttagatgatgatcaatttgaaaagatctaaaagaatattcttaggagatgattaaattgggatgtggatggatcgagtacgtatgtacaggtagatagactcgcatccatatacttcctccgtccataaatgtttaacgccgttaacttttttaaatatgtttgaccgttcgtcttattaaaaaattaaataattattaattattttcctatcatttggtttattgttaaatatatttttatgtatatatatagtttaaatatttcgtaaaagtttttaataagacgaacagtcaaatatatttaaaaaagtcaaaggcgtcaaacgtttagggacggagggagtaccatatttccatctgaccttgtttactttgttaattaatttgctcacacatattgtattgtgcaggcaacaacgatgctaccgagttccatatgctccatgggccaaatcccaagaacttcaccccattcctatgggatgctgccaaagcagatgagcaaaggacatcctcctacggtcactagaggtacaatagtttttattgggattgatgttacttgacatgaccaagtccctctctcctatactaatcgttctaacgtggagtagtaaaggcaggagacaaattagctttaggtaaaaataaccaaactacccttaattattagttgcagatagttatttcaatgcttacgaaattgtcacaaaataattgcaccagccatgcctgctacccaaggaatatttctagcatggagtacaattatttaaacaaaaagttcgaataccccctaaaatatggcgctagttcgaattatcccctttgaattcaaatactaggcattttacacccgagttcttaaatctagacaaattacccctaatttaatcatgtgtagttttcagcttacgtggcacacacatggcatctgtcagaaaaacaaatactccgtaaaaatctggcggggcctattgtcggtgatgctttttttcctcaccctcaatgcctcgctctccaccaacaactcggaatcgaccagctatccgccgcccgtgctccaccgacaaatatctccttctcctctatacgatgaacacctagaggaggaacccaccgatagagggtggtgggacaccataacctacttgccttcctcttcatttcttcccctcttccgagcatgcttgggctttagatgctcaccgctgcatgccatccacccgactccctcagcgaagaggtcgacgcagatccaccagctccgtgcaggaatgagctcctcggcagcgacaacgatgagcttgatgcctactggcctctcctcaattcggcactgccggctatcaatttgatggggcggcgcctcgaacagaaggctaaggagggagcagaaggaggtccaggagaggcacattcgatggccagaggaggaggtggagccggtggtctcgatcagagtggctccgtcgatctagaccgcaccagtgcttaagcccactcactgaggtccgtggaggcgaattgcctccgaagcccaagccaaccaagaggaggtggtgtggatccgaacttggttcattgtcgagagatcgagtttgctctgcgatgggtggatccatcgctgtgatgttgccaccaccaaccaccgccattgttccacctctaacatcattcgccgccccgtgcacacttggcccacagccgtcactctaagtcccatctcggcaccgtaacttgggaataaggggagtcgagaggtacaagcccctcctaggcactgccctcctcatcggcaagcgcatgcaatggaaaagctgtgatgcgatgcatgcgctagcatgcttgtgatgctgaggaggaggcggcgtgactctttgtgctaaggtgatctttgtgttgatttgtcacgcccagaaattcactgatattttccgaacttatttgtgcataaaatcctcgtccaggaattagctgaggtacacaaactgacaatttaatatacatattcatcaaaataactaaagagattaacacttactgaagaggcacttagtccacacaacaaagaaaactgcagcggaaaataaaatctagcgaagctccggctccactcccacaggcagctcaactggggtataagctaaacgtcttttccctctggatcctttttcttcaactgaggtttaattgattattgcaaggtgagcatatgacatactccgcaagccacacagcaaatatgcaagtgcacaaggatatcaaatgatggcataatataggctcatttgcaaaagcagcatttagcaaacatttaagagtaataaaacagtggagtaattaatcatcaattttaatcaacactgaacagcacacccatgctggtcaggcccaaccctcctgaacaaccatacccggctgtacagatctaactccaaaccaggagctaagcaaactattaccagttatagcatcaataattattgtgagaggtgtgactctaatcatgaaaaacattgctcaacccgcccatgaccgcgggcacggctattcgaatagttttactctggccagaggtgtaccactgtacccacaagacacagccccaaaacatgtcaccatgctctcagtaccaccacggtacctcggaacgggactgtgacagtacccttcgcacaacacaacccaccacagcgcatcattcctggatcataatcactccctctacaaccagaggcatggactccctagcgacccccacggacttctcgccgcttctcagtctggtgccccgcaatgaaccatgctatataaaaaggtaaagccgttgcccacgctggcttgtggttggtacggttaatgtctcacatcagtagctcgcgaaccggtccttaattgtcatgagcacggccttcaaaaccatgtgctcacaacccaccattatcaagttttagttggcaagtaattaattaatcaatcacgattgaccatcgtgagctaccattaaatataacaataagtgatagtgtaacattagttatcccaatcatgtgctaatatttctaagcatggctaagtaattatgtctaacatctagcggaaccaatatataaagctcaactagtcaaattataataacccaaggtatcaaggaaaagggtaatcaatgcaaattggccataacaaaggaatagattcacaccacccggtgacattcgagaataaatgtacagttgaaataaatagagaatttaaatataggatcaacatgctcaaaggaattgtgtttgggatctgtatgacttgccttgcaataatcggtcttcaattagtcttctgaacaacttccgacgcactcacgaaccttcgcaacgacggaaacaagctaacacgcaaaacgagaaaaaagactaataaaaaccaaataaacagtacataaaagtaaacaaacatgtagatcataattttaaatgaattatgagacttgaacggcctcattctgacttcatatgaattagttatgaattttacaagattaattccaattaaacctattaaagaaaagactattccaaattaattaaacaatttacaaataatttataactgaaatataagactaaagcatcctccggaaattattggaatgaacttagtagacgacatatagtaaaaacaactaatatgccattgaaaaggaataacatgatttatattgattttggacagctgagatcaactttgacctagttgaccaaaattggatggctcggattgatctgatctaaggttttagatggctgccacgtgggatctgagagacggcgtggcacttaggtggcagcgacggcagctgacaaggcaatgacatggtaaccacgcgggatcaacgccggcggctctattcggcggtgaggacggcaaatggcggtacaacggtgaaaaccgagagcacggagaggaagaggaggacgcgacgatccttaccaacacttacgcagcgatgaacagcgaaggagatggccgacgacaagctccgaagggcggcgagatactggtcaacgatgacagcggcgttccagcgatctttggcgaagacgagatggtggacggtgttctccttgcagctgcgaatctaatggaggcggcggcgaccgaaggcgacgacgggagtgcaaacatgttcatggagtattgcattggtaagtagaaagttgagcactattagcgatggtggcctccactgggactgtcctaacttagccatatattccatgctatacttacgacaccataataaactttgttgttcaagtttggtgtccttcagggaagaacaaagagatggaggtgaccaaagtagttttttaaagtgttttgagtagatttgtggtgcagtagtgtagatacaatttgtttatggtgttgatcattactactaaattttttatgatatagatagaatactctcttttgaaaatgaccgagggtaatcgttcgatgatattttaaaaaattatagctcatgagacataccaccacgataatatccatatcatcattttattatttatattttggcaaatatgtatagtgaaatagttctaaaaatataaaaacattttgagaatcttaatctcaaacaaattataatttaatcagaactacttgaaaaacacaagtgttgaagttattattttctaataatagatccaatctaatagtgtaaaataatgagtccaccaatttaagtgaaaatcaacggtgagattatatagtgcccatgtggtggcttagaagtgagtgccacgtagcgacttaagagcatccataggaggtttaatggacttttagtatataatagaatttttacatatgttgatttaaattgtgaagtgatattgccctccctaaaatatgttgtgatttttttgaaaagttatcatacatatgttggcctcatgtgccgtggtgtatttaggaccataatataacttttataatttaattaaagaaatacaacatgatcgcaaattggatatatataatttcaaaataatttagaagatggtttaaagaatatttattgggtattttatattttattatagatattagtttaactatatatatttatattatatttctgaagtaatatatttcatatttatattgtagaaaaaaccgtccatttttatatatctatgtttattggttgtcttttctatctatgttcgtacgtatggttttttcccgttaaaatcgcatgtactactcgtacgtcgtaagtactggagaacggtagtaccatagtagcgtttgtatctaaacagaatgaagttattactttcaataatagatgcaatctaatggtgtaaaataatagatcaacaaattttaatgaaaatcaacggtgagattatatagtgcctatgtggcgacttaggagtgtttataggaatgccacgtggcggcttatactacaagaatatatttaatctgtcacaaaatttccgtgatattttcagaaatcgtcatggatatgcaactattgatacaaggcccataataccgtgacagtttatcgatttcatcgtaaaccggcccaaaaactgtgacgttatatcaatttcgtcgcgatttacaaatataatattaaatacttcaaaattatgaatatcaagatctacaacttttgttttggtcattttgctatatgactctgtttcaataatttcaatttgaatttcaaattatgacaacttcaaacaacattttcaaatactaaatgatttcaagtgaaaaagtcatcaacaacaaaatatctgtaacttttattttgatcatttcttcatccaatagtaatattgtttataaaattttcacctcagccctagtggccgtgttttgccctagccgacggcgtacggtacgtcggtacataccgtggattaatcgatctccggctcaaattaatcgagccaaatcagtgcatgcatcaatgcatgggttgctgatgtgcacaatgagactcaccgatggttaaccggggattgacgaagcttggacagtgaagtctactccgggaacggctcaacgtacggcggcggtggtttcgcacggacggcgttggcgagttagggccatcggctaggaagaaggttagaaaaacatgcgcaagtgatcgatctattgctcaccggttgcggagaaatccacggctaagcttgacggccgagcggaggaagacgtacaatgggcgttctcctcgcttgggactcatcttggggttttctactcctgggagggatgcaagcttggtggtgttgcagtttggctagctggaggtggctcgagttagcgggaacggcgatgtcgatatatcggtggctgcagctgaggacgaggacggcgttcccgttgttcacggtgtcttcttcacgcagacgaggattggcattgttttctatttattccagatggtaaaagacttcttgtgaaggaaacagaactaccattttccttataagactacaatgcaccagatactgaatttctccaataatgtagccagaccaaccaagttgtatagattaaacgcatatttatcagatggttgccagtcggcagtaaagaaaattaagtgataatattatttctgatatgataatttcatttttaaacctaactaggaagatagcccgcgcatgtgcgcgggcttttaatataatgttgtttgaattttttttacgaatatttgcacgcaggtaatttttttcttgaaatattctttgattctatactaaacctgtttttgtcaataatttatttaggatttttttgacagtggttatgattttcttctaattacccttgtaacatataaattgtaaagtagaaatacttcaaaccatacagtcttgaatttatgagaatatattgtatggcaacaatggagtttctaaactttaaataccttttctttttttgtatagtgctccctctgttttttaatatataacaccatggacattttagatatctttgactattcgtgttatgaaccacaaattaatgttatgagagagtatatttatgaagagtgccatttatatattgatttattcggtttttatgatttgtttgcatatatgtggaataatttagctttgaatatttgtaaaatagtatatttgatttcataatatatactaagatttttagaaatttctaaggttgtttggatagcatgtaaatgttgtggatatttgaactattgagataaatgttagtgcttattattttacatgtaagaacatatagttggatccatgcaactacaaatataatattttagataaataccactactatttacaatatcggctatgtgctactggaatttggggaaattagaccagtgccactccatcacgttttccgtaaaaaatctctgttaccctcaactgcacgtgggacctaactgtcagttccaacttcacctccctcccctctcttctctttccccttcctctctctccaccaccgtcgttgacaaccaccgttgcagccgccatcatcgaccacctccgtggtgggaggcctcgagagccactaccgttgccactgttgtcttcgaccccatccatggtgggagggctcgggagccgccgccaccatcctcgacgccaaccgcggcgggaggcaagggagccgccatcctcaaccccatctgcgcgggagggctcggaagctgttgccaccgccatcatcgtcgttatcctcatagcagtagcggggatggaggaagagatggggaagaaagaagagggaggataggggaagatggaactcatatatgggtcccacgtctgggggtctgacggaaaacatgatggaattgcacagtctcagtttcttcaaattttagtggcacgtagccaatatcataaatagtagtgacatttatctagccacatttatagtgacatgatccatttaaccctaataaatatatgggtttaaactattgatttaattgtaaagctagactacaaccattcaaattaagtctagcaaaggaaaaatagagccaagtgccctagctagattactaaacattttctatcatcaatcagaccatcaacctgcttagggcctctaaatataggcttatgcttatcggtttcgatttttaagttagatttttagcttatatgccggtggagtcatacatctgtcttacataagccaattttttttccaacctagtttttttatttaatagtagtatataaagagtggcttatggctttaaaaaaaccaaaaaattgcttgtttgtttatgagtggcttatttttctcttctaattcgaagatcttttatagatttttggtgtgcatatgtatgcatatagatcatccataactgtgtggctatctagctagcataaaaatctatgcgtgattgcttggacagagttgggtacgtacgggacgcaggcagcggtatgtactgacatacgtacagggatgaaaatgaccgagggtaatcgttcgatgatattttaaaaaattataactcatgagacataccaccacgataatatccatagcatcattttattatttatattttgacaaatatgtatatccatagcatcattttattatttatattttgacaaatatgtatagtcaaataattctaaaaatataaaaatactttgagaattttaatctcaaacaaattataatttaatcataactacttgaaaaacacaactaaattgtgttgaaattattattttccaataatagatccaatctaatggtgtaaaataatgggttttaaagattgatcagatggttgataatagtgggcctaccgatttaaatgaaaatcaatggttagattttttaattgccacgtggcaatttgagagcgttttaaggagtgccatgtggtggcttgagaatgtttctaaaaagtttaatagatttttagtatataatagatagatagatagatacccttgtgcaacatgtccttcaaatgatgctacatccctcaagatcctgcatttatagtaggttgaatcaatagcatatggaaaaaagaaaaagggcactgctggcatacatgtaggattgcacaattctgtatgtttcagttatcagagaagttgatccttaagcttgttcgatttggagggaactgaagggagattgaggaagataattccacaccacaatagttatggaataaaatcctctctaatccctctccttggggattaactgaacatggcttaaatagaaaagataatgacatacaaagcaatgggattgaagaatggcacccacaactgagtttgagatatccaattatttatccaccattagttcctacagtagcattttgatggcgcctactagcagggggaaaatctggcctattccagccaaaatcaactggaatattgcttatcaagtactccaagcttttagcagagggaagtccaccttggtatattttaacatatatttggttattgaacatttagaacatgcacaatatttgtgcaaaaagattataagaaacttttggactttcagtttggttcatctcacatttttcttttgcaagtacacattctcatgttcctttttggcagtaatgtttgtaaatccacatattatacatatgggagtttttcaagaactaggaaggtagcccgcgcgttcgcgcgggcatgagtcgtacgccaagtttgaggtatttataaaagcgacatattaacaggagaacatctgccacgatttctccataaattatttttgtcagcattaatttattctttaataatattttaacctattagatttatattatatcaaatataagtagtatctataagtaattatttataatattcttcatcattttaaaaaaaaggtagatttattttctttagaaaacatgtcaacgaaagtaaaagtaagtgtaaaataaaaattaaggtgtttttatttttttaattgtataatatattatcataatatgttaaaggatgaattgggtgggacattaagctacacgaaaaatgtacgggtttatatagtctaatatgattgatatattttgagaggcgatctacctatgaacatttcatgtagagtgaatgagaggctccacgcaacctagcaggaatacaataacgtcgaaatatcattgcactgtaatatttttggaatttcatgtaccataaataaatacttgttaaaaggtataggagcgcacacatgcatgttatgcagtgagccagacagagattctgatagactttgtttttttcccaaaagatagatatgatgttataaaaattggatccatcggtttaaagtggaaaccgatggtcgattatatgagtgttttttaattaatagaatgccacatagcgacttagaagtgtttataggagtgctaggagcaatcatatgtatgatttagatgctatgatcattttaagatcatttatttatcttttaaatttaaaatatcatttatttacaaaagcatcaagatcaattcgtttatgtaaatagcccccacgtgtatgttgtgagaaattaataaagtttttttatgaagaaattaattaagttggtagaaagtcattagatgtctaacaatgtacttttaatgggttagtttcattaaaaaataagctagcatattttgattttcaatgacaaattttaatattttcttttatttagtggagcactcaagatggatgtaggtctagaatgcaataaattcaatatagatattaaaattatatatttatttgaaaaataaaaatagatatataatttatggtacaaataattgtaaagactcgtaaaattaatccggcctttattaaaaagtctaaaatagcacgtttaagtataaattagttaatatatttctttgttagtttaatgcgtacagaatgtaacgggtataacctttataaactttatttaaatagtgtatgatttgaaaataatgctcaccataaagggttcacgtatacctttatttaatgggtaaaaatatagtggtgtaaactttattttggaaagaaatatatcataatataatcatataagttatgattatataaaatttaactatattaactgttatctcgattatatatatatgaaaagaaaaaggagggaaggagatggaaccgtacgtacgtacgtacggatggtgtggaattgtacgttttaagatcaatctagttaatctgacggtatgtactagtggacccactattttaagtaaaaatcaatggatagatgcttttcttttttctcagaatttctttgatttctctaatttattagagcaccaagtggcggcttaggagcgtttgtaggaagattaatggacttttagtatataatagaaatagatattttgaaatgaacaattgaataatcaggaaaaagccgagaatgaaaaccacttccttctacatcatcaccaacaatttctgaatcatgttaacattcatagctacagattatgtgaacatcacccaagtgaactctttacaaaaacatatgaaccttattatagtgagtttagtaaagcactcataacaggcataggtagttcctatacgtactaatgaatcacccataaaaagcataggcagtttgtatacgtacgtacataccaagcacaccggaaaaccaaacacgtagtttggacgttatggtctcgggctaatacagcgcatattgcaatagtatagtg

SEQ ID NO: 67324 - DNA, 10477 bp, Oryza sativa
gggggggggcgaggagaggggattgggtggagggttcaattcaatttcgtcaattcgtttgcgcggcgcccgctgcggcccgtgcggtgtaggcggcggcggcggagcgctcgcgggggagcggcgttgtggctggggagatggtgaagaagaaaggcaagtatagccccggcgcgagcggcagcggcagcggcagcggcggcggcaatgcgggaggaggccccaggccgggcggcagggagacggtggtgtggtccgagaagatgaacgagtatctcatcgacgcgttgctgcaccagcaggcgatcgggaacaggggcgaggggaggtttcactccgcggccttcgatagcatcatctccggggtcgccgagaggttcggggtggccatcgacaggtcaaacatcaagaaccgtctcaagtccatcaaggagaacttccatgaatgcgagaacctcttccagaaccagagtggctttaagtggagcgcgatgaacaagaagttttatgctgacccaactgtttggagggagtacatcgaggtctgtttattttttgttgtcaatcaatcagcattgctgaaatttctcaagctgttttgaactctttgctttgatcttgtagaggaaaccggaagccaggaaatggatcaacaagcccattgatcattacgataggttactagagctattcggtaaggatagagaaagatgtctagcttctggcagcccaaagagtccaccggcaaaaaaggcgcgaagagacccaccaaaggagaaacctcaacggacaccaacaaatggtttggtgtcacccattgtcaaaagtttgaaagacatggaatctcaacggacaccaacaaatgttttggtgtcacccattattatcaaaagttcgaaagaaatggtgaatgaaaacgaggtatctatctctgaaactgaataaatatgagacatataattaattattttgctgacatgatttgttttcatttcgttgaatgagggtttagcattagtaaaattggtagggtgattggttgaatccttatttttccacctctaactatttgttatgctttcttatgcaagtgtttgtttcgtcaccaaaattgtggcatgcagtgtttctttagccctataaacctacatgtgataaacacagtattttactagcttggtcagaattattccgtggactatttggtcgcagctgcaagctacacttggcccaacagtaatctatgcaaagtagtctatgataaaatagggtaaccagatccttttgttcagtaggtgcatatgcatttttttaaaaaaaaatgcaaataagataaattgtaccttgagctttttgttattacctgcgtgctgcatgttctcataccgctgtacaatttctgtttgttattttgtgcatctgctgtcatcaaattgtctatcatttcattcatgcaaggttgtatgtaatccattgcatctcgccaaaacttcactgtacacaattgcttctctgcattgagataatccattgttctaactgttcttttggtctctttcacttgaccaaatcaaagaatgaatgcaagtctgcgcaatagtctctgagttcagtacatgagtaaaatttcggctatatgttcttgactgatgagattcctgtttctttcaggtccctagcgaggcggtaacagaaattaacatagctgaggagcaggatctatcagaaaagttcacaagtgagaatggtgctatgccagttgaaggtaattcatgtggtacaggtatgccctatgctcccgaaaactggccatgtcctggagatcaatggagctggaaagtgggaaacagggcttctgcaactggccactggcttgataggtaatgctgttttctaggcctaaatagcttccatctgaagttttttacttttgctataaggagaagaaaataaacacaggacactgattcttaattagaatcagaccaagtttggtaggtgaattcttctagtgtgttggaaggctcgtatgctattattcattattatttttagaactgggccagtagctctatcattccattaaggagaagggacactcatgctagtggtaggacttgaactgggtcgatggcaaggttaaacagcctcccaccaacaggccgctggccttccccaccaaaattgtttgagttatctatggttgttcggtctagaaaatgaattttagcagtactattaacttgtgttatggatacatctgtgaacaggtaccttacaccgccctcacgttttcgtgatgctactggtaaaaagacatcattcacaagtagactaaaggttgaagaatttatcaagacagagtttccagatatggatccgaacacattcttttctatgtttatttggaagatccctgctaaaggacactgtatccaaagaggttaaacctttctgttgccttttatgttcttttagttgctgtttccatgtaagattgtcttttacagtatttcctagcggtgctgtacaaccaccggaccagagactgggctctgacatcagctcactggcagttgtggtgactattggattctgtgcggtttagaatactatagcagaccattacagacgctgtagtgactagcggcttggactacatataataccaggtgcttatttgtagagatattcaccaagtagccagtgccatacaccattcatttcattgtgtgtattgggcgcttcttatgtaggattagaccttctttttggaaaaacattcatttcatataggagactatatttttttgtgacttactatttgattctcttgaagtaattaatatacaacattacttactaaaaatgcctacctgcctgaggacctttctgtgttcctttcctctatctaatagtgaccttctcgtgtaatcaaaatctgatttttgtatggcttacctttttcactgttattttgtataaacttccatattttgaatcttttatgttttaagtagctaacatatcactggaactctaccctatgtatccccgatccacatttttagactttcttttgacacagtctgtgccatcgattccttatcgttataaacactttgattggttttgtactttgatgcaccttcttcaataactttattcagctctaccacttagcatacctcctaactaacaggataatctagtgtagaaatgtgaaaacatcacaggttacctgccatgttacactggaaataaaaatggaaaaagtatacattggaaataataaagtcgataggcaacagtgcttctcagaatgcaatagattctcagtgtactaaccacacttttgatttttcttgtgcctatgcaccatcaatgtcgatatctgttatcatgtgataaatctcctgttacagtgcctctatagtgtagccaataaactatgttctcaatattgtttagccagaatgatatcctatctatttacaaaatacttttgttcatgtgtaatctgggaagtgcttcaagacttggttgttatttttggtggatgcgctttgaacattttaatgtttatcctgtgtataacacacatattttatccataaattagcgacaacgggccctgggctgctcgggcttcagccaggcctggtcctgaaagacccttgtaaccctttatagaaagtaaaatttacaggtatagagggcccataccaggatggtttgtttgcccagcctgggtaaagcccatttctggctccgccactgtatatataggttgttctacacagcttacctcttgcactctctgctcctaaaccctagccgccaatctgatccttgcttctgcctctacctcatcgtggtgccgatggatccatttgcgcgaaccaactcattgaggcggatccatgaacgctatctccttcccccttcggagagtaacactgacgctggtttttacgtctatattctggagtcaagttacagtaagctccattcttttctatcaagtggtgttttccattgattcaagtggtgtttttccccaaatcgtaacaccgataaaggaaaatagatcatttgcctcattcggaattcatatgtagcatataaactgattttgtcttacttttattcatatctaacctggtattgatgtgaggtttgatccaataccttggttgtaacatgtagccaaagggatttttttcttcacttgagatgtgtgttctttcctttgtgtgttaacgggttagaaaatgcatcctatatactgcctttgcatgttttctgctactttgttgattttcccttgtatttttgctgttctttaacaccaaaaatgtcttcaggaggtggagaagtgaggagggtcttttgtccttatgcaaggcaagctgatccagctggaccatgcaaggccaggaataacttgtgtaaacttgagagagagggattcattgaatcatctccggcacaggattgtgacctctgctgcaaaatgcctgatttctgccgagagtgctgctgtgttttctgccgcagggttgttgactattcctttggaggttatagctacattaagtgtgaggcagtcctagaagagaacaaaatatgtgggcatattgggcaccttgattgtgctctccgtacttttatggctggaacagttggaggatgtattgacttggacatgcagtattgttgcagacgttgtgataacaaaacgaacttgatgctgcacgtagaaaaattcttggaaatatgccaatctcttcaatcaagggatgacattgaacctatcctgaatactggcttatgcctagtgcgtggttcaagacaaacaagagcaaaaagcttggagagcattatgagatcagcaatggcaaaggtatggtcagttttatttttttagccacttgtggaaacttccattttggtcaccatttatcttctttttgatctcttataagtagtttgtggctatgcactgatggtttacaactatatgcagctaaagtgtggggttgatcttgctgaagtttggaaaatggaagataatggtatcaactcaactccaagtgcaggtaacttaattttgaatgcaactgatcatagagaactatattaggcaaatatattgctctagatatccagaggacaatccattgctcaaacagcgcccagcctagctgcaatggcccagatatttggtgccctcttatgttattagacagaacggaaactctatagattatgctgatatttggatcatactagtcaaaaccatctgcgatttgttccatacagaccatttattttgaaaaatgtaagtgatgttttggtagtttttgtaacatgtggagtctagctcccctgtcatgcccatggcttcattgctatagatatactgctgctaatcatgttgtctgtaattttgcacaattaaaaccatagaggactgacaacaatttggatctcagatttacttctgttgttgctttatgtattgctttgctgctataattgtgcataattgagttccatatgtctcatgcagaagtttcccctgctaccggtggtgtaacagtgcttgggatccagcaagctccagaagaggatgctcctccagggtttccatattatgttgatttggctgacaatgatttgcagagggctgttgaaaatcttccagcttacattaccgaggatcaacacacactgtctgtcaggttcgaagattcgatagatcatgctcttaaagaactgaagagatctcaggaagcagagtacaagctggcagagcagaagctttattcccagaaggatcatgtcctgagtctttatcgtcagcttgattctgaaagatccgtccttgcagaccctatgcccttagctgatgatgatggttcactatatagtacactaatcaccaatgttatgaagcgtgtggatcaagtgaagagtgaagaggagaagctcaaggtcatgctgggaatcgctgatggatttgggaaaacgccatcaggagtcattcaggagcatttcgggctacctgctgatactgccaactgagagtgcctgctttgttgtactgtcgtatgagtttgttaccaacccatctggtttggactaaaccagtaataccgtgaaactcgcggtaatccgtggacatgcctttaggaaccttcgctctccctaataccagttttaccgtttagcagtaccagttttaccgtacttaaagtgatcgttctactgtcagcgtcgtttatccttgtgttcttctgtcgtgtaagtaaatttacattacaggttgcttctgctgcagctgctgtgatcccagagcaatgttggagaggtaagcatttacagattttgactagaatgagcagcagcgcagcacggaggcaattttcctttcagtaattactgcttgtcagttgtaagattaggcgatattcctgttggaatcgcaatactgaagaattcatggagctgaaggaaccccggcgattgatgaaatctgcggtggctgagtaatctgatgaaatagtagatcagctggtgacatcaggtctcgctcgaagcagcagcctgcagcctgaggattgatttgttggttgcggctattaatatactccctccgtaccataatataagggtttttaagtttttgcttgcactgtttgaccacttgtcttattaaaaaaattattcaaatataaaaaacgaaaagttgtacttaaagtactttggataataaagtaagtcaaaaaaaataaataataattctaaattttttttaaataagacgagcggtcaaacagtgtaagtaaaaacttaaaatcacttatattatgggacggagggagtatcacttgatttaggactcctggtcatctggaatctcgatgctgtcagacgaatcttcagcatcatcgtgctgagtcattggctcattgcacctgactccattgttgcgctcgttgagttcagctccatatttgttctctcctgaattgtttcaaggaattgtgaatggattttccccacctttgccagccctcttctcaaacgtgttaaggttggaaaatgtgatagatgtagagatggatgtttgagcagacggcacagtttcattcatgtttcatgaccgaaatttagagttccccaaaccaatcttttttgttcttggttgaaattcgttgaatttatttctcttgaaattcacgaaatctaccatctcgctaaggctgacattttaacaccaaaacaaaggaaccctgggcatgagacgaatgatgggtctgggcgtctggccacacagaggggaggatgaagaacagtactatgtttatgtggcaaggattcgagtttgaaccgtacgtattttctcagaatacactaccaatcgagtttgataacactactgtacgtatgtaccatcgatcaactccctccgtcccaaaataaacataaccatgagttttcgtgttcaactttaatcattcgtctattttttaaaaaaaaataagtcacatataaaatattattcatgtttgataatataataacaataaaatattaattataattttttttaataagacggaaaatcaaagttggacacagaaactcatctctgcgtttattttggaatggagggagtaataatcaagatatgatcttgataatcagaataattcggcagttcttaccccgttcatctgactaaacatcacatcaatacaaccaaaagaacggatacacagtgtgttccaccatcaatctcacaggagatgagacgaacaaagcaaaagctaataaaaaccatcctaaacaccacccttcttcaagccagagtctttgaagtcaggtcgggttcgcctgaatcccgccggcgccgccgtggaaccgtcgcctggccagcctctggcgagcccgcctcgccaccgccgagcacctggacgccaccagctccgccgcggcggggatcagccgcgtcccctcgaacaccacgctcctctggtactccaccacccacgtctcggcctccagcctcaccgccggcgagctccgcccaccgtagctccacgagctgccgttgctcgccctcaccgtcggccacaccctcccgtcggaccactgcaaaaatggcaacaacgacgcggggctcagctagctagctgcaaatgcaagattggttttctgggagtttgtatcggttatgccctgtttacatctcgtcctaaaatttttcaccatatcacaattcacatcgaatttttcaccatatcacaattcatatcaattcatatcgaatgtttgaatatatgtattaagtattaaatatatgctaaaaaaaactaatagcacagattgtgactattttgcgagacgaatcttttaagcctaattgctccatgattgataatgtggtgctacagtaaacatttgctaataacgaattagttaggcttaataaattcgtctcgtggtttactgatggatttttttttagagaagggtattttctacccggcctccatatctaaccggatatatacggccattgagatagggaagttagccccgcaaacaatccaatctgaaattcactccatagaagatttaaactcaggacttttgggtactactcaggtcactgtaaccactatattacatgtcatttcgtaattagtttttttaattagtttttcgtaattacttatggattctgtaattagtatttttattagtaccgaacacctcatgcagtatcctatataatatctgatatgacacgctaaaactttagatcctagtaacacccccttagtttacctcggtgatcttgccggagaggatggtgaggtgccgtgccgggagcgcgcgggggaggaggccggaggtgcggagtgggctcccccacacggtcacctcctccgccgccgacttgtacacggcgcagcgccagtagaacacgcgctgatcattctgcgcgagatcgagatggaaatctctttaacccaaatcaagaattcaacattctcgcaggaaccaaaaagggaaaaaatgttaatacctgctcgaattgccagacggaatcgtgcgagctgcagttggagatccccttctcgccgccgacgagctgcccgagcatccgctccagggcgcggagcttgtggctcaggccgcccggcgcgaggcgcgcctccgtggccagccgtgccacggcctccggcgagagcttggggccgaagcccctcgccgcgatctccgggacgaggccggagtccacccagaggaggaggaggaacccaagaaccgtggccgtgtagagggcccagtcatgcgatcccccgggggtcttcctcccggcgccgccaccgccgccgccggccgcctcctgctgctgccggggcctcctcgacttcgcggtggaccgcatcggcggcgtccacggctccgtgacggaggagccgtgcggcgtcgtgtcggcgccgccgaagagcgggcgcggagcgggcttcctgtccctggccgccgcggcgaaccacctccgcgcggaggcggcctccggcgggaggaggtccctggtggcgttgatgctggcgaggcacatctcgcacgcgcagttggcgtccttgcggcatcccgggtagtagcaccctcctcctcccgcaaccccatcccacggcacgactatggtgggcggcggcgtccgcgccgccgccgccgacacgctggggttggagttcgaggagcaggaggacgcggtggtggagcagcgcgtggcggtggtcggtggcgtggtggcggcgctcggcgctctcctcgccgccatctccctctcgtccatggcttggctggatggtttctcggagctgtgagttaatgcgaggcggcggcttggagaagaagaagaagaagagacgagttgaaaaattttgaaatcgcgtggtggcacaacggcgagcaacggtcgactcctggtcgtggggtgggagatctggtgattgcagtgtggctgacgtgtggggcccacggatgatccgtgggggctttctgactttggagttcggctttccggtaaatgaacctacagtactgaagtgttaatgggccacaccagacaccagtttaggcccccgttcgtttctacacggaataagttcatctaagatctcttaatttatcaacgaatccgattttcgtcattcaaccggaaaaccagatacaacgggtccctcaactatcaaaaccagtgcagatgagctccctcggtggttttgagggtagttttggctgacgtggcgctacgtagcaaatttgacttggtcttcatctgatgtggcattgacgtggcgcatacgtggcaatttgatcccgaaaaataataaactttgtgggacccacatgtcagtctcacacataaatgaagaatggtggggcccac

SEQ ID NO: 67325 - DNA, 2533 bp, Oryza sativa
  unsure (1)..(2533): unsure at all n locations
atgcagcgtttgttccttcttccttcttggcggcggcgtcctagctctgcaccgccgttaagcaacagccgttccggattccatggacagatcagatcaaattcgttattatctccatctcaagaaaaaaaaatcttgagagctatatatatatcgcatcgctcttgcagtacatttttccatccgtttgcaatggcgagaatactcctagcgttcgccggcgacgccgcgtcggcggcgatggcgacggcgaccggcctcgggcggccgtggttcatggcgttgtgcatggtggtggtttgctcgttgaccgtctcgttcgccgtcttcctctgcggccacagctccggcgtccacgacggcgatctcctcaggaagaagaagcctatgaaaccaccgccgccttcatccaagaagaagaaggtgtccacgtcgatgtccggcacggtggtcgacacgacgggcatgtatacggcggcgtacggcgtcgccgtcgtcggtggacacggtggccatggcggcggcgggtgcggtggcggcggcggcggcggtggtggaggcggttgctgcggcggcggcggtggctgtggtggtggtggtggtggcggcggcggcggcggctgttagacttgccggatcttgcgatggctttgcatggacagtgatggctgcttggtcattgtaaggtagtcttgtgatctctcctgtgtttggcctgatgttaatcttaggaaatttttgttacaaatatttgtgtcagtttgtagagattttgatcaatgctaatggattttgacatcttgtcatctgttcatgaggtcaacaaaaaacagaatccttgtgtaaactaggggcttaggggtttgtagttctgaatgtgttcatgaggtcaacaaaaaacagaatgcttgtgtannnncnncccggatttgtagttctgaatgtgttcgctagattgtgacttttaagtgctttacagtttgtcgtcaggatatttcaaaatgtgacaaatcagactttatcgctcgttgaaatactcacaaatattctcgcaaaaaaaaaagagaatatactacaatcataagataatttaatagttaggtactagatagactatcattgtagtatgcacttgcagtcaacagtaaacagctttagtcaattcgatcgcccatttgcccacaccatttgtttccctaatatgtcaaactcaatgccactacgaatcaattgtactccagtgccagattcataatcagtgcacaaagcagagacaaaaagccttcactggatcacctctgccttaaatatcgcctcaatactttgaacgacgacgagcatgttgaacatgcaggcactgcacatggcaagcaggattcagtaggtgaaatttcgacgacgacgatgattaattttctaatttcgaagcgaactctgcttcatttaaaaaaacgctgcacatggcggtcagtgaaggtaattcagaaggtgaaatttcgtctgcagtgttgttctctgaattgtagaataattttctccttccaaagctttgctccagttcattcaggattatcgtactttgcaagtgactgttctttactcaatgtccaaatcacttttctaagaccacgtttcaggctattgctgcaaatgcagaatgaacattttgggtataaagctgtccaaaaattcatcctaaaatttgcacacagttttgccacatcctctgaatctgtagatgtaaagtcgtgtgcagcaaaatagcaaattgaatggcatactctgaatctgacgagtgagtgaaagctgcagtagtcaagcacgcagacttgcagtctaaccagtttcagcctttcaggttttgctgatgccaataaaacacctacctgttccttgcattctgacaaaattttctctgaactgatcaacaacgaaatccttgaactccacttgatctgtctagtactccctccgtttcaaaatgtttgacaccgctgattttttatcacatgttttaccgttcgtcttattcaaaaacttttgtgaaatatgtaaaattatatacctacataaaaatatatttaacaatgaatcaaatgatatgaaaagaattaataaggttaaatatatgctaaaaagtcaacggcgtcaaacatttcgaaacgggagtattagtatttctctcgttccttcgtaacttaatcgttaagaaatcagcagcaggttcagcactcggtcgccatcactccatcagaaaaatgatcacgattgaatatgttaaaccactactactaagcaagccaatcggcgatttgattgcttagctcaaagtacgctcaactaaccgggaaacctacaccgtattgacccggccaaaatctagccgtctatacatcaatttatcagaataaatttattcacatgattaattctcagaatattttgcttaattcttagagcgattcgtgcacaaattcgttgaagtgcaaagtcaaatgcagaatcacacatgcaatttggctttttttttttg

SEQ ID NO: 67326 - DNA, 2279 bp, Oryza sativa
tccttttttttctcccaaatcgatcgatccaatgtaaatttcttgaaatcttgatctttgatgctcttgctttgaactcgcgatcatatgtaaattgatcgatcaagctgatgtgctcttggtgttcttgagtattagcatggaagctcatcagttcctcttcgatcaatcctatgtaaattccttgaaaccttaatcttaatgttctcttcctcacttgatgctcgtgctttcaacttgcaattctatgtaaattgatcgatcaagtagatgttcttggtgttcttgagtattattatagcatgaaagttcatcagctctcctgagcttgtgaaccaatttgtgttttgtttgttatcgattagtttgatcatggcatgttcagattggtctgccactttcaggtggcaaagcacacaactgatgcagcaaatatctatctccaatatatcattttcaagtgtgcaattcggagttgggagttagttggggggtaggcaactttattagtagatgagcagctgagctcccctctcgtagtctgaagcgactgcaaaggtgcaaagccgagctaacacgccaacgcacgcaattcaggggagcaacccaatcaactcccggagtcaaaaaactggagctgcacactggattctgcggctgcaaacttcttgattttcttgcctatttttccaatctatgtacaaaatcagccgtgagtaacagtgtgaggagtggaattctgcaacgtgtatgatcaactgcacagcataaattgcttaattaaaacgtgtgtggggtcagctccgacaaaaattagcacatagagtggatattctgggctaatactatttacttcatccgtcccaaaatttaactatttttagacgatacggtctacaagatgctactttaaccaacaattaccccataaaaataagatattctaaataaaaagagttacatattatgatagtttttttaataataaatctataaacatcaattttatattattgatcttttttttattaatagtcaaagtttaaaatgtttggcttatcactatgctaaaaatgcttatattttaggatggaaggagtatttttttcgctaagtgcataatttagaaaataaattagtatatgattagtaaagctacggctaataagctatggaaaaataaacaaaagaaatgatataaggataggattggctgggttaaaaaaacaaaacgatgaaaaatcacctaactgaaaattactaattttagatgccatttacaataaaaagaagaagggtaaaatataggcagacgtatggcccggatccatgcgaagattcatgacccgataaaaaatcaatgtagaaaataaattaatgaaaaacaatgcagactaggggtggatagcgagccggctcggctcggtctagctcgttatcctaacgagctagaaacccagctcggctcggctcgtttgaaagctcgagccagctcgttagactcgcgagccaatccaacaagacagcaagctccggaggaggggacctgtgagtgcaacctacgccttctctggcagcggtggcggcggccctagcgccggctggggaagtgcggctggtggcggctgcggctggggaagtgcaacggcagcggcgactctagcggcggtggccctagcggcggtggcctagtgcctgctggggaagtgcagtggcggttggggaagtgcggctggcggcggcagcaggggtgacggccctagcggcttgcggcagcggcgacgcgagcgcctggcgacagcggcggcgcgagcgcctggcgacggcgtcggcgcagtcttgtgcggcgaagcgatgcggatgtgcggtctcgactctcgtctcgtactcttgtgtggtgcggtggtcgacggatgaggaataggagtgaccgagtgaggagaccaagagaggactagggttttgcttttgctgttgtcttgggcttgggcctttgctattgtattgggttgggcctttgtggttgtctaataagtcctggctcgttaaggctcgcgagctggctcgagtcggctcgttatccctaacgagctaaaatgccagctcagctcgttaagaaaatcaaataagccgagccgagtctgtcacgagccgagcgagctaacctgtccaccctaatgtagactatgtttgttctcttagtttggagaaagttttgtagtgcacgtgaaacgagaaaactcaatgcacataattaattaactattatagatttaaaa

SEQ ID NO: 67327 - DNA, 3305 bp, Oryza sativa
taataataataataataataataataataataataataataataataataataataaacacaaaaacaaatccatcacccaaacccaagtgaagagaagcagcaaagagagagcttttccatccccaaatcccctcctcctcctcaaaccctagctaagctccgcttgcagcagccatggatcccaccaaatccagcacgccgccgccggtgatgggcgcgcccgtcggcttcccgcctggcgcgtaccctccgcctccccccgccggcgccgccgccgccgcctacgcgcagcagctctacgcgccccccgccgccgcggcggcgcagcaggcggcggcggcgcagcagcagctgcagatgttctgggcggagcagtaccgcgagatcgaggccaccaccgacttcaagaaccacaacctccccctggcccgcatcaagaagatcatgaaggccgacgaggacgtccgcatgatcgccgccgaggcccccgtcgtgttcgcccgcgcctgcgagatgttcatcctcgagctcacccaccgcggctgggcgcacgccgaggagaacaagcgccgtacgctgcagaagtccgacattgccgccgccatcgcgcgcaccgaggtgttcgacttcctcgtcgacatcgtgccccgcgacgacgccaaggacgccgacgccgccgcggccgcggcggcggccggcatcccccgccccgccgccggtgtgccggccaccgatccgctcgcctactactatgtgccccagcagtaatgtatctgattaacccctttcaagccttttctaagcgaaggatgtgttgttgtttgttgttgctgttgctgttcttgttgttgttgttgccgcgtaataagatatgttgataatttatggcttcccctgagcttaaagaatttgagcttttggttctagaatctgggtaaaattgttgtaatggggaagactgtatgactgtatttgtagtgcatgtcttaacttgtcggatagtgtaatccgataattattatgcggttagctggttacctctcatgattactgtgctcatgtgctgtgcaatttatgttctttgttttggatgtacaatgctgtaaccagaatttggttgtgtaaggaaactattaaaggttgtgcgagggcagtgtggctatcgctgcattttagcttacaagtccctcgtatgcagtaaggtttatgtgttcaaagccaaatgcggaagcttttcgtcaatgaagttgacacacttaacttaagtgccttataggtttttgctattattgatgtggttgacatacttggttgatttggtttgtcattgacaatttagctcttgtgtttggtttcaaggaaggttcttttttttgtcaaaacatgaagaaacaaaatatcaaatattgcctctccaatcttatacaccctccacccacaaatataaagaatctaggttgtttagaagagtttaatgttcaggtgaaattactttgatgcccctgggtgtttacttgattgggaaagatcattcctagtgatgcaactactagtaagtaataaatccaaaatcccttatattcgtggataaattttgaatcccaaaatcccttatatttgtggacggagtgagtatatagttactaaacaatagttccgcatttctaatttttcacctatggttgtatgggtttgcagaattatgcagttttctttttgctattgtttcgtagggcataaagaaggtaattaattcggttcttatttatttcctttacgcttctgtattttcagtcctcagtgtgtagagtttaaagtagtgatgtcatgtgtaagtatggattttcttttaccactgaatccctcatgcgaacttggatatgtggtccttttctgcacagttagtttatcaacacttcttggttatgtaatttgcagctactcatgtggaacaaccagcactacaaacatgcatttgcagtacacatcattcatcttaaactgctttacctattgggtttgctgataattatggctttaaagttagcaatgcccatttcatactgtaacggttatttgcttctgaaatcatattgaaatgtggcatgttatgcttcagaacatcattgttacgttccaatttgttcatgtgactttcatcctgttctatgtggatcatctacccaggcaggagcattccatgatactgcttgcatttgatatttggaaaagcttttgcttttagcatttgttttcctctctttggaatagcttcctctgacccagtatctgtatattattggactgcagtttataccttgtttcttctgattttattggctgagactatgctcttcctggaatgaaatgacaagtagttattacctctgaaggaaaaagtacaccagtggtctctcaacttgtcatcgagttacagaatcatcccccaaccgcaaaaccagatatccggcgtccgtcattcggtggttttgaccctagttttattcgacgtggcggctgagtcagcgtgggccccacctatcaggatgccacgtgccaccctctctctccttcccctcctttcacttcctctctctctctcgctcgcttttctcctctaccaggccagccggcgggtcgtaaggtcgccggggcgagaagggagaggagaaggcccgacggctggcgacaggcgacgaggcggcggcggcgacgcgggagcaggccggttggggaggaggccggcgacacagaggccataggccgtgcgggccgccgccagggacatctccacggccgccgtcgtctgggcgctcacgcacgtcgtccagcacggcgacaccatcctgctcctcgccgtcatgctgctgccgcacagggcacaactctggtatacatggccatgccttcctcttgaacagcttgccaatttacaatgccatttttatactgtatgattgagctctttggatttgtcttcatggatgaactttcactagttcaattacagttcttttcctctcgttttcaggcaagaagtcctgggagtttccgctctttgcagggggttgtgcgagcggccacaggagcgtgttgattcagaattcggatgtcgcttatttgtgtaatcaaatgatgctaaaacttcgtgatttttatgatccgagcaaggtacaaaaaggagcgctgttgtgttttttcagttcaatattccagcacaagcacaagcacaacaaaagcacgatggcagtggtgggagacggcggggcggtggccgtcatcgagcggcggcgcctgggcttg

SEQ ID NO: 67328 - DNA, 2023 bp, Oryza sativa
ttcgttccatgtcgctctcacgccgtgcgaatgtgccatgatcctgcatgcatcatcgccaagattatattcctcacattttttcttcctatcgctcctagtcgtctgtttgggagcttaaaattatgaaaagcagctgctgagaagctagctggtgagaatctgaagaatttgagttctagttcattctccagattctacaattacagattcttataatttaggtaaaaagctggactgtttgggagcttctgtcagccggagattctgtgagaagctgcagctgctagaagcttccccaaacagacccctagttgtactccagctgatcgattcactctattttatatgcaccttgctctctagcttatcaaacgtagccaagacttgaattttaaagcttaaattgattttgatgttcttttcatcgtaattcacttaccgaccttagtcggcatttgaatttttaaaaataatttttagagctgattttgatttttttttcagcggaatttattttcacgtatgtaaaagttttacctataaattattaattttcagcggagtaagcattagtgttatgggttataatcatctggtatgcttaaaatctctttacttggacttagttgggacaattgctaatgcattctcgtgcccatctctataaatacggcctgctagctttgctcttgtatctgcacacaagaactagctgcaaagtcctcaaggcgaacggcctccatcttctccttccagctcctcccatggcgtccctcgtcgccatcgccatcgccatggctctcatggtgcagaggatatcccagccatggctgaaattaacttgacgcatatcatctcatcatcacttgcatttcaacttctggattgtgcagacatgtttagctgatgcagtaaacgttgcctgtttgaattggtccttgatcaggtggttcaacctggccggcagatgactgcctttgctgctcggacgtcgccggcggcggcggcggaggcgttctggcgtgccgccatgcccggcgctcccatgccggacgccatcgtcgagctcctccaccatggtgaatccgtgaacttaattgtgtacactactttaaatgatactagtattagtgatggtcactactagaaaacaagtttttgcaggcagctagtaaatatttcgccggtaggctaaggcctgcgaaagtcgttgatttttgcaggcggagcctctatccgcttgcgcagacggcatccttgtatcacccacttgcaaaaagtttttgggggcaaaaaagaaaaagattaaaaaaaaagcaatttccactacatgcaaagcatcctattcaaatcaaaatcagattcattcaacaaagaaacaacatcgaacaggcagctacaatcagatgcactagaataaacactataagctgacatgtaagatcctcacatatatgaatgcttttgctgttatatatctatttttttaacgacggttatatatctaattaactaactatactataaacttatcttttgttttttgcttttatcttttataatatccgttgcaacgcacgaatctttagctactgatcataaaatgaacagaaataagagattatgtttttatacgtgggagcctctcttacatgcgtagctgcatgcgtgcatgcagagcacggcgttgctagcgccggcggcaaggccaacggcggcggcgacggtccaccgccgccgatgaacttcaactacgacgactacagggccctgcctcggagcgacgccccttccccggatgcattgaaccgcgtcgccgccgtacagaacgccgacgagaacggcgtgtcctcgccgccgccgccgccgccgacggtgttcttcctcgaggacgccgtgcgcgtcggcgagagcctgcccctaccgcgaccggcggccgacgcaaccgccgccggcgcagcggcggccacggcgttgccgccgctgcggctgtacaccgtccggtcggtgagggcaatcg
